United States Patent 12,569,549 (FLAVIVIRUS VACCINE) - sequence listing, part 17

SEQ ID NO: 8282 - RNA, 9879 nt, synthetic construct
  misc_feature 1..9879: note = derived and/or modified CDS sequence (opt1) from DENV-1__EU660393__SS-prME
  source 1..9879: mol_type = other RNA
agcgtgaccatgctgctgatgctgatgcccaccgccctggccttccacctcaccacccggggcggggagccccacatgatcgtgtccaagcaggagcggggcaagagcctgctgttcaagacctccgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgcgacaagcggtccgtggccctcgcgccccacgtgggcctggggctggagacccgcaccgagacctggatgagctccgagggcgcgtggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaaggggatcacccagtccggccggctgatcaccgccaacccgatcgtgaccgacaaggagaagcccgtgaacatcgaggccgagccgcccttcggggagagctacatcatcatcggcgccggcgagaaggcgctgaagctctcctggttcaagaaggggagctccatcggcaagatgttcgaggccacggcccgcggggcccggcgcatggccatcctgggcgacaccgcgtgggacttcgggagcatcggcggcgtcttcacctccgtggggaagctggtgcaccagatcttcggcaccgcctacggggtcctcttcagcggcgtgtcctggacgatgaagatcgggatcggcgtgctgctgacctggctcggcctgaacagccgctccaccagcctgtccatgacctgcatcgccgtcgggctcgtgacgctgtacctgggcgtgatggtccaggccgacagcgggtgcgtgatcaactggaagggccgggagctcaagtgcgggagcggcatcttcgtgaccaacgaggtccacacctggaccgagcagtacaagttccaggccgactccccgaagcgcctgagcgcggccatcggcaaggcctgggaggagggggtgtgcggcatccggtccgccacccgcctggagaacatcatgtggaagcagatcagcaacgagctcaaccacatcctgctggagaacgacatgaagttcacggtggtcgtgggggacgtggccggcatcctcgcgcaggggaagaagatgatccggccccagcccatggagtacaagtactcctggaagtcctggggcaaggccaagatcatcggcgccgacgtccagaacaccaccttcatcatcgacgggcccaacaccccggagtgccccgacgaccagcgcgcctggaacatctgggaggtggaggactacggcttcgggatcttcacgaccaacatctggctgaagctgcgggactcctacacccaggtgtgcgaccaccgcctcatgagcgcggccatcaaggactccaaggccgtccacgccgacatgggctactggatcgagagcgagaagaacgagacctggaagctggcccgggcgtccttcatcgaggtgaagacgtgcatctggcccaagagccacaccctgtggtccaacggcgtgctcgagagcgagatgatcatccccaagatctacgggggcccgatctcccagcacaactaccgccccgggtacttcacccagaccgccggcccctggcacctggggaagctggagctcgacttcgacctgtgcgagggcacgaccgtcgtggtggacgagcactgcggcaaccgggggccgagcctgcgcaccaccacggtcaccggcaagatcatccacgagtggtgctgccggtcctgcaccctgccgcccctccgcttccgcggggaggacggctgctggtacgggatggagatccgccccgtgaaggagaaggaggagaacctggtcaagagcatggtcagcgccggctccggcgaggtggacagcttctccctcgggctgctgtgcatcagcatcatgatcgaggaggtgatgcggtcccgctggagccggaagatgctcatgaccggcacgctggccgtcttcttcctgctcatcatggggcagctgacctggaacgacctgatccgcctctgcatcatggtgggcgccaacgcgtccgaccgcatggggatgggcaccacctacctggccctgatggccacgttcaagatgcggccgatgttcgccgtgggcctcctgttccgccggctgaccagccgcgaggtcctcctgctgaccatcgggctctccctggtggccagcgtggagctgcccaactccctcgaggagctgggcgacgggctggcgatgggcatcatgatcctcaagctgctgaccgacttccagagccaccagctctgggccacgctgctgtccctcaccttcatcaagaccaccttcagcctgcactacgcctggaagacgatggccatggtcctgtccatcgtgagcctcttccccctgtgcctgtccaccaccagccagaagaccacgtggctccccgtcctgctgggctccctcgggtgcaagccgctgaccatgttcctgatcgcggagaacaagatctggggccggcgcagctggcccctcaacgaggggatcatggccgtgggcatcgtgagcatcctgctgtccagcctcctgaagaacgacgtccccctggccgggcccctcatcgccggcggcatgctgatcgcctgctacgtgatctccgggagctccgcggacctgagcctcgagaaggccgccgaggtgtcctgggaggaggaggccgagcacagcggcgcctcccacaacatcctggtcgaggtgcaggacgacgggaccatgaagatcaaggacgaggagcgggacgacaccctgaccatcctcctgaaggcgacgctgctcgccgtgagcggcgtctacccgctgtccatccccgccaccctgttcgtgtggtacttctggcagaagaagaagcagcgcagcggggtgctctgggacacccccagcccgcccgaggtcgagcgggccgtgctggacgacggcatctaccgcatcatgcagcggggcctgctggggcgcagccaggtgggcgtcggggtgttccaggagaacgtgttccacaccatgtggcacgtcacgcggggcgccgtgctcatgtaccaggggaagcgcctggagccctcctgggcgagcgtgaagaaggacctgatctcctacggcggcgggtggcggctccagggcagctggaacaccggggaggaggtccaggtgatcgccgtggagcccggcaagaaccccaagaacgtccagaccgcccccgggaccttcaagacgcccgagggcgaggtgggcgccatcgccctggacttcaagcccgggacctccggcagccccatcgtgaaccgcgaggggaagatcgtcggcctgtacggcaacggggtggtgaccaccagcggcacgtacgtctccgcgatcgcccaggccaaggccagccaggaggggccgctccccgagatcgaggacgaggtgttccggaagcgcaacctgaccatcatggacctgcaccccggctccgggaagacccggcgctacctcccggcgatcgtgcgggaggccatcaagcgcaagctgcgcaccctgatcctcgcccccacgcgggtcgtggccagcgagatggccgaggcgctgaagggcatgcccatccgctaccagaccaccgccgtgaagtccgagcacaccggcaaggagatcgtcgacctgatgtgccacgccacgttcaccatgcggctcctgagccccgtgcgcgtgccgaactacaacatgatcatcatggacgaggcccacttcaccgacccctccagcatcgccgcgcgggggtacatctccacccgcgtcggcatgggggaggccgccgccatcttcatgacggccacgccgcccggcagcgtggaggcgttcccgcagtccaacgccgtgatccaggacgaggagcgggacatccccgagcgcagctggaactccgggtacgagtggatcaccgacttccccggcaagaccgtctggttcgtgcccagcatcaagtccggcaacgacatcgccaactgcctgcggaagaacgggaagcgcgtgatccagctcagccggaagacgttcgacaccgagtaccagaagaccaagaacaacgactgggactacgtcgtgaccacggacatctccgagatgggcgccaacttccgcgcggaccgggtgatcgacccgcgccggtgcctgaagcccgtcatcctgaaggacgggcccgagcgcgtgatcctcgccggccccatgccggtgaccgtcgccagcgccgcccagcggcgcgggcggatcggccgcaaccacaacaaggagggcgaccagtacatctacatggggcagcccctgaacaacgacgaggaccacgcgcactggaccgaggccaagatgctgctcgacaacatcaacacccccgagggcatcatccccgccctgttcgagccggagcgcgagaagtccgccgccatcgacggggagtaccggctgcgcggcgaggcgcggaagacgttcgtggagctcatgcgccgcggggacctgcccgtctggctgagctacaaggtggccagcgagggcttccagtactccgaccgccggtggtgcttcgacggcgagcgcaacaaccaggtgctcgaggagaacatggacgtcgagatctggaccaaggagggggagcggaagaagctgcgcccccggtggctggacgcccgcacctacagcgaccccctcgccctgcgggagttcaaggagttcgccgcgggccgccggtccgtgagcggggacctgatcctcgagatcggcaagctgccgcagcacctgacccagcgcgcccagaacgccctcgacaacctggtgatgctgcacaactccgagcagggcgggcgggcctaccgccacgcgatggaggagctccccgacacgatcgagaccctgatgctgctcgccctgatcgccgtcctgaccggcggggtgaccctcttcttcctgagcggccgggggctgggcaagacctccatcggcctcctgtgcgtgatggccagctccgtcctgctctggatggccagcgtggagccccactggatcgcggcctccatcatcctggagttcttcctgatggtgctcctgatccccgagccggaccgccagcggacgccccaggacaaccagctggcctacgtcgtgatcgggctcctgttcatgatcctgaccgtggccgccaacgagatgggcctcctggagaccaccaagaaggacctggggatcggccacgtcgcggtggagaaccaccaccacgccgccatgctcgacgtggacctgcaccccgccagcgcctggacgctgtacgcggtcgccaccaccatcatcaccccgatgatgcgccacacgatcgagaacaccaccgccaacatctccctcaccgccatcgccaaccaggcggccatcctgatggggctggacaagggctggcccatcagcaagatggacatcggcgtgcccctcctggccctggggtgctactcccaggtgaaccccctcacgctgaccgccgcggtcctgatgctcgtggcccactacgccatcatcggcccggggctgcaggccaaggccacccgcgaggcgcagaagcggaccgccgccggcatcatgaagaaccccacggtggacgggatcgtcgccatcgacctggaccccgtggtgtacgacgccaagttcgagaagcagctcggccagatcatgctgctgatcctctgcaccagccagatcctgctgatgcgcaccacctgggcgctctgcgagtccatcacgctggccaccggccccctgaccaccctctgggaggggagcccgggcaagttctggaacacgaccatcgccgtctccatggccaacatcttccgggggagctacctggccggcgcgggcctggccttcagcctcatgaagtccctcgggggcgggcgccgggggaccggggcccagggcgagaccctgggcgagaagtggaagcgccagctcaaccagctgagcaagtccgagttcaacacgtaccggcgcagcgggatcatggaggtggaccggtccgaggccaaggagggcctgaagcgcggggagaccaccaagcacgcggtgagccggggcaccgccaagctccgctggttcgtcgagcggaacctggtgaagcccgaggggaaggtgatcgacctgggctgcggccgcgggggctggtcctactactgcgccgggctgaagaaggtcacggaggtgaagggctacaccaagggcgggcccggccacgaggagcccatcccgatggccacctacgggtggaacctcgtgaagctgcacagcggcaaggacgtcttcttcatcccgcccgagaagtgcgacaccctgctctgcgacatcggggagtccagccccaacccgacgatcgaggagggccggaccctgcgcgtgctgaagatggtggagccctggctccgggggaaccagttctgcatcaagatcctgaacccctacatgccctccgtcgtggagaccctggagcagatgcagcgcaagcacggcggcatgctcgtgcggaacccgctgagccgcaactccacccacgagatgtactgggtcagctgcgggaccggcaacatcgtgtccgccgtgaacatgacgagccgcatgctgctcaaccggttcaccatggcgcaccgcaagcccacctacgagcgggacgtcgacctgggggccggcacccgccacgtggccgtggagcccgaggtcgccaacctggacatcatcggccagcggatcgagaacatcaagcacgagcacaagtccacgtggcactacgacgaggacaacccctacaagacctgggcctaccacgggagctacgaggtgaagccgtccggcagcgcgagctccatggtgaacggggtcgtgaagctcctgaccaagccctgggacgtcatccccatggtgacccagatcgccatgacggacaccacccccttcggccagcagcgcgtgttcaaggagaaggtcgacacccggacgccgaaggccaagcgcgggaccgcccagatcatggaggtgaccgccaagtggctgtggggcttcctcagccggaacaagaagccccgcatctgcacccgggaggagttcacgcgcaaggtgcggtccaacgcggccatcggcgccgtcttcgtggacgagaaccagtggaacagcgccaaggaggcggtggaggacgagcgcttctgggacctggtccaccgggagcgcgagctgcacaagcaggggaagtgcgcgacctgcgtgtacaacatgatgggcaagcgggagaagaagctcggggagttcggcaaggccaaggggtcccgcgccatctggtacatgtggctgggcgcccggttcctggagttcgaggcgctcggcttcatgaacgaggaccactggttcagccgcgagaactccctgagcggggtggagggcgaggggctgcacaagctcggctacatcctgcgggacatctccaagatccccgggggcaacatgtacgccgacgacaccgccggctgggacacccgcatcacggaggacgacctgcagaacgaggcccgcatcaccgacatcatggagccggagcacgccctcctggccaagagcatcttcaagctgacctaccagaacaaggtcgtgcgggtgcagcgccccgccaagaacgggaccgtcatggacgtgatctcccggcgcgaccagcggggcagcggccaggtggggacgtacggcctcaacaccttcaccaacatggaggcccagctgatccgccagatggagtccgaggggatcttcagcccctccgagctggagacccccaacctcgccgagcgggtcctggactggctggagaagtacggcgtggagcgcctcaagcggatggccatcagcggggacgactgcgtggtcaagccgatcgacgaccgcttcgcgacggccctgaccgccctgaacgacatgggcaaggtgcggaaggacatcccccagtgggagccctccaaggggtggaacgactggcagcaggtccccttctgcagccaccacttccaccagctcatcatgaaggacggccgcgagatcgtcgtgccgtgccggaaccaggacgagctggtgggccgcgcccgggtcagccagggggccggctggtccctgcgcgagaccgcgtgcctcggcaagagctacgcccagatgtggcagctgatgtacttccaccggcgcgacctgcggctcgccgccaacgcgatctgctccgccgtgcccgtggactggatccccaccagccgcacgacctggtccatccacgcccaccaccagtggatgaccaccgaggacatgctgagcgtctggaaccgcgtgtggatcgaggagaacccctggatggaggacaagacgcacatctccagctggggcgacgtgccgtacctggggaagcgggaggaccagtggtgcggctccctcatcggcctgaccgcccgcgccacctgggcgaccaacatccaggtcgccatcaaccaggtgcggcgcctgatcgggaacgagaactacctcgactacatgaccagcatgaagcggttcaagaacgagtccgaccccgagggcgccctgtggtga

SEQ ID NO: 8283 - RNA, 9879 nt, synthetic construct
  misc_feature 1..9879: note = derived and/or modified CDS sequence (opt1) from DENV-1__EU660401__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtcacctacgggacctgcagccagacgggcgagcaccggcgggacaagcggtccgtggccctcgcgccccacgtgggcctggggctggagacccgcaccgagacctggatgagctccgagggcgcctggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcatcatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtggggaagctggtccaccagatcttcggcaccgcctacggggtgctgttctccggcgtgagctggacgatgaagatcgggatcggcgtcctgctgacctggctcggcctgaactcccgcagcacctccctgagcatgacctgcatcgccgtggggctcgtgacgctgtacctgggcgtcatggtgcaggccgactccgggtgcgtgatcaactggaagggccgggagctcaagtgcgggagcggcatcttcgtcaccaacgaggtgcacacctggaccgagcagtacaagttccaggccgacagcccgaagcgcctgtccgcggccatcggcaaggcctgggaggagggggtgtgcggcatccggagcgccacccgcctggagaacatcatgtggaagcagatctccaacgagctcaaccacatcctgctggagaacgacatgaagttcacggtcgtggtgggggacgtcgccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctgaagctgcgggacagccacacccaggtctgcgaccaccgcctcatgtccgcggccatcaaggacagcaaggccgtgcacgccgacatgggctactggatcgagtccgagaagaacgagacctggaagctggcccgggcgagcttcatcgaggtgaagacgtgcatctggcccaagtcccacaccctgtggagcaacggcgtcctcgagtccgagatgatcatccccaagatctacgggggcccgatcagccagcacaactaccgccccgggtacttcacccagaccgccggcccctggcacctggggaagctggagctcgacttcgacctgtgcgagggcacgaccgtggtggtcgacgagcactgcggcaaccgggggccgtccctgcgcaccaccacggtgaccggcaagatcatccacgagtggtgctgccggagctgcaccctgccgcccctccgcttccgcggggaggacggctgctggtacgggatggagatccgccccgtgaaggagaaggaggagaacctggtcaagtccatggtgagcgccggcagcggcgaggtggactccttcagcctcgggctgctgtgcatctccatcatgatcgaggaggtcatgcggagccgctggtcccggaagatgctcatgaccggcacgctggccgtgttcttcctgctcatcatggggcagctgacctggaacgacctgatccgcctctgcatcatggtgggcgccaacgcgagcgaccgcatggggatgggcaccacctacctggccctgatggccacgttcaagatgcggccgatgttcgccgtcggcctcctgttccgccggctgacctcccgcgaggtgctcctgctgaccatcgggctcagcctggtggcctccgtcgagctgcccaacagcctcgaggagctgggcgacgggctggcgatgggcatcatgatcctcaagctgctgaccgacttccagtcccaccagctctgggccacgctgctgagcctcaccttcatcaagaccaccttctccctgcactacgcctggaagacgatggccatggtgctgagcatcgtctccctcttccccctgtgcctgagcaccacctcccagaagaccacgtggctccccgtgctgctgggcagcctcgggtgcaagccgctgaccatgttcctgatcgcggagaacaagatctggggccggcgctcctggcccctcaacgaggggatcatggccgtgggcatcgtcagcatcctgctgagctccctcctgaagaacgacgtgcccctggccgggcccctcatcgccggcggcatgctgatcgcctgctacgtgatcagcgggtccagcgcggacctgtccctcgagaaggccgccgaggtcagctgggaggaggaggccgagcactccggcgccagccacaacatcctggtggaggtgcaggacgacgggaccatgaagatcaaggacgaggagcgggacgacaccctgaccatcctcctgaaggcgacgctgctcgccgtctccggcgtgtacccgctgagcatccccgccaccctgttcgtgtggtacttctggcagaagaagaagcagcgctccggggtcctctgggacacccccagcccgcccgaggtggagcgggccgtgctggacgacggcatctaccgcatcatgcagcggggcctgctggggcgctcccaggtcggcgtgggggtgttccaggagaacgtcttccacaccatgtggcacgtgacgcggggcgccgtgctcatgtaccaggggaagcgcctggagcccagctgggcgtccgtcaagaaggacctgatcagctacggcggcgggtggcggctccagggctcctggaacaccggggaggaggtccaggtgatcgccgtcgagcccggcaagaaccccaagaacgtgcagaccgcccccgggaccttcaagacgcccgagggcgaggtgggcgccatcgccctggacttcaagcccgggaccagcggctcccccatcgtcaaccgcgaggggaagatcgtgggcctgtacggcaacggggtggtcaccaccagcggcacgtacgtgagcgcgatcgcccaggccaaggcctcccaggaggggccgctccccgagatcgaggacgaggtgttccggaagcgcaacctgaccatcatggacctgcaccccggcagcgggaagacccggcgctacctcccggcgatcgtccgggaggccatcaagcgcaagctgcgcaccctgatcctcgcccccacgcgggtggtggcctccgagatggccgaggcgctgaagggcatgcccatccgctaccagaccaccgccgtcaagagcgagcacaccggcaaggagatcgtggacctgatgtgccacgccacgttcaccatgcggctcctgtcccccgtgcgcgtcccgaactacaacatgatcatcatggacgaggcccacttcaccgaccccagctccatcgccgcgcgggggtacatcagcacccgcgtgggcatgggggaggccgccgccatcttcatgacggccacgccgcccggctccgtggaggcgttcccgcagagcaacgccgtcatccaggacgaggagcgggacatccccgagcgctcctggaacagcgggtacgagtggatcaccgacttccccggcaagaccgtgtggttcgtgccctccatcaagagcggcaacgacatcgccaactgcctgcggaagaacgggaagcgcgtcatccagctctcccggaagacgttcgacaccgagtaccagaagaccaagaacaacgactgggactacgtggtgaccacggacatcagcgagatgggcgccaacttccgcgcggaccgggtcatcgacccgcgccggtgcctgaagcccgtgatcctgaaggacgggcccgagcgcgtgatcctcgccggccccatgccggtcaccgtggcctccgccgcccagcggcgcgggcggatcggccgcaaccacaacaaggagggcgaccagtacatctacatggggcagcccctgaacaacgacgaggaccacgcgcactggaccgaggccaagatgctgctcgacaacatcaacacccccgagggcatcatccccgccctgttcgagccggagcgcgagaagtccgccgccatcgacggggagtaccggctgcgcggcgaggcgcggaagacgttcgtcgagctcatgcgccgcggggacctgcccgtgtggctgtcctacaaggtggccagcgagggcttccagtacagcgaccgccggtggtgcttcgacggcgagcgcaacaaccaggtcctcgaggagaacatggacgtggagatctggaccaaggagggggagcggaagaagctgcgcccccggtggctggacgcccgcacctactccgaccccctcgccctgcgggagttcaaggagttcgccgcgggccgccggagcgtgtccggggacctgatcctcgagatcggcaagctgccgcagcacctgacccagcgcgcccagaacgccctcgacaacctggtcatgctgcacaacagcgagcagggcgggcgggcctaccgccacgcgatggaggagctccccgacacgatcgagaccctgatgctgctcgccctgatcgccgtgctgaccggcggggtgaccctcttcttcctgtccggccgggggctgggcaagaccagcatcggcctcctgtgcgtcatggcctccagcgtgctgctctggatggcctccgtggagccccactggatcgcggccagcatcatcctggagttcttcctgatggtcctcctgatccccgagccggaccgccagcggacgccccaggacaaccagctggcctacgtggtgatcgggctcctgttcatgatcctgaccgtcgccgccaacgagatgggcctcctggagaccaccaagaaggacctggggatcggccacgtggcggtggagaaccaccaccacgccgccatgctcgacgtcgacctgcaccccgcctccgcctggacgctgtacgcggtggccaccaccatcatcaccccgatgatgcgccacacgatcgagaacaccaccgccaacatcagcctcaccgccatcgccaaccaggcggccatcctgatggggctggacaagggctggcccatctccaagatggacatcggcgtgcccctcctggccctggggtgctacagccaggtcaaccccctcacgctgaccgccgcggtgctgatgctcgtggcccactacgccatcatcggcccggggctgcaggccaaggccacccgcgaggcgcagaagcggaccgccgccggcatcatgaagaaccccacggtcgacgggatcgtggccatcgacctggaccccgtggtctacgacgccaagttcgagaagcagctcggccagatcatgctgctgatcctctgcacctcccagatcctgctgatgcgcaccacctgggcgctctgcgagagcatcacgctggccaccggccccctgaccaccctctgggaggggtccccgggcaagttctggaacacgaccatcgccgtgagcatggccaacatcttccgggggtcctacctggccggcgcgggcctggccttcagcctcatgaagtccctcgggggcgggcgccgggggaccggggcccagggcgagaccctgggcgagaagtggaagcgccagctcaaccagctgtccaagagcgagttcaacacgtacaagcggtccgggatcatggaggtggaccgcagcgaggccaaggagggcctgaagcgcggggagaccaccaagcacgcggtctcccgcggcaccgccaagctccggtggttcgtggagcgcaacctggtgaagcccgaggggaaggtcatcgacctgggctgcggccgcgggggctggagctactactgcgccgggctgaagaaggtgacggaggtgaagggctacaccaagggcggccccggccacgaggagcccatcccgatggccacctacgggtggaacctcgtcaagctgcactccggcaaggacgtgttcttcatcccgcccgagaagtgcgacaccctgctctgcgacatcggggagagctcccccaacccgacgatcgaggagggccgcaccctgcgggtgctgaagatggtcgagccctggctccgcgggaaccagttctgcatcaagatcctgaacccctacatgcccagcgtggtggagaccctggagcagatgcagcggaagcacggcggcatgctcgtccgcaacccgctgtcccggaacagcacccacgagatgtactgggtgtcctgcgggaccggcaacatcgtgagcgccgtcaacatgacgtcccgcatgctgctcaaccgcttcaccatggcgcaccggaagcccacctacgagcgcgacgtggacctgggggccggcacccggcacgtggccgtcgagcccgaggtggccaacctggacatcatcggccagcgcatcgagaacatcaagcacgagcacaagagcacgtggcactacgacgaggacaacccctacaagacctgggcctaccacgggtcctacgaggtgaagccgagcggctccgcgagcagcatggtcaacggggtggtcaagctcctgaccaagccctgggacgtgatccccatggtgacccagatcgccatgacggacaccacccccttcggccagcagcgggtcttcaaggagaaggtggacacccgcacgccgaaggccaagcgggggaccgcccagatcatggaggtgaccgccaagtggctgtggggcttcctctcccgcaacaagaagccccggatctgcacccgcgaggagttcacgcggaaggtccgcagcaacgcggccatcggcgccgtgttcgtggacgagaaccagtggaactccgccaaggaggcggtcgaggacgagcggttctgggacctggtgcaccgcgagcgggagctgcacaagcaggggaagtgcgcgacctgcgtgtacaacatgatgggcaagcgcgagaagaagctcggggagttcggcaaggccaaggggagccgggccatctggtacatgtggctgggcgcccgcttcctggagttcgaggcgctcggcttcatgaacgaggaccactggttctcccgggagaacagcctgtccggggtcgagggcgaggggctgcacaagctcggctacatcctgcgcgacatcagcaagatccccgggggcaacatgtacgccgacgacaccgccggctgggacacccggatcacggaggacgacctgcagaacgaggcccgcatcaccgacatcatggagccggagcacgccctcctggcgaagtccatcttcaagctgacctaccagaacaaggtggtgcgcgtccagcggcccgccaagaacgggaccgtgatggacgtgatcagccgccgggaccagcgcggctccgggcaggtcggcacgtacggcctcaacaccttcaccaacatggaggcccagctgatccggcagatggagagcgaggggatcttctcccccagcgagctggagacccccaacctcgccgagcgcgtgctggactggctggagaagtacggcgtggagcggctcaagcgcatggccatctccggggacgactgcgtcgtgaagccgatcgacgaccggttcgcgacggccctgaccgccctgaacgacatgggcaaggtgcgcaaggacatcccccagtgggagcccagcaaggggtggaacgactggcagcaggtccccttctgctcccaccacttccaccagctcatcatgaaggacggccgggagatcgtggtgccgtgccgcaaccaggacgagctggtcggccgggcccgcgtgagccagggggccggctggagcctgcgggagaccgcgtgcctcgggaagtcctacgcccagatgtggcagctgatgtacttccaccgccgggacctgcgcctcgccgccaacgcgatctgcagcgccgtgcccgtcgactggatccccacctcccggacgacctggagcatccacgcccaccaccagtggatgaccaccgaggacatgctgtccgtgtggaaccgcgtgtggatcgaggagaacccctggatggaggacaagacgcacatcagctcctggggcgacgtcccgtacctggggaagcgcgaggaccagtggtgcggcagcctcatcggcctgaccgcccgggccacctgggcgaccaacatccaggtggccatcaaccaggtgcgccggctgatcgggaacgagaactacctcgactacatgacctccatgaagcgcttcaagaacgagggcgaccccgagggggccctgtggtga

SEQ ID NO: 8284 - RNA, 9879 nt, synthetic construct
  misc_feature 1..9879: note = derived and/or modified CDS sequence (opt1) from DENV-1__FJ373305__SS-prME
  source 1..9879: mol_type = other RNA
agcgtgaccatgctgctgatgctgatgcccaccgccctggccttccacctcaccacccggggcggggagccccacatgatcgtgagcaagcaggagcggggcaagagcctgctgttcaagacctccgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtcacctacgggacctgcagccagacgggcgagcaccggcgggacaagcggtccgtggccctcgcgccccacgtgggcctggggctggagacccgcaccgagacctggatgagctccgagggcgcgtggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcctgacgcaggacgagaagggggtgacccagaacggccggctgatcaccgccaacccgatcgtgaccgacaaggagaagcccgtcaacatcgaggccgagccgcccttcggggagagctacatcatcatcggcgccggcgagaaggcgctcaagctgtcctggttcaagaaggggagctccatcggcaagatgttcgaggccacggcccgcggggcccggcgcatggccatcctgggcgacaccgcgtgggacttcgggagcatcggcggcgtgttcacctccgtggggaagctcgtccaccagatcttcggcaccgcctacggggtgctgttcagcggcgtgtcctggacgatgaagatcgggatcggcgtcctgctcacctggctgggcctgaacagccgctccaccagcctctccatgacctgcatcgccgtggggctggtgacgctgtacctcggcgtcatggtgcaggccgacagcgggtgcgtgatcaactggaagggccgggagctgaagtgcgggtccggcatcttcgtcaccaacgaggtgcacacctggaccgagcagtacaagttccaggccgacagcccgaagcgcctgagcgcggccatcggcaaggcctgggaggagggggtgtgcggcatccggtccgccacccgcctcgagaacatcatgtggaagcagatcagcaacgagctgaaccacatcctgctcgagaacgacatgaagttcacggtcgtggtgggggacgtcgccggcatcctggcgcaggggaagaagatgatccggccccagcccatggagtacaagtactcctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctgaagctccgggactcctacacccaggtctgcgaccaccgcctgatgagcgcggccatcaaggactccaaggccgtgcacgccgacatgggctactggatcgagagcgagaagaacgagacctggaagctggcccgggcgtccttcatcgaggtgaagacgtgcatctggcccaagagccacaccctctggtccaacggcgtcctggagagcgagatgatcatccccaagatctacgggggcccgatctcccagcacaactaccgccccgggtacttcacccagaccgccggcccctggcacctggggaagctcgagctggacttcgacctgtgcgagggcacgaccgtggtggtcgacgagcactgcggcaaccgggggccgagcctccgcaccaccacggtgaccggcaagatcatccacgagtggtgctgccggtcctgcaccctgccgcccctgcgcttccgcggggaggacggctgctggtacgggatggagatccgccccgtgaaggagaaggaggagaacctcgtcaagagcatggtgtccgccggcagcggcgaggtggacagcttctccctggggctgctctgcatcagcatcatcatcgaggaggtcatgcggtcccgctggagccggaagatgctgatgaccggcacgctggccgtgttcttcctcctgatcatggggcagctgacctggaacgacctcatccgcctgtgcatcatggtgggcgccaacgcgtccgaccgcatggggatgggcaccacctacctggccctcatggccacgttcaagatgcggccgatgttcgccgtcggcctgctgttccgccggctcaccagccgcgaggtgctgctgctcaccatcgggctgtccctggtggccagcgtcgagctccccaactccctggaggagctgggcgacgggctcgcgatgggcatcatgatcctgaagctgctcaccgacttccagagccaccagctgtgggccacgctgctctccctgaccttcatcaagaccaccgtgagcctgcactacgcctggaagacgatggccatggtcctctccatcgtgagcctgttccccctgtgcctctccaccaccagccagaagaccacgtggctgcccgtgctgctcggctccctggggtgcaagccgctgaccatgttcctcatcgcggagaacaagatctggggccggcgcagctggcccctgaacgaggggatcatggccgtcggcatcgtgtccatcctgctcagcagcctgctgaagaacgacgtgcccctcgccgggcccctgatcgccggcggcatgctgatcgcctgctacgtcatctccgggagctccgcggacctcagcctggagaaggccgccgaggtgtcctgggaggaggaggccgagcacagcggcgcctcccacaacatcctggtggaggtccaggacgacgggaccatgaagatcaaggacgaggagcgggacgacaccctcaccatcctgctgaaggcgacgctcctggccgtgagcggcgtgtacccgctgtccatccccgccaccctcttcgtctggtacttctggcagaagaagaagcagcgcagcggggtgctgtgggacacccccagcccgcccgaggtggagcgggccgtcctggacgacggcatctaccgcatcatgcagcggggcctgctcgggcgcagccaggtgggcgtgggggtcttccaggagaacgtgttccacaccatgtggcacgtgacgcggggcgccgtcctgatgtaccaggggaagcgcctggagccctcctgggcgagcgtgaagaaggacctcatctcctacggcggcgggtggcggctgcagggcagctggaacaccggggaggaggtgcaggtcatcgccgtggagcccggcaagaaccccaagaacgtgcagaccgcccccgggaccttcaagacgcccgagggcgaggtcggcgccatcgccctggacttcaagcccgggacctccggcagccccatcgtgaaccgcgaggggaagatcgtgggcctctacggcaacggggtcgtgaccacctccggcacgtacgtgagcgcgatcgcccaggccaaggccagccaggaggggccgctgcccgagatcgaggacgaggtcttccggaagcgcaacctgaccatcatggacctccaccccggctccgggaagacccggcgctacctgccggcgatcgtgcgggaggccatcaagcgcaagctgcgcaccctcatcctggcccccacgcgggtggtcgccagcgagatggccgaggcgctgaagggcatgcccatccgctaccagaccaccgccgtgaagtccgagcacaccggcaaggagatcgtggacctcatgtgccacgccacgttcaccatgcggctgctgagccccgtccgcgtgccgaactacaacatgatcatcatggacgaggcccacttcaccgacccctccagcatcgccgcgcgggggtacatctccacccgcgtgggcatgggggaggccgccgccatcttcatgacggccacgccgcccggcagcgtcgaggcgttcccgcagtccaacgccgtgatccaggacgaggagcgggacatccccgagcgcagctggaactccgggtacgagtggatcaccgacttccccggcaagaccgtgtggttcgtccccagcatcaagtccggcaacgacatcgccaactgcctccggaagaacgggaagcgcgtgatccagctgagccggaagacgttcgacaccgagtaccagaagaccaagaacaacgactgggactacgtggtcaccacggacatctccgagatgggcgccaacttccgcgcggaccgggtgatcgacccgcgccggtgcctgaagcccgtgatcctcaaggacgggcccgagcgcgtcatcctggccggccccatgccggtgaccgtcgccagcgccgcccagcggcgcgggcggatcggccgcaaccacaacaaggagggcgaccagtacatctacatggggcagcccctgaacaacgacgaggaccacgcgcactggaccgaggccaagatgctcctggacaacatcaacacccccgagggcatcatccccgccctgttcgagccggagcgcgagaagtccgccgccatcgacggggagtaccggctccgcggcgaggcgcggaagacgttcgtggagctgatgcgccgcggggacctgcccgtgtggctcagctacaaggtcgcctccgagggcttccagtacagcgaccgccggtggtgcttcgacggcgagcgcaacaaccaggtgctggaggagaacatggacgtggagatctggaccaaggagggggagcggaagaagctgcgcccccggtggctcgacgcccgcacctacagcgaccccctggccctgcgggagttcaaggagttcgccgcgggccgccggtccgtcagcggggacctcatcctggagatcggcaagctgccgcagcacctcacccagcgcgcccagaacgccctggacaacctggtgatgctccacaactccgagcagggcgggcgggcctaccgccacgcgatggaggagctgcccgacacgatcgagaccctgatgctcctggccctgatcgccgtgctcaccggcggggtcaccctgttcttcctgagcggccgggggctcggcaagacctccatcggcctgctgtgcgtgatggccagctccgtgctcctgtggatggccagcgtcgagccccactggatcgcggcctccatcatcctggagttcttcctcatggtgctgctgatccccgagccggaccgccagcggacgccccaggacaaccagctcgcctacgtggtcatcgggctgctgttcatgatcctcaccgtggccgccaacgagatgggcctgctggagaccaccaagaaggacctcgggatcggccacgtggcggtcgagaaccaccaccacgccgccatgctggacgtggacctgcaccccgccagcgcctggacgctctacgcggtggccaccaccatcatcaccccgatgatgcgccacacgatcgagaacaccaccgccaacatctccctgaccgccatcgccaaccaggcggccatcctgatggggctcgacaagggctggcccatcagcaagatggacatcggcgtccccctgctggccctcgggtgctactcccaggtgaaccccctgacgctgaccgccgcggtgctcatgctggtcgcccactacgccatcatcggcccggggctgcaggccaaggccacccgcgaggcgcagaagcggaccgccgccggcatcatgaagaaccccacggtggacgggatcgtggccatcgacctcgaccccgtcgtgtacgacgccaagttcgagaagcagctgggccagatcatgctgctcatcctgtgcaccagccagatcctgctcatgcgcaccacctgggcgctgtgcgagtccatcacgctggccaccggccccctcaccaccctgtgggaggggagcccgggcaagttctggaacacgaccatcgccgtgtccatggccaacatcttccgggggagctacctggccggcgcgggcctcgccttctccctgatgaagtccctcgggggcgggcgccgggggaccggggcccagggcgagaccctcggcgagaagtggaagcgccagctgaaccagctgagcaagtccgagttcaacacgtacaagcggagcgggatcatggaggtcgaccgctccgaggccaaggagggcctcaagcgcggggagaccaccaagcacgcggtgagccgcggcaccgccaagctgcggtggttcgtggagcgcaacctggtcaagcccgaggggaaggtgatcgacctgggctgcggccgcggcgggtggtcctactactgcgccgggctcaagaaggtgacggaggtcaaggggtacaccaagggcggccccggccacgaggagcccatcccgatggccacctacgggtggaacctggtgaagctgcacagcggcaaggacgtgttcttcatcccgcccgagaagtgcgacaccctcctgtgcgacatcggggagtccagccccaacccgacgatcgaggagggccgcaccctgcgggtcctcaagatggtggagccctggctgcgcgggaaccagttctgcatcaagatcctgaacccctacatgccctccgtggtcgagaccctcgagcagatgcagcggaagcacggcggcatgctggtgcgcaacccgctgagccggaactccacccacgagatgtactgggtgagctgcgggaccggcaacatcgtctccgccgtgaacatgacgagccgcatgctcctgaaccgcttcaccatggcgcaccggaagcccacctacgagcgcgacgtggacctgggggccggcacccggcacgtcgccgtggagcccgaggtggccaacctcgacatcatcggccagcgcatcgagaacatcaagcacgagcacaagtccacgtggcactacgacgaggacaacccctacaagacctgggcctaccacgggagctacgaggtcaagccgtccggcagcgcgtccagcatggtgaacggggtcgtgaagctgctgaccaagccctgggacgtgatccccatggtcacccagatcgccatgacggacaccacccccttcggccagcagcgggtgttcaaggagaaggtggacacccgcacgccgaaggccaagcgggggaccgcccagatcatggaggtcaccgccaagtggctctggggcttcctgagccgcaacaagaagccccggatctgcacccgcgaggagttcacgcggaaggtgcgctccaacgcggccatcggcgccgtgttcgtcgacgagaaccagtggaacagcgccaaggaggcggtggaggacgagcggttctgggacctggtgcaccgcgagcgggagctccacaagcaggggaagtgcgcgacctgcgtctacaacatgatgggcaagcgcgagaagaagctgggggagttcggcaaggccaaggggtcccgggccatctggtacatgtggctgggcgcccgcttcctcgagttcgaggcgctgggcttcatgaacgaggaccactggttcagccgggagaactccctgagcggggtggagggcgaggggctccacaagctgggctacatcctgcgcgacatctccaagatccccgggggcaacatgtacgccgacgacaccgccggctgggacacccggatcacggaggacgacctccagaacgaggcccgcatcaccgacatcatggagccggagcacgccctgctggccaagagcatcttcaagctcacctaccagaacaaggtggtccgcgtgcagcggcccgccaagaacgggaccgtgatggacgtcatctcccgccgggaccagcgcggcagcggccaggtggggacgtacggcctgaacaccttcaccaacatggaggcccagctgatccggcagatggagtccgaggggatcttcagcccctccgagctcgagacccccaacctggccgagcgcgtgctggactggctcgagaagtacggcgtcgagcggctgaagcgcatggccatcagcggggacgactgcgtggtgaagccgatcgacgaccggttcgcgacggccctgaccgccctcaacgacatgggcaaggtccgcaaggacatcccccagtgggagccctccaaggggtggaacgactggcagcaggtccccttctgcagccaccacttccaccagctgatcatgaaggacggccgggagatcgtggtcccgtgccgcaaccaggacgagctggtgggccgggcccgcgtgtcccagggggccggctggagcctccgggagaccgcgtgcctgggcaagagctacgcccagatgtggcagctgatgtacttccaccgccgggacctccgcctggccgccaacgcgatctgctccgccgtccccgtggactggatccccaccagccggacgacctggtccatccacgcccaccaccagtggatgaccaccgaggacatgctgagcgtgtggaaccgcgtctggatcgaggagaacccctggatggaggacaagacgcacatctccagctggggcgacgtgccgtacctcgggaagcgcgaggaccagtggtgcggctccctgatcggcctgaccgcccgggccacctgggcgaccaacatccaggtggccatcaaccaggtccgccggctcatcgggaacgagaactacctggactacatgaccagcatgaagcgcttcaagaacgagggcgaccccgagggggccctgtggtga

SEQ ID NO: 8285 - RNA, 9879 nt, synthetic construct
  misc_feature 1..9879: note = derived and/or modified CDS sequence (opt1) from DENV-1__EU660402__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagttctgcgaggacacgatgacctacaagtgcccccgcatcaccgaggccgagcccgacgacgtggactgctggtgcaacgccaccgacacctgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtcgagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggaccagcggggcctccaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctcgtccagatcaagtacgagggcatcgacgccccctgcaagatccccttctccacccaggacgagaagggggtgacccagaacggccggctgatcaccgccaacccgatcgtgacggacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacaccgcctgggacttcgggagcatcggcggcgtgttcacctccgtcgggaagctggtgcaccagatcttcggcacggcctacggggtgctgttcagcggcgtctcctggaccatgaagatcgggatcggcgtgctcctgacctggctgggcctcaacagccgctccaccagcctgtccatgacgtgcatcgccgtggggctggtcaccctctacctgggcgtgatggtgcaggccgacagcgggtgcgtcatcaactggaagggccgggagctgaagtgcgggagcggcatcttcgtgaccaacgaggtgcacacctggacggagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagctgaccgtggtggtcggggacgtggcgggcatcctcgcccaggggaagaagatgatccggccccagcccatggagtacaagtactcctggaagatctggggcaaggccaagatcatcggcgccgacgtgcagaacaccaccttcatcatcgacgggcccaacacgccggagtgccccgacgaccagcgcgcgtggaacatctgggaggtcgaggactacggcttcgggatcttcaccaccaacatctggctgaagctgcgggacagctacacccaggtgtgcgaccaccgcctcatgtccgccgccatcaaggacagcaaggccgtgcacgccgacatgggctactggatcgagtccgagaagaacgagacgtggaagctggcgcgggccagcttcatcgaggtcaagacctgcatctggcccaagtcccacaccctgtggagcaacggcgtgctcgagtccgagatgatcatccccaagatctacgggggcccgatcagccagcacaactaccgccccgggtacttcacccagacggccggcccctggcacctggggaagctggagctcgacttcgacctgtgcgagggcaccaccgtggtcgtggacgagcactgcggcaaccgggggccgtccctgcgcaccacgaccgtgaccggcaagatcatccacgagtggtgctgccggagctgcaccctgccgcccctccgcttcaagggggaggacggctgctggtacgggatggagatccggcccgtcaaggagaaggaggagaacctggtgaagtccatggtgagcgccggcagcggcgaggtcgactccttcagcctcgggctgctgtgcatctccatcatgatcgaggaggtgatgcgcagccggtggtcccgcaagatgctcatgacgggcaccctggccgtgttcttcctgctcatcatggggcagctgacctggaacgacctgatccggctctgcatcatggtcggcgcgaacgcctacgaccgcatggggatgggcaccacgtacctggccctgatggccaccttcaagatgcgcccgatgttcgccgtgggcctcctgttccggcgcctgaccagccgggaggtgctcctgctgaccatcgggctctccctggtcgcgagcgtggagctgcccaactccctcgaggagctgggcgacgggctggccatgggcatcatgatcctcaagctgctgacggacttccagagccaccagctctgggccaccctgctgtccctcaccttcatccgcaccacgttcagcctgcactacgcctggaagaccatggcgatggtcctgtccatcgtgagcctcttccccctgtgcctgtccaccaccagccagaagacgacctggctccccgtgctgctgggctccctcgggtgcaagccgctgaccatgttcctgatcgccgagaacaagatctggggccggaagtcctggcccctcaacgaggggatcatggccgtcggcatcgtgtccatcctgctgagcagcctcctgaagaacgacgtgcccctggccgggcccctcatcgccggcggcatgctgatcgcgtgctacgtcatctccgggagctccgccgacctgagcctcgagaaggccgccgaggtgtcctgggaggaggaggccgagcacagcggcgcgtcccacaacatcctggtggaggtccaggacgacgggaccatgaagatcaaggacgaggagcgcgacgacacgctgaccatcctcctgaaggccaccctgctcgccgtgagcggcgtgtacccgctgtccatccccgccaccctgttcgtctggtacttctggcagaagaagaagcagcggagcggggtgctctgggacacccccagcccgcccgaggtggagcgcgccgtcctggacgacggcatctaccggatcatgcagcgcggcctgctggggcggagccaggtgggcgtgggggtcttccaggagaacgtgttccacacgatgtggcacgtgacccgcggcgcggtcctcatgtaccaggggaagcggctggagccctcctgggccagcgtgaagaaggacctgatctcctacggcggcgggtggcgcctccagggcagctggaacaccggggaggaggtgcaggtcatcgccgtggagcccggcaagaaccccaagaacgtgcagaccgcccccgggacgttcaagacctccgagggcgaggtcggcgccatcgcgctggacttcaagcccgggaccagcggctcccccatcgtgaaccgggaggggaagatcgtgggcctgtacggcaacggggtcgtgaccacgagcggcacctacgtgagcgccatcgcccaggccaaggcgtcccaggaggggcccctcccggagatcgaggacgaggtcttccgcaagcggaacctgaccatcatggacctgcaccccggcagcgggaagacccgccggtacctccccgccatcgtgcgcgaggccatcaagcggcgcctgcgcacgctgatcctcgccccgacccgggtggtcgcctccgagatggcggaggccctgaagggcatgcccatccgctaccagaccaccgccgtcaagagcgagcacacgggcaaggagatcgtggacctgatgtgccacgccaccttcaccatgcggctcctgtcccccgtccgcgtgcccaactacaacatgatcatcatggacgaggcccacttcaccgacccgagctccatcgcggcccgggggtacatcagcacgcgcgtgggcatgggggaggccgccgccatcttcatgaccgcgacgccgcccggctccgtcgaggccttcccccagagcaacgccgtgatccaggacgaggagcgggacatcccggagcgctcctggaacagcgggtacgagtggatcaccgacttccccggcaagacggtgtggttcgtcccctccatcaagagcggcaacgacatcgccaactgcctgcggaagaacgggaagcgcgtgatccagctctcccggaagaccttcgacaccgagtaccagaagaccaagaacaacgactgggactacgtggtcacgaccgacatcagcgagatgggcgcgaacttccgcgccgaccgggtgatcgacccccgccggtgcctgaagccggtgatcctgaaggacgggcccgagcgcgtcatcctcgccggccccatgcccgtgaccgtcgcctccgccgcgcagcggcgcgggcggatcggccgcaaccacaacaaggagggcgaccagtacatctacatggggcagccgctgaacaacgacgaggaccacgcccactggaccgaggccaagatgctgctcgacaacatcaacacgcccgagggcatcatccccgccctgttcgagcccgagcgcgagaagtccgccgcgatcgacggggagtaccggctgcgcggcgaggcccggaagaccttcgtggagctcatgcgccgcggggacctgccggtgtggctgtcccacaaggtcgccagcgagggcttccagtacagcgaccgccggtggtgcttcgacggcgagcgcaacaaccaggtgctcgaggagaacatggacgtggagatctggaccaaggagggggagcggaagaagctgcgcccccggtggctggacgcccgcacctactccgaccccctcgccctgcgggagttcaaggagttcgcggccggccgccggagcgtctccggggacctgatcctcgagatcggcaagctgccccagcacctgacgcagcgcgcccagaacgccctcgacaacctggtgatgctgcacaacagcgagcagggcgggcgggcgtaccgccacgccatggaggagctcccggacaccatcgagaccctgatgctgctcgccctgatcgccgtgctgaccggcggggtcatgctgttcttcctgtccggccgggggctgggcaagacgagcatcggcctcctgtgcgtgatggcctccagcgtgctgctctggatggcgtccgtcgagccccactggatcgccgccagcatcatcctggagttcttcctgatggtgctcctgatccccgagcccgaccgccagcggaccccgcaggacaaccagctggcctacgtggtcatcgggctcctgttcatgatcctgaccgtggccgcgaacgagatgggcctcctggagaccaccaagaaggacctggggatcggccacgtggccgtcgagaaccaccaccacgccgccatgctcgacgtggacctgcaccccgcctccgcgtggacgctgtacgccgtggccaccaccatcatcacccccatgatgcgccacacgatcgagaacaccaccgccaacatcagcctcaccgccatcgcgaaccaggccgccatcctgatggggctggacaagggctggccgatctccaagatggacatcggcgtccccctcctggccctggggtgctacagccaggtgaaccccctcacgctgaccgcggccgtgctgatgctcgtcgcccactacgccatcatcggccccgggctgcaggccaaggcgacccgcgaggcccagaagcggaccgccgccggcatcatgaagaacccgacggtggacgggatcgtggccatcgacctggaccccgtcgtgtacgacgcgaagttcgagaagcagctcggccagatcatgctgctgatcctctgcacctcccagatcctgctgatgcgcaccacctgggccctctgcgagagcatcacgctggccaccggccccctgaccaccctctgggaggggtcccccggcaagttctggaacacgaccatcgccgtgagcatggccaacatcttccgggggtcctacctggcgggcgccggcctggccttcagcctcatgaagtccctcgggggcgggcgccgggggaccggggcccagggcgagaccctgggcgagaagtggaagcgccagctcaaccagctgtccaagagcgagttcaacacgtacaagcggtccgggatcatggaggtcgaccgcagcgaggcgaaggagggcctgaagcgcggggagaccaccaagcacgccgtgtcccgcggcaccgccaagctccggtggttcgtggagcgcaacctggtcaagccggaggggaaggtgatcgacctgggctgcggccgcggcgggtggagctactactgcgccgggctgaagaaggtgacggaggtcaaggggtacaccaagggcgggcccggccacgaggagcccatccccatggccacctacgggtggaacctcgtgaagctgcactccggcaaggacgtgttcttcatcccgcccgagaagtgcgacaccctgctctgcgacatcggggagagctcccccaaccccacgatcgaggagggccgcaccctgcgggtcctgaagatggtggagccgtggctccgcgggaaccagttctgcatcaagatcctgaacccctacatgcccagcgtggtcgagaccctggagcagatgcagcggaagcacggcggcatgctcgtgcgcaaccccctgtcccggaacagcacccacgagatgtactgggtgtcctgcgggacgggcaacatcgtcagcgcggtgaacatgacctcccgcatgctgctcaaccgcttcaccatggcccaccggaagccgacctacgagcgcgacgtggacctgggggccggcacccggcacgtcgccgtggagcccgaggtggccaacctggacatcatcggccagcgcatcgagaacatcaagcacgagcacaagagcacgtggcactacgacgaggacaacccctacaagacctgggcgtaccacgggtcctacgaggtcaagcccagcggctccgccagcagcatggtgaacggggtcgtgaagctcctgaccaagccgtgggacgtgatccccatggtcacccagatcgccatgacggacaccacccccttcggccagcagcgggtgttcaaggagaaggtggacacccgcacgcccaaggccaagcgggggaccgcccagatcatggaggtcaccgcgaagtggctgtggggcttcctctcccgcaacaagaagccgcggatctgcacccgcgaggagttcacgcggaaggtgcgcagcaacgccgccatcggcgccgtgttcgtcgacgagaaccagtggaactccgcgaaggaggccgtggaggacgagcggttctgggacctggtgcaccgcgagcgggagctgcacaagcaggggaagtgcgcgacctgcgtctacaacatgatgggcaagcgcgagaagaagctcggggagttcggcaaggccaaggggagccgggccatctggtacatgtggctgggcgcgcgcttcctggagttcgaggccctcggcttcatgaacgaggaccactggttctcccgggagaacagcctgtccggggtggagggcgaggggctgcacaagctcggctacatcctgcgcgacatcagcaagatccccgggggcaacatgtacgccgacgacaccgccggctgggacacccggatcacggaggacgacctgcagaacgaggccaagatcaccgacatcatggagcccgagcacgcgctcctggccaagtccatcttcaagctgacctaccagaacaaggtggtccgcgtgcagcgcccggccaagaacgggaccgtgatggacgtcatcagccggcgcgaccagcggggctccggccaggtgggcacgtacggcctcaacaccttcaccaacatggaggcccagctgatccgccagatggagagcgaggggatcttctcccccagcgagctggagacccccaacctcgccggccgggtgctggactggctggagaagcacggggtcgagcgcctcaagcggatggcgatctccggcgacgactgcgtggtgaagcccatcgacgaccgcttcgccacggccctgaccgccctgaacgacatggggaaggtccggaaggacatcccgcagtgggagcccagcaagggctggaacgactggcagcaggtccccttctgctcccaccacttccaccagctcatcatgaaggacggccgcgagatcgtggtcccctgccggaaccaggacgagctggtggggcgcgcccgggtgagccagggcgcggggtggagcctgcgcgagaccgcctgcctcggcaagtcctacgcccagatgtggcagctgatgtacttccaccggcgcgacctgcggctcgccgcgaacgccatctgcagcgccgtcccggtggactgggtgcccacctcccgcacgacctggagcatccacgcccaccaccagtggatgaccaccgaggacatgctgtccgtctggaaccgggtgtggatcgaggagaacccctggatggaggacaagacgcacgtgagctcctggggcgacgtcccctacctgggcaagcgcgaggaccagtggtgcggcagcctcatcgggctgaccgcccgcgcgacctgggccaccaacatccaggtggccatcaaccaggtgcggcgcctgctcggcaacgagaactacctggactacatgacgtccatgaagcggttcaagaacgagagcgacccggagggggccctgtggtga

SEQ ID NO: 8286 - RNA, 9879 nt, synthetic construct
  misc_feature 1..9879: note = derived and/or modified CDS sequence (opt1) from DENV-1__EU660403__SS-prME
  source 1..9879: mol_type = other RNA
agcgtgaccatgctgctgatgctgatgcccaccgccctggccttccacctcaccacccggggcggggagccccacatgatcgtgagcaagcaggagcggggcaagagcctgctgttcaagacctccgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtcacctacgggacctgcagccagacgggcgagcaccggcgggacaagcggtccgtggccctcgcgccccacgtgggcctggggctggagacccgcaccgagacctggatgagctccgagggcgcgtggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcctgacgcaggacgagaagggggtgacccagaacggccggctgatcaccgccaacccgatcgtgaccgacaaggagaagcccgtcaacatcgaggccgagccgcccttcggggagagctacatcatcatcggcgccggcgagaaggcgctcaagctgtcctggttcaagaaggggagctccatcggcaagatgttcgaggccacggcccgcggggcccggcgcatggccatcctgggcgacaccgcgtgggacttcgggagcatcggcggcgtgttcacctccgtggggaagctcgtccaccagatcttcggcaccgcctacggggtgctgttcagcggcgtgtcctggacgatgaagatcgggatcggcgtcctgctcacctggctgggcctgaacagccgctccaccagcctctccatgacctgcatcgccgtggggctggtgacgctgtacctcggcgtcatggtgcaggccgacagcgggtgcgtgatcaactggaagggccgggagctgaagtgcgggtccggcatcttcgtcaccaacgaggtgcacacctggaccgagcagtacaagttccaggccgacagcccgaagcgcctgagcgcggccatcggcaaggcctgggaggagggggtgtgcggcatccggtccgccacccgcctcgagaacatcatgtggaagcagatcagcaacgagctgaaccacatcctgctcgagaacgacatgaagttcacggtcgtggtgggggacgtcgccggcatcctggcgcaggggaagaagatgatccggccccagcccatggagtacaagtactcctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctgaagctccgggactcctacacccaggtctgcgaccaccgcctgatgagcgcggccatcaaggactccaaggccgtgcacgccgacatgggctactggatcgagagcgagaagaacgagacctggaagctggcccgggcgtccttcatcgaggtgaagacgtgcatctggcccaagagccacaccctctggtccaacggcgtcctggagagcgagatgatcatccccaagatctacgggggcccgatctcccagcacaactaccgccccgggtacttcacccagaccgccggcccctggcacctggggaagctcgagctggacttcgacctgtgcgagggcacgaccgtggtggtcgacgagcactgcggcaaccgggggccgagcctccgcaccaccacggtgaccggcaagatcatccacgagtggtgctgccggtcctgcaccctgccgcccctgcgcttccgcggggaggacggctgctggtacgggatggagatccgccccgtgaaggagaaggaggagaacctcgtcaagagcatggtgtccgccggcagcggcgaggtggacagcttctccctggggctgctctgcatcagcatcatcatcgaggaggtcatgcggtcccgctggagccggaagatgctgatgaccggcacgctggccgtgttcttcctcctgatcatggggcagctgacctggaacgacctcatccgcctgtgcatcatggtgggcgccaacgcgtccgaccgcatggggatgggcaccacctacctggccctcatggccacgttcaagatgcggccgatgttcgccgtcggcctgctgttccgccggctcaccagccgcgaggtgctgctgctcaccatcgggctgtccctggtggccagcgtcgagctccccaactccctggaggagctgggcgacgggctcgcgatgggcatcatgatcctgaagctgctcaccgacttccagagccaccagctgtgggccacgctgctctccctgaccttcatcaagaccaccttcagcctgcactacgcctggaagacgatggccatggtgctctccatcgtcagcctgttccccctgtgcctctccaccaccagccagaagaccacgtggctgcccgtgctgctcggctccctggggtgcaagccgctgaccatgttcctcatcgcggagaacaagatctggggccggcgcagctggcccctgaacgaggggatcatggccgtgggcatcgtctccatcctgctcagcagcctgctgaagaacgacgtgcccctcgccgggcccctgatcgccggcggcatgctgatcgcctgctacgtgatctccgggagctccgcggacctcagcctggagaaggccgccgaggtctcctgggaggaggaggccgagcacagcggcgcctcccacaacatcctggtggaggtgcaggacgacgggaccatgaagatcaaggacgaggagcgggacgacaccctcaccatcctgctgaaggcgacgctcctggccgtcagcggcgtgtacccgctgtccatccccgccaccctcttcgtgtggtacttctggcagaagaagaagcagcgcagcggggtcctgtgggacacccccagcccgcccgaggtggagcgggccgtgctggacgacggcatctaccgcatcatgcagcggggcctgctcgggcgcagccaggtcggcgtgggggtgttccaggagaacgtcttccacaccatgtggcacgtgacgcggggcgccgtgctgatgtaccaggggaagcgcctggagccctcctgggcgagcgtcaagaaggacctcatctcctacggcggcgggtggcggctgcagggcagctggaacaccggggaggaggtccaggtgatcgccgtcgagcccggcaagaaccccaagaacgtgcagaccgcccccgggaccttcaagacgcccgagggcgaggtgggcgccatcgccctggacttcaagcccgggacctccggcagccccatcgtcaaccgcgaggggaagatcgtgggcctctacggcaacggggtggtcaccacctccggcacgtacgtgagcgcgatcgcccaggccaaggccagccaggaggggccgctgcccgagatcgaggacgaggtgttccggaagcgcaacctgaccatcatggacctccaccccggctccgggaagacccggcgctacctgccggcgatcgtccgggaggccatcaagcgcaagctgcgcaccctcatcctggcccccacgcgggtggtggccagcgagatggccgaggcgctgaagggcatgcccatccgctaccagaccaccgccgtcaagtccgagcacaccggcaaggagatcgtggacctcatgtgccacgccacgttcaccatgcggctgctgagccccgtgcgcgtcccgaactacaacatgatcatcatggacgaggcccacttcaccgacccctccagcatcgccgcgcgggggtacatctccacccgcgtgggcatgggggaggccgccgccatcttcatgacggccacgccgcccggcagcgtggaggcgttcccgcagtccaacgccgtcatccaggacgaggagcgggacatccccgagcgcagctggaactccgggtacgagtggatcaccgacttccccggcaagaccgtgtggttcgtgcccagcatcaagtccggcaacgacatcgccaactgcctccggaagaacgggaagcgcgtcatccagctgagccggaagacgttcgacaccgagtaccagaagaccaagaacaacgactgggactacgtggtgaccacggacatctccgagatgggcgccaacttccgcgcggaccgggtcatcgacccgcgccggtgcctgaagcccgtgatcctcaaggacgggcccgagcgcgtgatcctggccggccccatgccggtcaccgtggccagcgccgcccagcggcgcgggcggatcggccgcaaccacaacaaggagggcgaccagtacatctacatggggcagcccctgaacaacgacgaggaccacgcgcactggaccgaggccaagatgctcctggacaacatcaacacccccgagggcatcatccccgccctgttcgagccggagcgcgagaagtccgccgccatcgacggggagtaccggctccgcggcgaggcgcggaagacgttcgtcgagctgatgcgccgcggggacctgcccgtgtggctcagctacaaggtggcctccgagggcttccagtacagcgaccgccggtggtgcttcgacggcgagcgcaacaaccaggtcctggaggagaacatggacgtggagatctggaccaaggagggggagcggaagaagctgcgcccccggtggctcgacgcccgcacctacagcgaccccctggccctgcgggagttcaaggagttcgccgcgggccgccggtccgtgagcggggacctcatcctggagatcggcaagctgccgcagcacctcacccagcgcgcccagaacgccctggacaacctggtcatgctccacaactccgagcagggcgggcgggcctaccgccacgcgatggaggagctgcccgacacgatcgagaccctgatgctcctggccctgatcgccgtgctcaccggcggggtgaccctgttcttcctgagcggccgggggctcggcaagacctccatcggcctgctgtgcgtcatggccagctccgtgctcctgtggatggccagcgtggagccccactggatcgcggcctccatcatcctggagttcttcctcatggtcctgctgatccccgagccggaccgccagcggacgccccaggacaaccagctcgcctacgtggtgatcgggctgctgttcatgatcctcaccgtcgccgccaacgagatgggcctgctggagaccaccaagaaggacctcgggatcggccacgtggcggtggagaaccaccaccacgccgccatgctggacgtcgacctgcaccccgccagcgcctggacgctctacgcggtggccaccaccatcatcaccccgatgatgcgccacacgatcgagaacaccaccgccaacatctccctgaccgccatcgccaaccaggcggccatcctgatggggctcgacaagggctggcccatcagcaagatggacatcggcgtgcccctgctggccctcgggtgctactcccaggtcaaccccctgacgctgaccgccgcggtgctcatgctggtggcccactacgccatcatcggcccggggctgcaggccaaggccacccgcgaggcgcagaagcggaccgccgccggcatcatgaagaaccccacggtcgacgggatcgtggccatcgacctcgaccccgtggtctacgacgccaagttcgagaagcagctgggccagatcatgctgctcatcctgtgcaccagccagatcctgctcatgcgcaccacctgggcgctgtgcgagtccatcacgctggccaccggccccctcaccaccctgtgggaggggagcccgggcaagttctggaacacgaccatcgccgtgtccatggccaacatcttccgggggagctacctggccggcgcgggcctcgccttctccctgatgaagtccctcgggggcgggcgccgggggaccggggcccagggcgagaccctcggcgagaagtggaagcgccagctgaaccagctgagcaagtccgagttcaacacgtacaagcggagcgggatcatggaggtggaccgctccgaggccaaggagggcctcaagcgcggggagaccaccaagcacgcggtcagccgcggcaccgccaagctgcggtggttcgtggagcgcaacctggtgaagcccgaggggaaggtcatcgacctgggctgcggccgcggcgggtggtcctactactgcgccgggctcaagaaggtgacggaggtgaaggggtacaccaagggcggccccggccacgaggagcccatcccgatggccacctacgggtggaacctggtcaagctgcacagcggcaaggacgtgttcttcatcccgcccgagaagtgcgacaccctcctgtgcgacatcggggagtccagccccaacccgacgatcgaggagggccgcaccctgcgggtgctcaagatggtcgagccctggctgcgcgggaaccagttctgcatcaagatcctgaacccctacatgccctccgtggtggagaccctcgagcagatgcagcggaagcacggcggcatgctggtccgcaacccgctgagccggaactccacccacgagatgtactgggtgagctgcgggaccggcaacatcgtgtccgccgtcaacatgacgagccgcatgctcctgaaccgcttcaccatggcgcaccggaagcccacctacgagcgcgacgtggacctgggggccggcacccggcacgtggccgtcgagcccgaggtggccaacctcgacatcatcggccagcgcatcgagaacatcaagcacgagcacaagtccacgtggcactacgacgaggacaacccctacaagacctgggcctaccacgggagctacgaggtgaagccgtccggcagcgcgtccagcatggtcaacggggtggtcaagctgctgaccaagccctgggacgtgatccccatggtgacccagatcgccatgacggacaccacccccttcggccagcagcgggtcttcaaggagaaggtggacacccgcacgccgaaggccaagcgggggaccgcccagatcatggaggtgaccgccaagtggctctggggcttcctgagccgcaacaagaagccccggatctgcacccgcgaggagttcacgcggaaggtccgctccaacgcggccatcggcgccgtgttcgtggacgagaaccagtggaacagcgccaaggaggcggtcgaggacgagcggttctgggacctggtgcaccgcgagcgggagctccacaagcaggggaagtgcgcgacctgcgtgtacaacatgatgggcaagcgcgagaagaagctgggggagttcggcaaggccaaggggtcccgggccatctggtacatgtggctgggcgcccgcttcctcgagttcgaggcgctgggcttcatgaacgaggaccactggttcagccgggagaactccctgagcggggtcgagggcgaggggctccacaagctgggctacatcctgcgcgacatctccaagatccccgggggcaacatgtacgccgacgacaccgccggctgggacacccggatcacggaggacgacctccagaacgaggcccgcatcaccgacatcatggagccggagcacgccctgctggccaagagcatcttcaagctcacctaccagaacaaggtggtgcgcgtccagcggcccgccaagaacgggaccgtgatggacgtgatctcccgccgggaccagcgcggcagcgggcaggtcggcacgtacggcctgaacaccttcaccaacatggaggcccagctgatccggcagatggagtccgaggggatcttcagcccctccgagctcgagacccccaacctggccgagcgcgtgctggactggctcgagaagtacggcgtggagcggctgaagcgcatggccatcagcggggacgactgcgtcgtgaagccgatcgacgaccggttcgcgacggccctgaccgccctcaacgacatgggcaaggtgcgcaaggacatcccccagtgggagccctccaaggggtggaacgactggcagcaggtccccttctgcagccaccacttccaccagctgatcatgaaggacggccgggagatcgtggtgccgtgccgcaaccaggacgagctggtcggccgggcccgcgtgtcccagggggccggctggagcctccgggagaccgcgtgcctgggcaagagctacgcccagatgtggcagctgatgtacttccaccgccgggacctccgcctggccgccaacgcgatctgctccgccgtgcccgtcgactggatccccaccagccggacgacctggtccatccacgcccaccaccagtggatgaccaccgaggacatgctgagcgtgtggaaccgcgtgtggatcgaggagaacccctggatggaggacaagacgcacatctccagctggggcgacgtcccgtacctcgggaagcgcgaggaccagtggtgcggctccctgatcggcctgaccgcccgggccacctgggcgaccaacatccaggtggccatcaaccaggtgcgccggctcatcgggaacgagaactacctggactacatgaccagcatgaagcgcttcaagaacgagggcgaccccgagggggccctgtggtga

SEQ ID NO: 8287 - RNA, 9879 nt, synthetic construct
  misc_feature 1..9879: note = derived and/or modified CDS sequence (opt1) from DENV-1__EU660397__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgagaccgagcccgacgacgtggactgctggtgcaacgccacggacacctgggtgacctacgggacctgcagccagacgggcgagcaccggcgcgacaagcggtccgtggccctcgcgccccacgtgggcctggggctggagacccgcaccgagacctggatgagctccgagggcgcctggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgcggggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccgcctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccacggcccgcggggcccgccgcatggccatcctgggcgacaccgcgtgggacttcgggtccatcggcggcgtgttcaccagcgtcgggaagctggtgcaccagatcttcggcaccgcctacggggtgctgttctccggcgtcagctggacgatgaagatcgggatcggcgtgctgctgacctggctcggcctgaactcccggagcacctccctgagcatgacctgcatcgccgtggggctcgtcacgctgtacctgggcgtgatggtgcaggccgactccgggtgcgtcatcaactggaagggccgcgagctcaagtgcgggagcggcatcttcgtgaccaacgaggtgcacacctggaccgagcagtacaagttccaggccgacagcccgaagcggctgtccgcggccatcggcaaggcctgggaggagggggtctgcggcatccgcagcgccacccggctggagaacatcatgtggaagcagatctccaacgagctcaaccacatcctgctggagaacgacatgaagttcacggtggtggtcggggacgtggccggcatcctcgcgcaggggaagaagatgatccgcccccagcccatggagtacaagtacagctggaagtcctggggcaaggccaagatcatcggcgccgacgtgcagaacaccaccttcatcatcgacgggcccaacaccccggagtgccccgacgaccagcgggcctggaacatctgggaggtcgaggactacggcttcgggatcttcacgaccaacatctggctgaagctgcgcgacagctacacccaggtgtgcgaccaccggctcatgtccgcggccatcaaggacagcaaggccgtgcacgccgacatgggctactggatcgagtccgagaagaacgagacctggaagctggcccgcgcgagcttcatcgaggtcaagacgtgcatctggcccaagtcccacaccctgtggagcaacggcgtgctcgagtccgagatgatcatccccaagatctacgggggcccgatcagccagcacaactaccggcccgggtacttcacccagaccgccggcccctggcacctggggaagctggagctcgacttcgacctgtgcgagggcacgaccgtggtcgtggacgagcactgcggcaaccgcgggccgtccctgcggaccaccacggtgaccggcaagatcatccacgagtggtgctgccgcagctgcaccctgccgcccctccggttccgcggggaggacggctgctggtacgggatggagatccggcccgtcaaggagaaggaggagaacctggtgaagtccatggtgagcgccggcagcggcgaggtcgactccttcagcctcgggctgctgtgcatctccatcatgatcgaggaggtgatgcgcagccggtggtcccgcaagatgctcatgaccggcacgctggccgtgttcttcctgctcatcatggggcagctgacctggaacgacctgatccgcctctgcatcatggtcggcgccaacgcgagcgaccggatggggatgggcaccacctacctggccctgatggccacgttcaagatgcgcccgatgttcgccgtgggcctcctgttccggcgcctgacctcccgggaggtgctcctgctgaccatcgggctcagcctggtcgcctccgtggagctgcccaacagcctcgaggagctgggcgacgggctggcgatgggcatcatgatcctcaagctgctgaccgacttccagtcccaccagctctgggccacgctgctgagcctcaccttcatcaagaccaccttctccctgcactacgcctggaagacgatggccatggtcctgagcatcgtgtccctcttccccctgtgcctgagcaccacctcccagaagaccacgtggctccccgtgctgctgggcagcctcgggtgcaagccgctgaccatgttcctgatcgcggagaacaagatctggggccgccggtcctggcccctcaacgaggggatcatggccgtcggcatcgtgagcatcctgctgagctccctcctgaagaacgacgtgcccctggccgggcccctcatcgccggcggcatgctgatcgcctgctacgtcatcagcgggtccagcgcggacctgtccctcgagaaggccgccgaggtgagctgggaggaggaggccgagcactccggcgccagccacaacatcctggtggaggtccaggacgacgggaccatgaagatcaaggacgaggagcgcgacgacaccctgaccatcctcctgaaggcgacgctgctcgccgtgtccggcgtgtacccgctgagcatccccgccaccctgttcgtctggtacttctggcagaagaagaagcagcggtccggggtgctctgggacacccccagcccgcccgaggtggagcgcgccgtcctggacgacggcatctaccggatcatgcagcgcggcctgctggggcggtcccaggtgggcgtgggggtcttccaggagaacgtgttccacaccatgtggcacgtgacgcgcggcgccgtcctcatgtaccaggggaagcggctggagcccagctgggcgtccgtgaagaaggacctgatcagctacggcggcgggtggcgcctccagggctcctggaacaccggggaggaggtgcaggtcatcgccgtggagcccggcaagaaccccaagaacgtgcagaccgcccccgggaccttcaagacgcccgagggcgaggtcggcgccatcgccctggacttcaagcccgggaccagcggctcccccatcgtgaaccgggaggggaagatcgtgggcctgtacggcaacggggtcgtgaccaccagcggcacgtacgtgagcgcgatcgcccaggccaaggcctcccaggaggggccgctccccgagatcgaggacgaggtcttccgcaagcggaacctgaccatcatggacctgcaccccggcagcgggaagacccgccggtacctcccggcgatcgtgcgcgaggccatcaagcgcaagctgcggaccctgatcctcgcccccacgcgcgtggtcgcctccgagatggccgaggcgctgaagggcatgcccatccggtaccagaccaccgccgtcaagagcgagcacaccggcaaggagatcgtggacctgatgtgccacgccacgttcaccatgcgcctcctgtcccccgtccgggtgccgaactacaacatgatcatcatggacgaggcccacttcaccgaccccagctccatcgccgcgcgcgggtacatcagcacccgggtgggcatgggggaggccgccgccatcttcatgacggccacgccgcccggctccgtcgaggcgttcccgcagagcaacgccgtgatccaggacgaggagcgcgacatccccgagcggtcctggaacagcgggtacgagtggatcaccgacttccccggcaagaccgtgtggttcgtcccctccatcaagagcggcaacgacatcgccaactgcctgcgcaagaacgggaagcgggtgatccagctctcccgcaagacgttcgacaccgagtaccagaagaccaagaacaacgactgggactacgtggtcaccacggacatcagcgagatgggcgccaacttccgggcggaccgcgtgatcgacccgcggcgctgcctgaagcccgtgatcctgaaggacgggcccgagcgggtcatcctcgccggccccatgccggtgaccgtcgcctccgccgcccagcgccgggggcgcatcggccgcaaccacaacaaggagggcgaccagtacatctacatggggcagcccctgaacaacgacgaggaccacgcgcactggaccgaggccaagatgctgctcgacaacatcaacacccccgagggcatcatccccgccctgttcgagccggagcgggagaagtccgccgccatcgacggggagtaccgcctgcggggcgaggcgcgcaagacgttcgtggagctcatgcggcgcggggacctgcccgtgtggctgtcctacaaggtcgccagcgagggcttccagtacagcgaccggcgctggtgcttcgacggcgagcggaacaaccaggtgctcgaggagaacatggacgtggagatctggaccaaggagggggagcgcaagaagctgcggccccgctggctggacgcccggacctactccgaccccctcgccctgcgcgagttcaaggagttcgccgcgggccggcgcagcgtctccggggacctgatcctcgagatcggcaagctgccgcagcacctgacccagcgggcccagaacgccctcgacaacctggtgatgctgcacaacagcgagcagggcgggcgcgcctaccggcacgcgatggaggagctccccgacacgatcgagaccctgatgctgctcgccctgatcgccgtgctgaccggcggggtcaccctcttcttcctgtccggccgcgggctgggcaagaccagcatcggcctcctgtgcgtgatggcctccagcgtgctgctctggatggcctccgtcgagccccactggatcgcggccagcatcatcctggagttcttcctgatggtgctcctgatccccgagccggaccggcagcgcacgccccaggacaaccagctggcctacgtggtcatcgggctcctgttcatgatcctgaccgtggccgccaacgagatgggcctcctggagaccaccaagaaggacctggggatcggccacgtggcggtcgagaaccaccaccacgccgccatgctcgacgtggacctgcaccccgcctccgcctggacgctgtacgcggtggccaccaccatcatcaccccgatgatgcgccacacgatcgagaacaccaccgccaacatcagcctcaccgccatcgccaaccaggcggccatcctgatggggctggacaagggctggcccatctccaagatggacatcggcgtccccctcctggccctggggtgctacagccaggtgaaccccctcacgctgaccgccgcggtgctgatgctcgtcgcccactacgccatcatcggcccggggctgcaggccaaggccacccgggaggcgcagaagcgcaccgccgccggcatcatgaagaaccccacggtggacgggatcgtggccatcgacctggaccccgtcgtgtacgacgccaagttcgagaagcagctcggccagatcatgctgctgatcctctgcacctcccagatcctgctgatgcggaccacctgggcgctctgcgagagcatcacgctggccaccggccccctgaccaccctctgggaggggtccccgggcaagttctggaacacgaccatcgccgtgagcatggccaacatcttccgcgggtcctacctggccggcgcgggcctggccttcagcctcatgaagtccctcgggggcgggcggcgcgggaccggggcccagggcgagaccctgggcgagaagtggaagcggcagctcaaccagctgtccaagagcgagttcaacacgtacaagcgctccgggatcatggaggtcgaccggagcgaggccaaggagggcctgaagcgcggggagaccaccaagcacgcggtgtcccggggcaccgccaagctccgctggttcgtggagcggaacctggtcaagcccgaggggaaggtgatcgacctgggctgcggccgcgggggctggagctactactgcgccgggctgaagaaggtgacggaggtcaagggctacaccaagggcgggcccggccacgaggagcccatcccgatggccacctacgggtggaacctcgtgaagctgcactccggcaaggacgtgttcttcatcccgcccgagaagtgcgacaccctgctctgcgacatcggggagagctcccccaacccgacgatcgaggagggccggaccctgcgcgtcctgaagatggtggagccctggctccgggggaaccagttctgcatcaagatcctgaacccctacatgcccagcgtggtcgagaccctggagcagatgcagcgcaagcacggcggcatgctcgtgcggaacccgctgtcccgcaacagcacccacgagatgtactgggtgtcctgcgggaccggcaacatcgtcagcgccgtgaacatgacgtcccgcatgctgctcaaccggttcaccatggcgcaccgcaagcccacctacgagcgggacgtggacctgggggccggcacccgccacgtcgccgtggagcccgaggtggccaacctggacatcatcggccagcggatcgagaacatcaagcacgagcacaagagcacgtggcactacgacgaggacaacccctacaagacctgggcctaccacgggtcctacgaggtcaagccgagcggctccgcgagcagcatggtgaacggggtcgtgaagctcctgaccaagccctgggacgtgatccccatggtcacccagatcgccatgacggacaccacccccttcggccagcagcgcgtgttcaaggagaaggtggacacccggacgccgaaggccaagcgcgggaccgcccagatcatggaggtcaccgccaagtggctgtggggcttcctctcccggaacaagaagccccgcatctgcacccgggaggagttcacgcgcaaggtgcggagcaacgcggccatcggcgccgtgttcgtcgacgagaaccagtggaactccgccaaggaggcggtggaggacgagcgcttctgggacctggtgcaccgggagcgcgagctgcacaagcaggggaagtgcgcgacctgcgtctacaacatgatgggcaagcgggagaagaagctcggggagttcggcaaggccaaggggagccgcgccatctggtacatgtggctgggcgcccggttcctggagttcgaggcgctcggcttcatgaacgaggaccactggttctcccgcgagaacagcctgtccggggtggagggcgaggggctgcacaagctcggctacatcctgcgggacatcagcaagatccccgggggcaacatgtacgccgacgacaccgccggctgggacacccgcatcacggaggacgacctgcagaacgaggcccgcatcaccgacatcatggagccggagcacgccctcctggcgaagtccatcttcaagctgacctaccagaacaaggtggtccgggtgcagcgccccgccaagaacgggaccgtgatggacgtcatcagccggcgcgaccagcggggctccggccaggtgggcacgtacggcctcaacaccttcaccaacatggaggcccagctgatccgccagatggagagcgaggggatcttctcccccagcgagctggagacccccaacctcgccgagcgggtgctggactggctggagaagtacggcgtcgagcgcctcaagcggatggccatctccggggacgactgcgtggtgaagccgatcgacgaccgcttcgcgacggccctgaccgccctgaacgacatgggcaaggtccggaaggacatcccccagtgggagcccagcaaggggtggaacgactggcagcaggtccccttctgctcccaccacttccaccagctcatcatgaaggacggccgcgagatcgtggtcccgtgccggaaccaggacgagctggtgggccgcgcccgggtgagccagggggccggctggagcctgcgcgagaccgcgtgcctcgggaagtcctacgcccagatgtggcagctgatgtacttccaccggcgcgacctgcggctcgccgccaacgcgatctgcagcgccgtccccgtggactggatccccacctcccgcacgacctggagcatccacgcccaccaccagtggatgaccaccgaggacatgctgtccgtgtggaaccgcgtctggatcgaggagaacccctggatggaggacaagacgcacatcagctcctggggcgacgtgccgtacctggggaagcgggaggaccagtggtgcggcagcctcatcggcctgaccgcccgcgccacctgggcgaccaacatccaggtggccatcaaccaggtccggcgcctgatcgggaacgagaactacctcgactacatgacctccatgaagcggttcaagaacgagagcgaccccgagggcgccctgtggtga

SEQ ID NO: 8288 - RNA, 9879 nt, synthetic construct
  misc_feature 1..9879: note = derived and/or modified CDS sequence (opt1) from DENV-1__EU687247__SS-prME
  source 1..9879: mol_type = other RNA
agcgtgaccatgctgctgatgctgatgcccaccgccctggccttccacctcacgacccggggcggggagccccacatgatcgtgtccaagcaggagcggggcaagagcctgctgttcaagacctccgccggggtgaacatgtgcaccctcatcgccatggacctgggcgagttctgcgaggacaccatgacctacaagtgcccccgcatcaccgaggccgagcccgacgacgtggactgctggtgcaacgccaccgacacgtgggtcacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtcgagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggaccagcggggcctccaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctcgtccagatcaagtacgagggcaccgacgccccctgcaagatccccttctccacccaggacgagaagggggtgacccagaacggccggctgatcacggccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacaccgcctgggacttcgggagcatcggcggcgtgttcacgtccgtcgggaagctggtgcaccagatcttcggcaccgcctacggggtgctgttcagcggcgtctcctggaccatgaagatcgggatcggcgtgctcctgacctggctgggcctcaacagccgctccacgagcctgtccatgacctgcatcgccgtggggctggtcaccctctacctgggcgtgatggtgcaggccgacagcgggtgcgtcatcaactggaagggccgggagctgaagtgcgggagcggcatcttcgtgaccaacgaggtgcacacgtggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagctgaccgtggtggtcggggacgtggcgggcatcctcgcccaggggaagaagatgatccggccccagcccatggagtacaagtactcctggaagatctggggcaaggccaagatcatcggcgccgacgtgcagaacaccacgttcatcatcgacgggcccaacaccccggagtgccccgacgaccagcgcgcgtggaacatctgggaggtcgaggactacggcttcgggatcttcaccaccaacatctggctgaagctgcgggacagctacacccaggtgtgcgaccaccgcctcatgtccgccgccatcaaggacagcaaggccgtgcacgccgacatgggctactggatcgagtccgagaagaacgagacctggaagctggcgcgggccagcttcatcgaggtcaagacctgcatctggcccaagtcccacaccctgtggagcaacggcgtgctcgagtccgagatgatcatccccaagatctacgggggcccgatcagccagcacaactaccgccccgggtacttcacgcagaccgccggcccctggcacctggggaagctggagctcgacttcgacctgtgcgagggcaccaccgtggtcgtggacgagcactgcggcaaccgggggccgtccctgcgcacgaccaccgtgaccggcaagatcatccacgagtggtgctgccggagctgcacgctgccgcccctccgcttcaagggggaggacggctgctggtacgggatggagatccggcccgtcaaggagaaggaggagaacctggtgaagtccatggtgagcgccggcagcggcgaggtcgactccttcagcctcgggctgctgtgcatctccatcatgatcgaggaggtgatgcgcagccggtggtcccgcaagatgctcatgaccggcaccctggccgtgttcttcctgctcatcatggggcagctgacctggaacgacctgatccggctctgcatcatggtcggcgcgaacgccagcgaccgcatggggatgggcacgacctacctggccctgatggccaccttcaagatgcgcccgatgttcgccgtgggcctcctgttccggcgcctgacctcccgggaggtgctcctgctgacgatcgggctcagcctggtcgcgtccgtggagctgcccaacagcctcgaggagctgggcgacgggctggccatgggcatcatgatcctcaagctgctgaccgacttccagtcccaccagctctgggccaccctgctgagcctcaccttcatccgcacgaccttctccctgcactacgcctggaagaccatggcgatggtcctgagcatcgtgtccctcttccccctgtgcctgagcaccacgtcccagaagaccacctggctccccgtgctgctgggcagcctcgggtgcaagccgctgaccatgttcctgatcgccgagaacaagatctggggccggaagtcctggcccctcaacgaggggatcatggccgtcggcatcgtgagcatcctgctgagctccctcctgaagaacgacgtgcccctggccgggcccctcatcgccggcggcatgctgatcgcgtgctacgtcatcagcgggtccagcgccgacctgtccctcgagaaggccgccgaggtgagctgggaggaggaggccgagcactccggcgcgagccacaacatcctggtggaggtccaggacgacgggacgatgaagatcaaggacgaggagcgcgacgacaccctgaccatcctcctgaaggccaccctgctcgccgtgtccggcgtgtacccgctgagcatccccgccaccctgttcgtctggtacttctggcagaagaagaagcagcggtccggggtgctctgggacacgcccagcccgcccgaggtggagcgcgccgtcctggacgacggcatctaccggatcatgcagcgcggcctgctggggcggtcccaggtgggcgtgggggtcttccaggagaacgtgttccacaccatgtggcacgtgacccgcggcgcggtcctcatgtaccaggggaagcggctggagcccagctgggcctccgtgaagaaggacctgatcagctacggcggcgggtggcgcctccagggctcctggaacaccggggaggaggtgcaggtcatcgccgtggagcccggcaagaaccccaagaacgtgcagacggcccccgggaccttcaagaccagcgagggcgaggtcggcgccatcgcgctggacttcaagcccgggacctccggcagccccatcgtgaaccgggaggggaagatcgtgggcctgtacggcaacggggtcgtgacgaccagcggcacctacgtgtccgccatcgcccaggccaaggcgagccaggaggggcccctcccggagatcgaggacgaggtcttccgcaagcggaacctgaccatcatggacctgcaccccggctccgggaagacgcgccggtacctccccgccatcgtgcgcgaggccatcaagcggcgcctgcgcaccctgatcctcgccccgacccgggtggtcgccagcgagatggcggaggccctgaagggcatgcccatccgctaccagaccacggccgtgaagtccgagcacaccggcaaggagatcgtggacctgatgtgccacgccaccttcaccatgcggctcctgagccccgtccgcgtgcccaactacaacatgatcatcatggacgaggcccacttcacggacccgtccagcatcgcggcccgggggtacatctccacccgcgtgggcatgggggaggccgccgccatcttcatgaccgcgacgccgcccggcagcgtcgaggccttcccccagtccaacgccgtgatccaggacgaggagcgggacatcccggagcgcagctggaactccgggtacgagtggatcacggacttccccggcaagaccgtgtggttcgtccccagcatcaagtccggcaacgacatcgccaactgcctgcggaagaacgggaagcgcgtgatccagctcagccggaagaccttcgacaccgagtaccagaagacgaagaacaacgactgggactacgtggtcaccaccgacatctccgagatgggcgcgaacttccgcgccgaccgggtgatcgacccccgccggtgcctgaagccggtgatcctgaaggacgggcccgagcgcgtcatcctcgccggccccatgcccgtgaccgtcgccagcgccgcgcagcggcgcgggcggatcggccgcaaccacaacaaggagggcgaccagtacatctacatggggcagccgctgaacaacgacgaggaccacgcccactggacggaggccaagatgctgctcgacaacatcaacacccccgagggcatcatccccgccctgttcgagcccgagcgcgagaagtccgccgcgatcgacggggagtaccggctgcgcggcgaggcccggaagaccttcgtggagctcatgcgccgcggggacctgccggtgtggctgagctacaaggtcgccagcgagggcttccagtactccgaccgccggtggtgcttcgacggcgagcgcaacaaccaggtgctcgaggagaacatggacgtggagatctggaccaaggagggggagcggaagaagctgcgcccccggtggctggacgcccgcacgtacagcgaccccctcgccctgcgggagttcaaggagttcgcggccggccgccggtccgtcagcggggacctgatcctcgagatcggcaagctgccccagcacctgacccagcgcgcccagaacgccctcgacaacctggtgatgctgcacaactccgagcagggcgggcgggcgtaccgccacgccatggaggagctcccggacaccatcgagaccctgatgctgctcgccctgatcgccgtgctgacgggcggggtcaccctcttcttcctgagcggccgggggctgggcaagacctccatcggcctcctgtgcgtgatggccagctccgtgctgctctggatggcgagcgtcgagccccactggatcgccgcctccatcatcctggagttcttcctgatggtgctcctgatccccgagcccgaccgccagcggaccccgcaggacaaccagctggcctacgtggtcatcgggctcctgttcatgatcctgaccgtggccgcgaacgagatgggcctcctggagacgaccaagaaggacctggggatcggccacgtggccgtcgagaaccaccaccacgccgccatgctcgacgtggacctgcaccccgccagcgcgtggaccctgtacgccgtggccaccacgatcatcacccccatgatgcgccacaccatcgagaacaccacggccaacatctccctcaccgccatcgcgaaccaggccgccatcctgatggggctggacaagggctggccgatcagcaagatggacatcggcgtccccctcctggccctggggtgctactcccaggtgaaccccctcaccctgaccgcggccgtgctgatgctcgtcgcccactacgccatcatcggccccgggctgcaggccaaggcgacgcgcgaggcccagaagcggaccgccgccggcatcatgaagaacccgaccgtggacgggatcgtggccatcgacctggaccccgtcgtgtacgacgcgaagttcgagaagcagctcggccagatcatgctgctgatcctctgcaccagccagatcctgctgatgcgcacgacctgggccctctgcgagtccatcaccctggccaccggccccctgacgaccctctgggaggggagccccggcaagttctggaacaccaccatcgccgtgtccatggccaacatcttccgggggagctacctggcgggcgccggcctggccttcagcctcatgaagtccctcgggggcgggcgccgggggacgggggcccagggcgagaccctgggcgagaagtggaagcgccagctcaaccagctgagcaagtccgagttcaacacctacaagcggagcgggatcatggaggtcgaccgctccgaggcgaaggagggcctgaagcgcggggagaccacgaagcacgccgtgagccgcggcaccgccaagctccggtggttcgtggagcgcaacctggtcaagccggaggggaaggtgatcgacctgggctgcggccgcggcgggtggtcctactactgcgccgggctgaagaaggtgaccgaggtcaaggggtacaccaagggcgggcccggccacgaggagcccatccccatggccacgtacgggtggaacctcgtgaagctgcacagcggcaaggacgtgttcttcatcccgcccgagaagtgcgacaccctgctctgcgacatcggggagtccagccccaaccccaccatcgaggagggccgcaccctgcgggtcctgaagatggtggagccgtggctccgcgggaaccagttctgcatcaagatcctgaacccctacatgccctccgtggtcgagacgctggagcagatgcagcggaagcacggcggcatgctcgtgcgcaaccccctgagccggaactccacccacgagatgtactgggtgagctgcgggaccggcaacatcgtctccgcggtgaacatgaccagccgcatgctgctcaaccgcttcaccatggcccaccggaagccgacgtacgagcgcgacgtggacctgggggccggcacccggcacgtcgccgtggagcccgaggtggccaacctggacatcatcggccagcgcatcgagaacatcaagcacgagcacaagtccacctggcactacgacgaggacaacccctacaagacctgggcgtaccacgggagctacgaggtcaagccctccggcagcgccagctccatggtgaacggggtcgtgaagctcctgacgaagccgtgggacgtgatccccatggtcacccagatcgccatgaccgacaccacgcccttcggccagcagcgggtgttcaaggagaaggtggacacccgcacccccaaggccaagcgggggaccgcccagatcatggaggtcacggcgaagtggctgtggggcttcctcagccgcaacaagaagccgcggatctgcacccgcgaggagttcacccggaaggtgcgctccaacgccgccatcggcgccgtgttcgtcgacgagaaccagtggaacagcgcgaaggaggccgtggaggacgagcggttctgggacctggtgcaccgcgagcgggagctgcacaagcaggggaagtgcgcgacctgcgtctacaacatgatgggcaagcgcgagaagaagctcggggagttcggcaaggccaaggggtcccgggccatctggtacatgtggctgggcgcgcgcttcctggagttcgaggccctcggcttcatgaacgaggaccactggttcagccgggagaactccctgagcggggtggagggcgaggggctgcacaagctcggctacatcctgcgcgacatctccaagatccccgggggcaacatgtacgccgacgacacggccggctgggacacccggatcaccgaggacgacctgcagaacgaggccaagatcaccgacatcatggagcccgagcacgcgctcctggccaagagcatcttcaagctgacgtaccagaacaaggtggtccgcgtgcagcgcccggccaagaacgggaccgtgatggacgtcatctcccggcgcgaccagcggggcagcggccaggtgggcacctacggcctcaacaccttcacgaacatggaggcccagctgatccgccagatggagtccgaggggatcttcagcccctccgagctggagacccccaacctcgccggccgggtgctgaactggctggagaagcacggggtcgagcgcctcaagcggatggcgatcagcggcgacgactgcgtggtgaagcccatcgacgaccgcttcgccaccgccctgaccgccctgaacgacatggggaaggtccggaaggacatcccgcagtgggagccctccaagggctggaacgactggcagcaggtccccttctgcagccaccacttccaccagctcatcatgaaggacggccgcgagatcgtggtcccctgccggaaccaggacgagctggtggggcgcgcccgggtgagccagggcgcggggtggtccctgcgcgagacggcctgcctcggcaagagctacgcccagatgtggcagctgatgtacttccaccggcgcgacctgcggctcgccgcgaacgccatctgctccgccgtcccggtggactgggtgcccaccagccgcaccacctggtccatccacgcccaccaccagtggatgacgaccgaggacatgctgagcgtctggaaccgggtgtggatcgaggagaacccctggatggaggacaagacccacgtgtccagctggggcgacgtcccctacctgggcaagcgcgaggaccagtggtgcggctccctcatcgggctgaccgcccgcgcgacgtgggccaccaacatccaggtggccatcaaccaggtgcggcgcctgctcggcaacgagaactacctggactacatgaccagcatgaagcggttcaagaacgagtccgacccggagggggccctgtggtga

SEQ ID NO: 8289 - RNA, 9879 nt, synthetic construct
  misc_feature 1..9879: note = derived and/or modified CDS sequence (opt1) from DENV-1__EU660412__SS-prME
  source 1..9879: mol_type = other RNA
agcgtgaccatgctgctcatgctgatgcccaccgccctggccttccacctcaccacccgcggcggggagccccacatgatcgtgagcaagcaggagcggggcaagagcctgctgttcaagaccagcgcgggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtcctcttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggccgactccgggtgcgtcatcaactggaagggccgggagctcaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctggagaacatcatgtggaagcagatctccaacgagctcaaccacatcctgctggagaacgacatgaagctcaccgtggtggtcggggacgtggcgggcatcctggggcagggcaagaagatgatccggccccagcccatggagtacaagtacagctggaagtcctggggcaaggccaagatcatcggggccgacgcccagaacacgaccttcatcatcgacggccccaacaccccggagtgccccgacgaccagcgcgcgtggaacatctgggaggtggaggactacgggttcggcatcttcaccacgaacatctggctgaagctccgggacagctacacccaggtctgcgaccaccgcctgatgtccgccgccatcaaggacagcaaggccgtgcacgccgacatgggctactggatcgagtccgagaagaacgagacctggaagctggcgcgggccagcttcatcgaggtgaagacctgcatctggcccaagtcccacacgctctggagcaacggggtcctggagtccgagatgatcatccccaagatctacggcgggccgatcagccagcacaactaccgccccggctacttcacccagaccgccgggccctggcacctgggcaagctcgagctggacttcgacctgtgcgagggcaccacggtggtggtcgacgagcactgcgggaaccggggcccgtccctccgcaccaccaccgtgacggggaagatcatccacgagtggtgctgccggagctgcaccctgccgcccctgcgcttccggggcgaggacgggtgctggtacggcatggagatccgccccgtgaaggagaaggaggagaacctcgtcaagtccatggtgagcgccggcagcggggaggtggactccttcagcctgggcctgctctgcatctccatcatgatcgaggaggtcatgcggagccgctggtcccggaagatgctgatgaccgggaccctggccgtgttcttcctcctgatcatgggccagctgacgtggaacgacctcatccgcctgtgcatcatggtgggggcgaacgccagcgaccgcatgggcatgggcaccacctacctggccctcatggccaccttcaagatgcggccgatgttcgccgtcgggctgctgttccgccggctcacgtcccgcgaggtgctgctgctcaccatcggcctgagcctggtggcgtccgtcgagctccccaacagcctggaggagctgggggacggcctcgccatgggcatcatgatcctgaagctgctcaccgacttccagtcccaccagctgtgggccaccctgctcagcctgacgttcatcaagaccaccttctccctgcactacgcctggaagaccatggcgatggtgctcagcatcgtctccctgttccccctgtgcctcagcacgacctcccagaagaccacctggctgcccgtgctgctcgggagcctgggctgcaagccgctgacgatgttcctcatcgccgagaacaagatctgggggcggaagtcctggcccctgaacgagggcatcatggccgtggggatcgtcagcatcctgctcagctccctgctgaagaacgacgtgcccctcgccggccccctgatcgccggcgggatgctgatcgcgtgctacgtgatcagcggctccagcgccgacctctccctggagaaggccgccgaggtcagctgggaggaggaggccgagcactccggggcgagccacaacatcctggtggaggtgcaggacgacggcaccatgaagatcaaggacgaggagcgcgacgacaccctcaccatcctgctgaaggccaccctcctggccgtctccggggtgtacccgctgagcatccccgccaccctcttcgtgtggtacttctggcagaagaagaagcagcggtccggcgtcctgtgggacacccccagcccgcccgaggtggagcgcgccgtgctggacgacggcatctaccggatcatgcagcgcgggctgctcggccggtcccaggtcggggtgggcgtgttccaggagaacgtcttccacaccatgtggcacgtgacccgcggggcggtgctgatgtaccagggcaagcggctggagcccagctgggcctccgtcaagaaggacctcatcagctacggcgggggctggcgcctgcgggggtcctggaacacgggcgaggaggtccaggtgatcgccgtcgagcccgggaagaaccccaagaacgtgcagaccgcccccggcaccttcaagacccccgagggcgaggtgggggccatcgcgctggacttcaagcccggcacgagcgggtcccccatcgtcaaccgcgagggcaagatcgtgggcctctacgggaacggcgtggtcaccaccagcgggacctacgtgagcgccatcgcccaggccaaggcgtcccaggagggcccgctgcccgagatcgaggacgaggtgttccggaagcgcaacctgacgatcatggacctccaccccgggagcggcaagacccggcgctacctgccggccatcgtccgggaggccatcaagcgcaagctgcgcaccctcatcctggcccccacccgggtggtggcctccgagatggcggaggccctgaagggcatgcccatccgctaccagacgaccgccgtcaagagcgagcacaccgggaaggagatcgtggacctcatgtgccacgccaccttcacgatgcggctgctgtcccccgtgcgcgtcccgaactacaacatgatcatcatggacgaggcccacttcaccgaccccagctccatcgcggcccggggctacatcagcacccgcgtggggatgggcgaggccgccgccatcttcatgaccgcgacgccgcccgggtccgtggaggccttcccgcagagcaacgccgtcatccaggacgaggagcgggacatccccgagcgctcctggaacagcggctacgagtggatcaccgacttccccggcaagaccgtgtggttcgtgccctccatcaagagcgggaacgacatcgccaactgcctccggaagaacggcaagcgcgtcatccagctgtcccggaagaccttcgacacggagtaccagaagaccaagaacaacgactgggactacgtggtgaccaccgacatcagcgagatgggggcgaacttccgcgccgaccgggtcatcgacccgcgccggtgcctgaagcccgtgatcctcaaggacggccccgagcgcgtgatcctggccgggcccatgccggtcacggtggcctccgccgcgcagcggcgcggccggatcggccgcaaccacaacaaggagggggaccagtacatctacatgggccagcccctgaacaacgacgaggaccacgcccactggaccgaggccaagatgctcctggacaacatcaacacccccgaggggatcatccccgccctgttcgagccggagcgcgagaagtccgccgcggtcgacggcgagtaccggctccgcggggaggcccggaagaccttcgtggagctgatgcgccggggcgacctgcccgtgtggctctcctacaaggtcgccagcgagggcttccagtacagcgaccgccggtggtgcttcgacggggagcgcaacaaccaggtgctggaggagaacatggacgtggagatctggacgaaggagggcgagcggaagaagctgcgcccccggtggctcgacgcccgcacctactccgaccccctggccctgcgggagttcaaggagttcgcggccgggcgccggagcgtctccggcgacctcatcctggagatcggcaagctgccgcagcacctcacccagcgcgcccagaacgccctggacaacctggtgatgctccacaacagcgagcagggcgggcgggcgtaccgccacgccatggaggagctgcccgacaccatcgagacgctgatgctcctggccctgatcgccgtgctcaccgggggcgtcaccctgttcttcctgtccgggcggggcctcggcaagaccagcatcgggctgctgtgcgtgatggcctccagcgtgctcctgtggatggcgtccgtcgagccccactggatcgccgccagcatcatcctggagttcttcctcatggtgctgctgatccccgagccggaccgccagcggacgccccaggacaaccagctcgcctacgtggtcatcggcctgctgttcatgatcctcacggtggccgcgaacgagatggggctgctggagaccaccaagaaggacctcggcatcgggcacgtggccgtcgagaaccaccaccacgccgccatgctggacgtggacctgcaccccgcctccgcgtggaccctctacgccgtggccacgaccatcatcaccccgatgatgcgccacaccatcgagaacacgaccgccaacatcagcctgaccgccatcgcgaaccaggccgccatcctgatgggcctcgacaagggctggcccatctccaagatggacatcggggtccccctgctggccctcggctgctacagccaggtgaaccccctgaccctgacggcggccgtgctcatgctggtcgcccactacgccatcatcgggccgggcctgcaggccaaggcgacccgcgaggcccagaagcggaccgccgccgggatcatgaagaaccccaccgtggacggcatcgtggccatcgacctcgaccccgtcgtgtacgacgcgaagttcgagaagcagctgggccagatcatgctgctcatcctgtgcacgtcccagatcctgctcatgcgcaccacctgggccctgtgcgagagcatcaccctggccacggggcccctcaccaccctgtgggagggctccccggggaagttctggaacaccacgatcgccgtgagcatggccaacatcttccggggctcctacctggcgggcgccgggctcgccttcagcctgatgaagtccctgggcgggggccgccgggggaccggcgcccagggcgagaccctcggggagaagtggaagcgccagctgaaccagctgtccaagagcgagttcaacacctacaagcggtccggcatcatggaggtcgaccgcagcgaggcgaaggaggggctcaagcggggcgagacgaccaagcacgccgtgtcccgcgggaccgccaagctgcggtggttcgtggagcgcaacctggtcaagcccgagggcaaggtgatcgacctgggctgcgggcggggcgggtggagctactactgcgccggcctcaagaaggtgaccgaggtcaaggggtacacgaagggcggccccgggcacgaggagcccatcccgatggccacctacggctggaacctggtgaagctgcactccgggaaggacgtgttcttcatcccgcccgagaagtgcgacaccctcctgtgcgacatcggcgagagctcccccaacccgaccatcgaggaggggcgcacgctgcgggtcctcaagatggtggagccctggctgcgcggcaaccagttctgcatcaagatcctgaacccctacatgcccagcgtggtcgaggcgctcgagcagatgcagcggaagcacggcgggatgctggtgcgcaacccgctgtcccggaacagcacccacgagatgtactgggtgtcctgcggcaccgggaacatcgtcagcgccgtgaacatgacctcccgcatgctcctgaaccgcttcaccatggcccaccggaagcccacgtacgagcgcgacgtggacctgggcaccggcacccggcacgtcgccgtggagcccgaggtggccaacctcgacatcatcgggcagcgcatcgagaacatcaagcacgagcacaagagcacctggcactacgacgaggacaacccctacaagacgtgggcgtaccacggctcctacgaggtcaagccgagcgggtccgccagcagcatggtgaacggcgtcgtgaagctgctgaccaagccctgggacgtgatccccatggtcacccagatcgccatgaccgacacgacccccttcgggcagcagcgggtgttcaaggagaaggtggacacccgcaccccgaaggccaagcggggcacggcccagatcatggaggtcaccgcgcgctggctctggggcttcctgtcccggaacaagaagccccgcatctgcacccgggaggagttcacccgcaaggtgcggagcaacgccgccatcggggccgtgttcgtcgacgagaaccagtggaactccgcgaaggaggccgtggaggacgagcgcttctgggacctggtgcaccgggagcgcgagctccacaagcagggcaagtgcgccacgtgcgtctacaacatgatggggaagcgggagaagaagctgggcgagttcgggaaggccaagggcagccgcgccatctggtacatgtggctgggcgcgcggttcctcgagttcgaggccctggggttcatgaacgaggaccactggttctcccgcgagaacagcctgtccggcgtggagggggagggcctccacaagctggggtacatcctgcgggacatcagcaagatccccggcggcaacatgtacgccgacgacaccgccgggtgggacacccgcatcaccgaggacgacctccagaacgaggccaagatcacggacatcatggagccggagcacgcgctgctggccaaggccatcttcaagctcacctaccagaacaaggtggtccgcgtgcagcggcccgccaagaacggcaccgtgatggacgtcatctcccgccgggaccagcgcgggagcggccaggtgggcacctacgggctgaacacgttcaccaacatggaggcccagctgatccggcagatggagtccgagggcatcttcagcccctccgagctcgagacccccaacctggcggagcgcgccctggactggctcgagaagtacggggtggagcggctgaagcgcatggccatcagcggcgacgactgcgtcgtgaagccgatcgacgaccggttcgccaccgccctgacggcgctcaacgacatggggaaggtgcgcaaggacatcccccagtgggagccctccaagggctggaacgactggcagcaggtccccttctgcagccaccacttccaccagctgatcatgaaggacggccgggagatcgtggtgccgtgccgcaaccaggacgagctggtcgggcgggcccgcgtgtcccagggcgccgggtggagcctccgggagaccgcctgcctgggcaagagctacgcgcagatgtggcagctgatgtacttccaccgccgggacctccgcctggccgccaacgccatctgctccgccgtgcccgtcgactgggtgcccaccagccggaccacgtggtccatccacgcgcaccaccagtggatgaccaccgaggacatgctgagcgtgtggaaccgcgtctggatcgaggagaacccctggatggaggacaagacccacatctccagctgggaggacgtgccgtacctcgggaagcgcgaggaccagtggtgcggctccctgatcggcctgacggcccgggccacctgggccaccaacatccaggtggccatcaaccaggtccgccggctcatcgggaacgagaactacctggactacatgatcagcatgaagcgcttcaagaacgagtccgaccccgagggcgcgctgtggtga

SEQ ID NO: 8290 - RNA, 9879 nt, synthetic construct
  misc_feature 1..9879: note = derived and/or modified CDS sequence (opt1) from DENV-1__EU660418__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgcgacaagcggtccgtggccctcgcgccccacgtgggcctggggctggagacccgcaccgagacctggatgagctccgagggcgcctggaagcagatccagcgggtggagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtcgggaagctggtgcaccagatcttcggcaccgcctacggggtcctcttctccggcgtcagctggacgatgaagatcgggatcggcgtgctgctgacctggctcggcctgaactcccgcagcacctccctgagcatgacctgcatcgccgtggggctcgtcacgctgtacctgggcgtgatggtgcaggccgactccgggtgcgtcatcaactggaagggccgggagctcaagtgcgggagcggcatcttcgtgaccaacgaggtgcacacctggaccgagcagtacaagttccaggccgacagcccgaagcgcctgtccgcggccatcggcaaggcctgggaggagggggtctgcggcatccggagcgccacccgcctggagaacatcatgtggaagcagatctccaacgagctcaaccacatcctgctggagaacgacatgaagttcacggtggtggtcggggacgtggccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtcgaggactacggcttcgggatcttcacgaccaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacgtgcatctggcccaagtcccacaccctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcacgaccgtggtcgtggacgagcactgcggcaaccgggggccgtccctgcgcaccaccacggtgaccggcaagatcatccacgagtggtgctgccggagctgcaccctgccgcccctccgcttccgcggggaggacggctgctggtacgggatggagatccgccccgtcaaggagaaggaggagaacctggtgaagtccatggtgagcgccggcagcggcgaggtcgactccttcagcctcgggctgctgtgcatctccatcatgatcgaggaggtgatgcggagccgctggtcccggaagatgctcatgaccggcacgctggccgtgttcttcctgctcatcatggggcagctgacctggaacgacctgatccgcctctgcatcatggtcggcgccaacgcgagcgaccgcatggggatgggcaccacctacctggccctgatggccacgttcaagatgcggccgatgttcgccgtggggctcctgttccgccggctgacctcccgcgaggtgctcctgctgaccatcgggctcagcctggtcgcctccgtggagctgcccaacagcctcgaggagctgggcgacgggctggcgatgggcatcatgatcctcaagctgctgaccgacttccagtcccaccagctctgggccacgctgctgagcctcaccttcatcaagaccaccttctccctgcactacgcctggaagacgatggccatggtcctgagcatcgtgtccctcttccccctgtgcctgagcaccacctcccagaagaccacgtggctccccgtgctgctgggcagcctcgggtgcaagccgctgaccatgttcctgatcgcggagaacaagatctggggccggcgctcctggcccctcaacgaggggatcatggccgtcggcatcgtgagcatcctgctgagctccctcctgaagaacgacgtgcccctggccgggcccctcatcgccggcggcatgctgatcgcctgctacgtcatcagcgggtccagcgcggacctgtccctcgagaaggccgccgaggtgagctgggaggaggaggccgagcactccggcgccagccacaacatcctggtggaggtccaggacgacgggaccatgaagatcaaggacgaggagcgggacgacaccctgaccatcctcctgaaggcgacgctgctcgccgtgtccggcgtgtacccgctgagcatccccgccaccctgttcgtctggcacttctggcagaagaagaagcagcgctccggggtgctctgggacacccccagcccgcccgaggtgggccgggccgtcctggacgacggcatctaccgcatcatgcagcgggggctgctgggccgctcccaggtgggggtgggcgtcttccaggagaacgtgttccacaccatgtggcacgtgacgcgcggggccgtcctcatgtaccagggcaagcgcctggagcccagctgggcgtccgtgaagaaggacctgatcagctacggcgggggctggcggctccaggggtcctggaacaccggcgaggaggtgcaggtcatcgccgtggagcccgggaagaaccccaagaacgtgcagaccgcccccggcaccttcaagacgcccgagggcgaggtcggggccatcgccctggacttcaagcccggcaccagcgggtcccccatcgtgaaccgcgagggcaagatcgtgggcctgtacgggaacggcgtcgtgaccaccagcgggacgtacgtgagcgcgatcgcccaggccaaggcctcccaggagggcccgctccccgagatcgaggacgaggtcttccggaagcgcaacctgaccatcatggacctgcaccccgggagcggcaagacccggcgctacctcccggcgatcgtgcgggaggccatcaagcgcaagctgcgcaccctgatcctcgcccccacgcgggtggtcgcctccgagatggccgaggcgctgaagggcatgcccatccgctaccagaccaccgccgtcaagagcgagcacaccgggaaggagatcgtggacctgatgtgccacgccacgttcaccatgcggctcctgtcccccgtccgcgtgccgaactacaacatgatcatcatggacgaggcccacttcaccgaccccagctccatcgccgcgcggggctacatcagcacccgcgtggggatgggcgaggccgccgccatcttcatgacggccacgccgcccgggtccgtcgaggcgttcccgcagagcaacgccgtgatccaggacgaggagcgggacatccccgagcgctcctggaacagcggctacgagtggatcaccgacttccccggcaagaccgtgtggttcgtcccctccatcaagagcgggaacgacatcgccaactgcctgcggaagaacggcaagcgcgtgatccagctctcccggaagacgttcgacaccgagtaccagaagaccaagaacaacgactgggactacgtggtcaccacggacatcagcgagatgggggccaacttccgcgcggaccgggtgatcgacccgcgccggtgcctgaagcccgtgatcctgaaggacggccccgagcgcgtcatcctcgccgggcccatgccggtgaccgtcgcctccgccgcccagcggcgcggccggatcggccgcaaccacaacaaggagggggaccagtacatctacatgggccagcccctgaacaacgacgaggaccacgcgcactggaccgaggccaagatgctgctcgacaacatcaacacccccgaggggatcatccccgccctgttcgagccggagcgcgagaagtccgccgccatcgacggcgagtaccggctgcgcggggaggcgcggaagacgttcgtggagctcatgcgccggggcgacctgcccgtgtggctgtcctacaaggtcgccagcgagggcttccagtacagcgaccgccggtggtgcttcgacggggagcgcaacaaccaggtgctcgaggagaacatggacgtggagatctggaccaaggagggcgagcggaagaagctgcgcccccggtggctggacgcccgcacctactccgaccccctcgccctgcgggagttcaaggagttcgccgcggggcgccggagcgtctccggcgacctgatcctcgagatcggcaagctgccgcagcacctgacccagcgcgcccagaacgccctcgacaacctggtgatgctgcacaacagcgagcagggcgggcgggcctaccgccacgcgatggaggagctccccgacacgatcgagaccctgatgctgctcgccctgatcgccgtgctgaccgggggcgtcaccctcttcttcctgtccgggcggggcctgggcaagaccagcatcgggctcctgtgcgtgatggcctccagcgtgctgctctggatggcctccgtcgagccccactggatcgcggccagcatcatcctggagttcttcctgatggtgctcctgatccccgagccggaccgccagcggacgccccaggacaaccagctggcctacgtggtcatcggcctcctgttcatgatcctgaccgtggccgccaacgagatggggctcctggagaccaccaagaaggacctgggcatcgggcacgtggcggtcgagaaccaccaccacgccgccatgctcgacgtggacctgcaccccgcctccgcctggacgctgtacgcggtggccaccaccatcatcaccccgatgatgcgccacacgatcgagaacaccaccgccaacatcagcctcaccgccatcgccaaccaggcggccatcctgatgggcctggacaagggctggcccatctccaagatggacatcggggtccccctcctggccctgggctgctacagccaggtgaaccccctcacgctgaccgccgcggtgctgatgctcgtcgcccactacgccatcatcgggccgggcctgcaggccaaggccacccgcgaggcgcagaagcggaccgccgccgggatcatgaagaaccccacggtggacggcatcgtggccatcgacctggaccccgtcgtgtacgacgccaagttcgagaagcagctcggccagatcatgctgctgatcctctgcacctcccagatcctgctgatgcgcaccacctgggcgctctgcgagagcatcacgctggccaccgggcccctgaccaccctctgggagggctccccggggaagttctggaacacgaccatcgccgtgagcatggccaacatcttccggggctcctacctggccggcgcggggctggccttcagcctcatgaagtccctgggcgggggccgccgggggaccggcgcccagggcgagaccctgggggagaagtggaagcgccagctcaaccagctgtccaagagcgagttcaacacgtacaagcggtccggcatcatggaggtcgaccgcagcgaggccaaggaggggctgaagcggggcgagaccaccaagcacgcggtgtcccgcgggaccgccaagctccggtggttcgtggagcgcaacctggtcaagcccgagggcaaggtgatcgacctgggctgcgggcggggcgggtggagctactactgcgccggcctgaagaaggtgacggaggtcaaggggtacaccaagggcggccccgggcacgaggagcccatcccgatggccacctacggctggaacctcgtgaagctgcactccgggaaggacgtgttcttcatcccgcccgagaagtgcgacaccctgctctgcgacatcggcgagagctcccccaacccgacgatcgaggaggggcgcaccctgcgggtcctgaagatggtggagccctggctccgcggcaaccagttctgcatcaagatcctgaacccctacatgcccagcgtggtcgagaccctggagcagatgcagcggaagcacggcgggatgctcgtgcgcaacccgctgtcccggaacagcacccacgagatgtactgggtgtcctgcggcaccgggaacatcgtcagcgccgtgaacatgacgtcccgcatgctgctcaaccgcttcaccatggcgcaccggaagcccacctacgagcgcgacgtggacctgggcgccggcacccggcacgtcgccgtggagcccgaggtggccaacctggacatcatcgggcagcgcatcgagaacatcaagcacgagcacaagagcacgtggcactacgacgaggacaacccctacaagacctgggcctaccacggctcctacgaggtcaagccgagcgggtccgcgagcagcatggtgaacggcgtcgtgaagctcctgaccaagccctgggacgtgatccccatggtcacccagatcgccatgacggacaccacccccttcgggcagcagcgggtgttcaaggagaaggtggacacccgcacgccgaaggccaagcggggcaccgcccagatcatggaggtcaccgccaagtggctgtggggcttcctctcccgcaacaagaagccccggatctgcacccgcgaggagttcacgcggaaggtgcgcagcaacgcggccatcggggccgtgttcgtcgacgagaaccagtggaactccgccaaggaggcggtggaggacgagcggttctgggacctggtgcaccgcgagcgggagctgcacaagcagggcaagtgcgcgacctgcgtctacaacatgatggggaagcgcgagaagaagctcggcgagttcgggaaggccaagggcagccgggccatctggtacatgtggctgggcgcccgcttcctggagttcgaggcgctcgggttcatgaacgaggaccactggttctcccgggagaacagcctgtccggcgtggagggggagggcctgcacaagctcgggtacatcctgcgcgacatcagcaacatccccggcggcaacatgtacgccgacgacaccgccgggtgggacacccggatcacggaggacgacctgcagaacgaggcccgcatcaccgacatcatggagccggagcacgccctcctggcgaagtccatcttcaagctgacctaccagaacaaggtggtccgcgtgcagcggcccgccaagaacggcaccgtgatggacgtcatcagccgccgggaccagcgcgggtccggccaggtgggcacgtacgggctcaacaccttcaccaacatggaggcccagctgatccggcagatggagagcgagggcatcttctcccccagcgagctggagacccccaacctcgccgagcgcgtgctggactggctggagaagtacggggtcgagcggctcaagcgcatggccatctccggcgacgactgcgtggtgaagccgatcgacgaccggttcgcgacggccctgaccgccctgaacgacatggggaaggtccgcaaggacatcccccagtgggagcccagcaagggctggaacgactggcagcaggtccccttctgctcccaccacttccaccagctcatcatgaaggacggccgggagatcgtggtcccgtgccgcaaccaggacgagctggtggggcgggcccgcgtgagccagggcgccgggtggagcctgcgggagaccgcgtgcctcggcaagtcctacgcccagatgtggcagctgatgtacttccaccgccgggacctgcgcctcgccgccaacgcgatctgcagcgccgtccccgtggactggatccccacctcccggacgacctggagcatccacgcccaccaccagtggatgaccaccgaggacatgctgtccgtgtggaaccgcgtctggatcgaggagaacccctggatggaggacaagacgcacatcagctcctggggcgacgtgccgtacctgggcaagcgcgaggaccagtggtgcggcagcctcatcgggctgaccgcccgggccacctgggcgaccaacatccaggtggccatcaaccaggtccgccggctgatcggcaacgagaactacctcgactacatgacctccatgaagcgcttcaagaacgagagcgaccccgagggggccctgtggtga

SEQ ID NO: 8291 - RNA, 9879 nt, synthetic construct
  misc_feature 1..9879: note = derived and/or modified CDS sequence (opt1) from DENV-1__EU677151__SS-prME
  source 1..9879: mol_type = other RNA
agcgtgaccatgctgctcatgctgatccccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacacgatgacctacaagtgcccccggatcaccgaggtggagcccgacgacgtcgactgctggtgcaacaccaccgacacctgggtgacctacgggacctgcagccagacgggcgagcaccggcgggacaagcggagcgtggccctcgcgccccacgtcggcctggggctggagacccgcgccgagacctggatgagcagcgagggcgcgtggaagcagatccagaaggtggagacctgggccctccggcaccccgggttcacggtgatcgccctgttcctggcccacgcgatcggcaccagcatcacccagaaggggatcatcttcatcctcctgatgctggtcaccccctccatggccatgcggtgcgtgggcatcggcagccgggacttcgtggaggggctctccggcgccacgtgggtcgacgtggtgctggagcacgggagctgcgtcaccaccatggccaaggacaagcccaccctggacatcgagctcctgaagacggaggtgaccaaccccgccgtgctgcgcaagctctgcatcgaggcgaagatctccaacaccaccacggacagccggtgccccacccagggcgaggccaccctggtcgaggagcaggacgccaacttcgtgtgccgccggaccttcgtggaccgcggctgggggaacggctgcgggctgttcggcaaggggtccctcatcacgtgcgccaagttcaagtgcgtcaccaagctggagggcaagatcgtgcagtacgagaacctgaagtacagcgtgatcgtcaccgtgcacaccggcgaccagcaccaggtcgggaacgagtccacggagcacggcaccaccgccaccatcacgccccaggcgcccacgagcgagatccagctcaccgactacggggccctgaccctggactgcagcccccggaccggcctcgacttcaacgagatggtgctgctgacgatgaaggagaagtcctggctcgtgcacaagcagtggttcctggacctgccgctcccctggaccagcggggcctccaccagccaggagacctggaaccgccaggacctgctggtcacgttcaagaccgcccacgccaagaagcaggaggtggtggtcctcggctcccaggagggcgcgatgcacaccgccctgaccggggccacggagatccagaccagcggcaccaccacgatcttcgccgggcacctgaagtgccggctcaagatggacaagctgaccctgaagggcatgtcctacgtgatgtgcaccgggagcttcaagctcgagaaggaggtggccgagacccagcacggcacggtcctggtgcagatcaagtacgagggcaccgacgcgccctgcaagatccccttctccacccaggacgagaagggggtgacccagaacggccgcctgatcacggccaacccgatcgtcaccgacaaggagaagcccgtgaacatcgaggccgagccgcccttcggggagagctacatcgtgatcggcgccggcgagaaggcgctgaagctctcctggttcaagaaggggagctccatcggcaagatgttcgaggccaccgcccgcggggcccgccggatggccatcctgggcgacaccgcgtgggacttcgggagcatcggcggcgtcttcacgtccgtggggaagctggtgcaccagatcttcggcaccgcctacggggtcctcttcagcggcgtgtcctggaccatgaagatcgggatcggcgtgctgctgacctggctcggcctgaacagccgctccacgagcctgtccatgacctgcatcgccgtcgggctcgtgaccctgtacctgggcgtgatggtccaggccgacagcgggtgcgtgatcaactggaagggccgcgagctcaagtgcgggagcggcatcttcgtgaccaacgaggtccacacgtggaccgagcagtacaagttccaggccgactccccgaagcggctgagcgcggccatcggcaaggcctgggaggagggggtgtgcggcatccgctccgccacccggctggagaacatcatgtggcgccagatcagcaacgagctcaaccacatcctgctggagaacgacatgaagttcaccgtggtcgtgggggacgtggtcggcatcctcgcccaggggaagaagatgatccggccccagcccatggagcacaagtactcctggaagtcctggggcaaggcgaagatcatcggcgccgacgtgcagaacaccacgttcatcatcgacgggcccaacaccccggagtgccccgacgaccagcgcgcctggaacatctgggaggtggaggactacggcttcgggatcttcaccaccaacatctggctgaagctgcgggactcctacacgcaggtctgcgaccaccgcctcatgagcgccgcgatcaaggactccaaggccgtgcacgccgacatgggctactggatcgagagcgagaagaacgagacctggaagctggcccgggcctccttcatcgaggtgaagacctgcatctggcccaagagccacaccctgtggtccaacggcgtcctcgagagcgagatgatcatccccaagatctacgggggcccgatctcccagcacaactaccgccccgggtacttcacgcagaccgcgggcccctggcacctggggaagctggagctcgacttcgacctgtgcgagggcaccaccgtggtggtcgacgagcactgcggcaaccgcggggccagcctgcgcacgaccaccgtgaccggcaagatcatccacgagtggtgctgccggtcctgcacgctcccgcccctgcgcttcaagggggaggacggctgctggtacgggatggagatccggcccgtgaaggagaaggaggagaacctggtcaagagcatggtgagcgccggctccggcgaggtggacagcttctccctcgggctgctgtgcatcagcatcatgatcgaggaggtcatgcgctcccggtggagccgcaagatgctcatgaccggcaccctggccgtgttcttcctgctcatcatggggcagctgacctggaacgacctgatccggtcctgcatcatggtgggcgccaacgcgagcgaccgcatggggatgggcacgacctacctcgccctgatggccaccttcaagatgcgccccatggtcgccgtgggcctgctgttccggcgcctgacctcccgggaggtcctgctcctgacgatcgggctgagcctcgtggcctccgtggagctgccgaacagcctggaggagctcggcgacgggctggcgatgggcatcatgatcctgaagctcctgaccgacttccagtcctaccagctgtgggccaccctcctgagcctgaccttcatcaagacgaccttctccctccactacgcctggaagaccatggccatggtcctgagcatcgtgtccctgctccccctgtgcctgagcaccacgtcccagaagaccacctggctccccgtgctgctgggcagcctcgggtgcaagcccctgaccatgttcctgatcgcggagaacaagatctggggccgcaagagctggccgctcaacgaggggatcatggccgtcggcatcgtgtccatcctgctgagctccctcctgaagaacgacgtgcccctggccgggcccctcatcgccggcggcatgctgatcgcctgctacgtcatcagcgggtccagcgcggacctgtccctcgagaaggccgccgaggtgagctgggaggaggaggccgagcactccggcgccagccacaacatcctggtggaggtccaggacgacgggacgatgaagatcaaggacgaggagcgggacgacaccctgaccatcctcctgaaggcgaccctgctcgccgtgtccggcgtgtaccccctgagcatcccggccaccctgttcgtctggtacttctggcagaagaagaagcagcgctccggggtgctctgggacacgccctccccgcccgaggtggagcgggccgtcctggacgacggcatctaccgcatcatgcagcggggcctgctggggcgctcccaggtgggcgtgggggtcttccaggagaacgtgttccacaccatgtggcacgtgacccggggcgccgtcctcatgtaccaggggaagcgcctggagccgagctgggcgtccgtgaagaaggacctgatcagctacggcggcgggtggcggctccagggctcctggaacaccggggaggaggtgcaggtcatcgccgtggagcccggcaagaaccccaagaacgtgcagacggcccccgggaccttcaagaccccggagggcgaggtcggcgccatcgccctggacttcaagcccgggaccagcggcagccccatcgtgaaccgcgaggggaagatcgtgggcctgtacggcaacggggtcgtgacgacctccggcacctacgtgagcgcgatcgcccaggccaaggcctcccaggaggggcccctcccggagatcgaggacgaggtcttccggaagcgcaacctgaccatcatggacctgcaccccggcagcgggaagacgcggcgctacctccccgcgatcgtgcgggaggccatcaagcgcaagctgcggaccctgatcctcgccccgacccgcgtggtcgcctccgagatggccgaggcgctgaagggcatgcccatccgctaccagaccacggccgtcaagagcgagcacaccggccgggagatcgtggacctgatgtgccacgccaccttcaccatgcgcctcctgtcccccgtccgggtgcccaactacaacatgatcatcatggacgaggcccacttcacggacccgagctccatcgccgcgcgcgggtacatcagcacccgggtgggcatgggggaggccgccgccatcttcatgaccgccacgccgcccggctccgtcgaggcgttcccccagagcaacgccgtgatccaggacgaggagcgcgacatcccggagcggtcctggaacagcgggtacgagtggatcacggacttccccggcaagaccgtgtggttcgtcccctccatcaagagcggcaacgacatcgccaactgcctgcgcaagaacgggaagcgggtgatccagctctcccgcaagaccttcgacaccgagtaccagaagacgaagaacaacgactgggactacgtggtcaccaccgacatcagcgagatgggcgccaacttccgggcggaccgcgtgatcgacccccggcgctgcctgaagccggtcatcctgaaggacgggcccgagcgggtgatcctcgccggccccatgcccgtgaccgtcgcctccgccgcccagcgccgggggcgcatcggccggaaccacaacaaggagggcgaccagtacatctacatggggcagccgctgaacaacgacgaggaccacgcgcactggacggaggccaagatgctgctcgacaacatcaacacccccgagggcatcatccccgccctgttcgagcccgagcgcgagaagtccgccgccatcgacggggagtaccgcctgcggggcgaggcgcgcaagaccttcgtggagctcatgcggcgcggggacctgccggtgtggctgagctacaaggtcgcctccgagggcttccagtacagcgaccggcgctggtgcttcgacggcgagcggaacaaccaggtgctcgaggagaacatggacgtggagatctggaccaaggagggggagcgcaagaagctgcggccccgctggctggacgcccggacgtactccgaccccctcgccctgcgcgagttcaaggagttcgccgcgggccggcgcagcgtctccggggacctgatcctcgagatcggcaagctgccccagcacctgacccagcgggcccagaacgccctcgacaacctggtgatgctgcacaacagcgagcagggcgggcgcgcctaccggcacgcgatggaggagctcccggacaccatcgagaccctgatgctgctcgccctgatcgccgtgctgacgggcggggtcaccctcttcttcctgtccggccgcgggctgggcaagaccagcatcggcctcctgtgcgtgatggcctccagcgccctgctctggatggcgtccgtggagccccactggatcgccgccagcatcatcctggagttcttcctgatggtcctcctgatccccgagcccgaccggcagcgcaccccgcaggacaaccagctggcctacgtggtgatcgggctcctgttcatgatcctgaccgtcgccgcgaacgagatgggcctcctggagacgaccaagaaggacctggggatcggccacgtggccgtggagaaccaccaccacgccaccatgctcgacgtcgacctgcaccccgcctccgcctggaccctgtacgcggtggccacgaccatcatcacccccatgatgcggcacaccatcgagaacacgaccgccaacatcagcctcaccgccatcgccaaccaggcggccatcctgatggggctggacaagggctggccgatctccaagatggacatcggcgtgcccctcctggccctggggtgctacagccaggtcaaccccctcaccctgacggccgcggtgctgatgctcgtggcccactacgccatcatcggccccgggctgcaggccaaggccacccgcgaggcgcagaagcgcaccgccgccggcatcatgaagaacccgaccgtcgacgggatcgtggccatcgacctggaccccgtggtctacgacgccaagttcgagaagcagctcggccagatcatgctgctgatcctctgcacgtcccagatcctgctgatgcggaccacctgggcgctctgcgagagcatcaccctggccacgggccccctgaccaccctctgggaggggtcccccggcaagttctggaacaccacgatcgccgtgagcatggccaacatcttccgcgggagctacctggccggcgcgggcctggccttctccctcatgaagtccctcgggggcgggcggcgcgggaccggggcccagggcgagaccctgggcgagaagtggaagcggcagctcaaccagctgtccaagagcgagttcaacacctacaagcgctccgggatcatggaggtggaccggagcgaggccaaggagggcctgcgccgcggggagacgaccaagcacgcggtctcccgcggcaccgccaagctccggtggttcgtggagcgcaacctggtgaagccggaggggaaggtcatcgacctgggctgcggccgcggcgggtggagctactactgcgccgggctgaagaaggtgaccgaggtgaaggggtacacgaagggcggccccggccacgaggagcccatccccatggccacctacgggtggaacctcgtcaagctgcactccggcaaggacgtgttcttcatcccgcccgagaagtgcgacaccctgctctgcgacatcggggagagctcccccaaccccaccatcgaggagggccgcacgctgcgggtgctgaagatggtcgagccgtggctccgcgggaaccagttctgcatcaagatcctgaacccctacatgcccagcgtggtggagaccctggagcagatgcagcggaagcacggcggcatgctcgtccgcaaccccctgtcccggaacagcacccacgagatgtactgggtgtcctgcgggaccggcaacatcgtgagcgccgtcaacatgacctcccgcatgctgctcaaccgcttcacgatggcgcaccggaagccgacctacgagcgcgacgtggacctgggggccggcacccggcacgtggccgtcgagcccgaggtggccaacctggacatcatcggccagcgcatcgagaacatcaagcacgagcacaagagcacctggcactacgacgaggacaacccctacaagacgtgggcctaccacgggtcctacgaggtcaagcccagcggcagcgcgtccagcatggtgaacggggtggtcaagctcctgaccaagccgtgggacgtgatccccatggtgacccagatcgccatgaccgacacgacccccttcggccagcagcgggtcttcaaggagaaggtggacacccgcacccccaaggccaagcgggggacggcccagatcatggaggtgaccgcccgctggctgtggggcttcctctcccggaacaagaagccgcgcatctgcacccgggaggagttcacccgcaaggtccggagcaacgcggccatcggcgccgtgttcgtggacgagaaccagtggaactccgccaaggaggcggtcgaggacgagcgcttctgggacctggtgcaccgggagcgcgagctgcacaagcaggggaagtgcgccacgtgcgtgtacaacatgatgggcaagcgggagaagaagctcggggagttcggcaaggccaaggggagccgcgccatctggtacatgtggctgggcgcccggttcctggagttcgaggcgctcggcttcatgaacgaggaccactggttctcccgcgagaacagcctgtccggggtcgagggcgaggggctgcacaagctcggctacatcctgcgggacatcagcaagatccccgggggcaacatgtacgccgacgacaccgccggctgggacacccgcatcaccgaggacgacctgcagaacgaggccaagatcacggacatcatggagcccgagcacgccctcctggcgacctccatcttcaagctgacctaccagaacaaggtggtgcgcgtccagcggccggcccgcaacgggaccgtgatggacgtgatcagccggcgcgaccagcggggctccgggcaggtcggcacgtacggcctcaacaccttcaccaacatggaggcccagctgatccgccagatggagagcgaggggatcttctcccccagcgagctggagacccccaacctcgccgagcgggtgctggactggctggagaagcacggcgtggagcgcctcaagcggatggccatctccggggacgactgcgtcgtgaagcccatcgacgaccgcttcgcgacggccctgagcgccctgaacgacatgggcaaggtgcggaaggacatcccgcagtgggagcccagcaaggggtggaacgactggcagcaggtccccttctgctcccaccacttccaccagctcatcatgaaggacggccgcgagatcgtggtgccctgccggaaccaggacgagctggtcggccgcgcccgggtgagccagggggccggctggtccctgcgcgagaccgcgtgcctcggcaagagctacgcccagatgtggcagctgatgtacttccaccggcgcgacctgcggctcgccgccaacgcgatctgctccgccgtgccggtcgactgggtgcccaccagccgcaccacgtggtccatccacgcccaccaccagtggatgaccaccgaggacatgctgagcgtgtggaaccgcgtctggatcgaggagaacccctggatggaggacaagacccacatctccagctggggcgacgtgccctacctggggaagcgggaggaccagtggtgcggctccctcatcggcctgacggcccgcgccacctgggcgaccaacatccaggtggccatcaaccaggtccggcgcctgatcgggaacgagaactacctcgactacatgaccagcatgaagcggttcaagaacgagtccgacccggagggcgccctgtggtga

SEQ ID NO: 8292 - RNA, 9879 nt, synthetic construct
  misc_feature 1..9879: note = derived and/or modified CDS sequence (opt1) from DENV-1__EU677152__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagaccagcgcgggggtgaacatgtgcaccctcatcgccatggacctgggcgagttctgcgaggacacgatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtcgagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagaccgtccagtacgagaacctgaagtacagcgtgatcgtgaccgtccacacgggcgaccagcaccaggtggggaacgagtccaccgagcacggcaccaccgcgaccatcacgccccaggcccccagcaccgagatccagctgaccgactacggggccctcaccctggactgcagcccccggacgggcctggacttcaacgagatggtcctcctgaccatgaaggagaagtcctggctggtgcacaagcagtggttcctcgacctgccgctgccctggaccagcggggcctccaccagccaggagacgtggaaccggaaggacctcctggtgaccttcaagaccgcccacgcgaagaagcaggaggtcgtggtgctgggctcccaggagggcgccatgcacaccgccctcacgggggccaccgagatccagaccagcggcaccacgaccatcttcgccgggcacctgaagtgccgcctgaagatggacaagctcaccctgaagggcatgtcctacgtcatgtgcaccgggagcttcaagctggagaaggaggtggcggagacgcagcacggcaccgtgctcgtccagatcaagtacgagggcaccgacgccccctgcaagatccccttctccacccaggacgagaagggggtgacgcagaacggccggctgatcaccgccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacacggcctgggacttcgggagcatcggcggcgtgttcacctccgtcgggaagctggtgcaccagatcttcggcaccgcctacggggtgctgttcagcggcgtctcctggaccatgaagatcgggatcggcgtgctcctgacgtggctgggcctcaacagccgctccaccagcctgtccatgacctgcatcgccgtggggctggtcaccctctacctgggcgtgatggtgcaggccgacagcgggtgcgtcatcaactggaagggccgggagctgaagtgcgggagcggcatcttcgtgacgaacgaggtgcacacctggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagttcaccgtggtggtcggggacgtggcgggcatcctggcccaggggaagaagatgatccggccccagcccatggagtacaagtactcctggaagtcctggggcaaggccaagatcatcggcgccgacgtgcagaacacgaccttcatcatcgacgggcccaacaccccggagtgccccgacgaccagcgcgcgtggaacatctgggaggtcgaggactacggcttcgggatcttcaccacgaacatctggctcaagctgcgggactcctacacccaggtgtgcgaccaccgcctgatgagcgccgccatcaaggactccaaggccgtgcacgccgacatgggctactggatcgagagcgagaagaacgagacctggaagctcgcgcgggcctccttcatcgaggtcaagacctgcatctggcccaagagccacacgctgtggtccaacggcgtgctggagagcgagatgatcatccccaagatctacgggggcccgatctcccagcacaactaccgccccgggtacttcacccagaccgccggcccctggcacctcgggaagctggagctggacttcgacctctgcgagggcaccacggtggtcgtggacgagcactgcggcaaccgggggccgagcctgcgcaccaccaccgtgacgggcaagatcatccacgagtggtgctgccggtcctgcaccctgccgcccctgcgcttcaagggggaggacggctgctggtacgggatggagatccggcccgtcaaggagaaggaggagaacctggtcaagagcatggtgagcgccggctccggcgaggtcgacagcttctccctggggctcctgtgcatcagcatcatgatcgaggaggtgatgcgctcccggtggagccgcaagatgctgatgaccggcaccctcgccgtgttcttcctgctgatcatggggcagctcacgtggaacgacctgatccggctgtgcatcatggtcggcgcgaacgcctccgaccgcatggggatgggcaccacctacctcgccctgatggccaccttcaagatgcgcccgatgttcgccgtgggcctcctgttccggcgcctgacgagccgggaggtgctgctcctgaccatcgggctgtccctcgtcgcgagcgtggagctgcccaactccctggaggagctcggcgacgggctggccatgggcatcatgatcctgaagctcctgaccgacttccagagccaccagctgtgggccaccctcctgtccctgacgttcatcaagaccaccttcagcctccactacgcctggaagaccatggcgatggtcctgtccatcgtgagcctgttccccctctgcctgtccacgaccagccagaagaccacctggctgcccgtgctcctgggctccctggggtgcaagccgctcacgatgttcctgatcgccgagaacaagatctggggccgcaagagctggcccctgaacgaggggatcatggccgtcggcatcgtgagcatcctcctgtccagcctgctcaagaacgacgtgcccctggccgggcccctgatcgccggcggcatgctcatcgcgtgctacgtcatctccgggagctccgccgacctgagcctggagaaggccgccgaggtgtcctgggaggaggaggccgagcacagcggcgcgtcccacaacatcctcgtggaggtccaggacgacgggaccatgaagatcaaggacgaggagcgggacgacaccctgaccatcctgctcaaggccaccctgctggccgtgagcggcgtgtacccgctctccatccccgccacgctgttcgtctggtacttctggcagaagaagaagcagcgcagcggggtgctgtgggacacccccagcccgcccgaggtggagcgggccgtcctcgacgacggcatctaccgcatcatgcagcggggcctgctggggcgcagccaggtgggcgtgggggtcttccaggagaacgtgttccacaccatgtggcacgtgacccggggcgcggtcctgatgtaccaggggaagcgcctcgagccctcctgggccagcgtgaagaaggacctgatctcctacggcggcgggtggcggctgcagggcagctggaacacgggggaggaggtgcaggtcatcgccgtggagcccggcaagaaccccaagaacgtgcagaccgcccccgggaccttcaagacctccgagggcgaggtcggcgccatcgcgctcgacttcaagcccgggacgagcggcagccccatcgtgaaccgcgaggggaagatcgtgggcctgtacggcaacggggtcgtgaccacctccggcacctacgtgagcgccatcgcccaggccaaggcgtcccaggaggggcccctgccggagatcgaggacgaggtcttccggaagcgcaacctcacgatcatggacctgcaccccggcagcgggaagacccggcgctacctgcccgccatcgtgcgggaggccatcaagcgcaagctccggaccctgatcctggccccgacccgcgtggtcgcctccgagatggcggaggccctcaagggcatgcccatccgctaccagacgaccgccgtcaagagcgagcacaccggcaaggagatcgtggacctgatgtgccacgccaccttcacgatgcggctgctctcccccgtccgcgtgcccaactacaacatgatcatcatggacgaggcccacttcaccgacccgagctccatcgcggcccgggggtacatcagcacccgcgtgggcatgggggaggccgccgccatcttcatgaccgcgacgccgcccggctccgtcgaggccttcccccagagcaacgccgtgatccaggacgaggagcgggacatcccggagcgctcctggaacagcgggtacgagtggatcaccgacttccccggcaagaccgtgtggttcgtcccctccatcaagagcggcaacgacatcgccaactgcctgcggaagaacgggaagcgcgtgatccagctgtcccggaagaccttcgacacggagtaccagaagaccaagaacaacgactgggactacgtggtcaccaccgacatcagcgagatgggcgcgaacttccgcgccgaccgggtgatcgacccccgccggtgcctcaagccggtgatcctgaaggacgggcccgagcgcgtcatcctggccggccccatgcccgtgacggtcgcctccgccgcgcagcggcgcgggcggatcggccgcaaccacaacaaggagggcgaccagtacatctacatggggcagccgctcaacaacgacgaggaccacgcccactggaccgaggccaagatgctgctggacaacatcaacacccccgagggcatcatccccgccctcttcgagcccgagcgggagaagtccgccgcgatcgacggggagtaccgcctgcgcggcgaggcccggaagaccttcgtggagctgatgcgccgcggggacctcccggtgtggctgagctacaaggtcgcctccgagggcttccagtacagcgaccgccggtggtgcttcgacggcgagcgcaacaaccaggtgctggaggagaacatggacgtggagatctggacgaaggagggggagcggaagaagctccgcccccggtggctggacgcccgcacctactccgaccccctggccctccgggagttcaaggagttcgcggccggccgccggagcgtctccggggacctgatcctggagatcggcaagctcccccagcacctgacccagcgcgcccagaacgccctggacaacctcgtgatgctgcacaacagcgagcagggcgggcgggcgtaccgccacgccatggaggagctgccggacaccatcgagacgctcatgctgctggccctcatcgccgtgctgaccggcggggtcaccctgttcttcctctccggccgggggctgggcaagaccagcatcggcctgctctgcgtgatggcctccagcgtgctgctgtggatggcgtccgtcgagccccactggatcgccgccagcatcatcctcgagttcttcctgatggtgctgctcatccccgagcccgaccgccagcggaccccgcaggacaaccagctggcctacgtggtcatcgggctcctcttcatgatcctgacggtggccgcgaacgagatgggcctgctcgagaccaccaagaaggacctggggatcggccacgccgccgtggagaaccaccaccacgccgccatgctggacgtcgacctccaccccgcgtccgcctggaccctgtacgccgtggccacgaccatcatcacccccatgatgcgccacaccatcgagaacacgaccgccaacatcagcctgaccgcgatcgccaaccaggccgccatcctcatggggctggacaagggctggccgatctccaagatggacatcggcgtgcccctgctcgcgctggggtgctacagccaggtcaaccccctgaccctcacggccgccgtgctgatgctggtggcccactacgccatcatcggccccgggctccaggcgaaggccacccgggaggcccagaagcgcaccgccgccggcatcatgaagaacccgaccgtcgacgggatcgtggcgatcgacctggaccccgtggtctacgacgccaagttcgagaagcagctgggccagatcatgctcctgatcctgtgcacgtcccagatcctcctgatgcgcaccacctgggccctgtgcgagagcatcaccctcgccacgggccccctgaccaccctgtgggaggggtcccccggcaagttctggaacaccacgatcgccgtgagcatggcgaacatcttccgggggagctacctcgccggcgccggcctggccttctccctgatgaagtccctcgggggcgggcgccggggcaccggggcgcagggcgagaccctgggcgagaagtggaagcgccagctgaaccagctctccaagagcgagttcaacacctacaagcggtccgggatcatggaggtggaccgcagcgaggccaaggagggcctgaagcgcggggagacgaccaagcacgccgtctcccgcggcaccgccaagctgcggtggttcgtggagcgcaacctcgtgaagccggaggggaaggtcatcgacctgggctgcggccgcggcgggtggagctactactgcgccgggctgaagaaggtgaccgaggtgaaggggtacacgaagggcgggcccggccacgaggagcccatccccatggcgacctacgggtggaacctggtcaagctccactccggcaaggacgtgttcttcatcccgcccgagaagtgcgacaccctgctgtgcgacatcggggagagctcccccaaccccaccatcgaggagggccgcacgctccgggtgctgaagatggtcgagccgtggctgcgcgggaaccagttctgcatcaagatcctcaacccctacatgcccagcgtggtggagaccctggagcagatgcagcggaagcacggcggcatgctggtccgcaaccccctctcccggaacagcacccacgagatgtactgggtgtcctgcgggaccggcaacatcgtgagcgccgtcaacatgacctcccgcatgctgctgaaccggttcacgatggcccaccgcaagccgacctacgagcgcgacgtggacctcggggccggcacccggcacgtggccgtcgagcccgaggtggcgaacctggacatcatcggccagcgcatcgagaacatcaagcacgagcacaagagcacctggcactacgacgaggacaacccctacaagacgtgggcctaccacgggtcctacgaggtgaagcccagcggcagcgcctccagcatggtcaacggggtggtcaagctgctcaccaagccgtgggacgtgatccccatggtgacccagatcgccatgaccgacacgacccccttcggccagcagcgggtcttcaaggagaaggtggacacccgcacccccaaggccaagcgggggacggcgcagatcatggaggtgaccgccaagtggctgtggggcttcctgtcccgcaacaagaagccgcggatctgcacccgcgaggagttcacccggaaggtccgcagcaacgccgccatcggcgcggtgttcgtggacgagaaccagtggaactccgccaaggaggccgtcgaggacgagcggttctgggacctcgtgcaccgcgagcgggagctgcacaagcaggggaagtgcgccacgtgcgtgtacaacatgatgggcaagcgcgagaagaagctgggggagttcggcaaggccaaggggagccgggcgatctggtacatgtggctcggcgcccgcttcctggagttcgaggccctgggcttcatgaacgaggaccactggttctcccgggagaacagcctctccggggtcgagggcgaggggctgcacaagctgggctacatcctccgcgacatcagcaagatccccgggggcaacatgtacgccgacgacaccgccggctgggacacccggatcaccgaggacgacctgcagaacgaggcgaagatcacggacatcatggagcccgagcacgccctgctcgccaagtccatcttcaagctgacctaccagaacaaggtggtgcgcgtccagcggccggccaagaacgggaccgtgatggacgtgatcagccgccgcgaccagcggggctccgggcaggtcggcacctacggcctgaacacgttcaccaacatggaggcccagctcatccgccagatggagagcgaggggatcttctcccccagcgagctggagacccccaacctggcgggccgggtgctcgactggctggagaagcacggggtggagcgcctgaagcggatggccatctccggcgacgactgcgtcgtgaagcccatcgacgaccgcttcgccaccgccctcacggccctgaacgacatggggaaggtgcggaaggacatcccgcagtgggagcccagcaagggctggaacgactggcagcaggtccccttctgcagccaccacttccaccagctgatcatgaaggacggccgcgagatcgtggtgccctgccggaaccaggacgagctcgtcgggcgcgcgcgggtgtcccagggcgccgggtggagcctgcgcgagaccgcctgcctgggcaagtcctacgcccagatgtggcagctcatgtacttccaccggcgcgacctgcggctggcggccaacgccatctgcagcgccgtgccggtcgactgggtgcccacctcccgcaccacgtggagcatccacgcccaccaccagtggatgaccaccgaggacatgctctccgtgtggaaccgggtctggatcgaggagaacccctggatggaggacaagacccacatcagctcctggggcgacgtgccctacctgggcaagcgcgaggaccagtggtgcggcagcctgatcgggctcacggcgcgggccacctgggccaccaacatccaggtggccatcaaccaggtccgccgcctgatcggcaacgagaactacctggactacatgacctccatgaagcggttcaagaacgagagcgacccggagggggccctctggtga

SEQ ID NO: 8293 - RNA, 9879 nt, synthetic construct
  misc_feature 1..9879: note = derived and/or modified CDS sequence (opt1) from DENV-1__EU677155__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccaccgacacctgggtgacctacgggacctgcagccagacgggcgagcaccggcgggacaagcggtccgtggccctcgcgccccacgtgggcctggggctggagacccgcaccgagacctggatgagctccgagggcgcgtggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtcgggaagctggtgcaccagatcttcggcaccgcctacggggtgctgttctccggcgtcagctggacgatgaagatcgggatcggcgtgctgctgacctggctcggcctgaactcccgcagcacctccctgagcatgacctgcatcgccgtggggctcgtcacgctgtacctgggcgtgatggtgcaggccgactccgggtgcgtcatcaactggaagggccgggagctcaagtgcgggagcggcatcttcgtgaccaacgaggtgcacacctggaccgagcagtacaagttccaggccgacagcccgaagcgcctgtccgcggccatcggcaaggcctgggaggagggggtctgcggcatccggagcgccacccgcctggagaacatcatgtggaagcagatctccaacgagctcaaccacatcctgctggagaacgacatgaagttcacggtggtggtcggggacgtggccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtcgaggactacggcttcgggatcttcacgaccaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacgtgcatctggcccaagtcccacaccctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcacgaccgtggtcgtggacgagcactgcggcaaccgggggccgtccctgcgcaccaccacggtgaccggcaagatcatccacgagtggtgctgccggagctgcaccctgccgcccctccgcttccgcggggaggacggctgctggtacgggatggagatccgccccgtcaaggagaaggaggagaacctggtgaagtccatggtgagcgccggcagcggcgaggtcgactccttcagcctcgggctgctgtgcatctccatcatgatcgaggaggtgatgcggagccgctggtcccggaagatgctcatgaccggcacgctggccgtgttcttcctgctcatcatggggcagctgacctggaacgacctgatccgcctctgcatcatggtcggcgccaacgcgagcgaccgcatggggatgggcaccacctacctggccctgatggccacgttcaagatgcggccgatgttcgccgtgggcctcctgttccgccggctgacctcccgcgaggtgctcctgctgaccatcgggctcagcctggtcgcctccgtggagctgcccaacagcctcgaggagctgggcgacgggctggcgatgggcatcatgatcctcaagctgctgaccgacttccagtcccaccagctctgggccacgctgctgagcctcaccttcatcaagaccaccttctccctgcactacgcctggaagacgatggccatggtcctgagcatcgtgtccctcttccccctgtgcctgagcaccacctcccagaagaccacgtggctccccgtgctgctgggcagcctcgggtgcaagccgctgaccatgttcctgatcgcggagaacaagatctggggccggcgctcctggcccctcaacgaggggatcatggccgtcggcatcgtgagcatcctgctgagctccctcctgaagaacgacgtgcccctggccgggcccctcatcgccggcggcatgctgatcgcctgctacgtcatcagcgggtccagcgcggacctgtccctcgagaaggccgccgaggtgagctgggaggaggaggccgagcactccggcaccagccacaacatcctggtggaggtccaggacgacgggaccatgaagatcaaggacgaggagcgggacgacaccctgacgatcctcctgaaggccaccctgctcgcggtgtccggcgtgtacccgctgagcatccccgccaccctgttcgtctggtacttctggcagaagaagaagcagcgctccggggtgctctgggacacccccagcccgcccgaggtggagcgggccgtcctggacgacggcatctaccgcatcatgcagcggggcctgctggggcgctcccaggtgggcgtgggggtcttccaggagaacgtgttccacacgatgtggcacgtgacccggggcgccgtcctcatgtaccaggggaagcgcctggagcccagctgggcctccgtgaagaaggacctgatcagctacggcggcgggtggcggctccagggctcctggaacaccggggaggaggtgcaggtcatcgcggtggagcccggcaagaaccccaagaacgtgcagaccgcccccgggacgttcaagacccccgagggcgaggtcggcgccatcgccctggacttcaagcccgggaccagcggctcccccatcgtgaaccgcgaggggaagatcgtgggcctgtacggcaacggggtcgtgaccacgagcggcacctacgtgagcgccatcgcgcaggccaaggcctcccaggaggggccgctccccgagatcgaggacgaggtcttccggaagcgcaacctgaccatcatggacctgcaccccggcagcgggaagacccggcgctacctcccggccatcgtgcgggaggcgatcaagcgcaagctgcgcacgctgatcctcgcccccacccgggtggtcgcctccgagatggccgaggccctgaagggcatgcccatccgctaccagaccaccgcggtcaagagcgagcacacgggcaaggagatcgtggacctgatgtgccacgccaccttcaccatgcggctcctgtcccccgtccgcgtgccgaactacaacatgatcatcatggacgaggcccacttcaccgaccccagctccatcgccgcccgggggtacatcagcacgcgcgtgggcatgggggaggcggccgccatcttcatgaccgccacgccgcccggctccgtcgaggccttcccgcagagcaacgcggtgatccaggacgaggagcgggacatccccgagcgctcctggaacagcgggtacgagtggatcaccgacttccccggcaagacggtgtggttcgtcccctccatcaagagcggcaacgacatcgccaactgcctgcggaagaacgggaagcgcgtgatccagctctcccggaagaccttcgacaccgagtaccagaagaccaagaacaacgactgggactacgtggtcacgaccgacatcagcgagatgggcgccaacttccgcgccgaccgggtgatcgacccgcgccggtgcctgaagcccgtgatcctgaaggacgggcccgagcgcgtcatcctcgcgggccccatgccggtgaccgtcgcctccgccgcccagcggcgcgggcggatcggccgcaaccacaacaaggagggcgaccagtacatctacatggggcagcccctgaacaacgacgaggaccacgcccactggaccgaggcgaagatgctgctcgacaacatcaacacgcccgagggcatcatccccgccctgttcgagccggagcgcgagaagtccgccgccatcgacggggagtaccggctgcgcggcgaggcccggaagaccttcgtggagctcatgcgccgcggggacctgcccgtgtggctgtcctacaaggtcgcgagcgagggcttccagtacagcgaccgccggtggtgcttcgacggcgagcgcaacaaccaggtgctcgaggagaacatggacgtggagatctggaccaaggagggggagcggaagaagctgcgcccccggtggctggacgcccgcacctactccgaccccctcgccctgcgggagttcaaggagttcgccgccggccgccggagcgtctccggggacctgatcctcgagatcggcaagctgccgcagcacctgacgcagcgcgcgcagaacgccctcgacaacctggtgatgctgcacaacagcgagcagggcgggcgggcctaccgccacgccatggaggagctccccgacaccatcgagaccctgatgctgctcgcgctgatcgccgtgctgaccggcggggtcaccctcttcttcctgtccggccgggggctgggcaagacgagcatcggcctcctgtgcgtgatggcctccagcgtgctgctctggatggcctccgtcgagccccactggatcgccgcgagcatcatcctggagttcttcctgatggtgctcctgatccccgagccggaccgccagcggacgccccaggacaaccagctggcctacgtggtcatcgggctcctgttcatgatcctgaccgtggccgccaacgagatgggcctcctggagaccacgaagaaggacctggggatcggccacgtggccgtcgagaaccaccaccacgcggccatgctcgacgtggacctgcaccccgcctccgcctggaccctgtacgccgtggcgaccaccatcatcacgccgatgatgcgccacaccatcgagaacaccaccgccaacatcagcctcacggccatcgccaaccaggccgcgatcctgatggggctggacaagggctggcccatctccaagatggacatcggcgtccccctcctggccctggggtgctacagccaggtgaaccccctcaccctgaccgccgccgtgctgatgctcgtcgcgcactacgccatcatcggcccggggctgcaggccaaggccacccgcgaggcccagaagcggacggcggccggcatcatgaagaaccccaccgtggacgggatcgtggccatcgacctggaccccgtcgtgtacgacgccaagttcgagaagcagctcggccagatcatgctgctgatcctctgcacctcccagatcctgctgatgcgcaccacgtgggccctctgcgagagcatcaccctggcgaccggccccctgaccacgctctgggaggggtccccgggcaagttctggaacaccaccatcgccgtgagcatggccaacatcttccgggggtcctacctggccggcgccggcctggcgttcagcctcatgaagtccctcgggggcgggcgccgggggaccggggcccagggcgagacgctgggcgagaagtggaagcgccagctcaaccagctgtccaagagcgagttcaacacctacaagcggtccgggatcatggaggtcgaccgcagcgaggccaaggagggcctgaagcgcggggagaccaccaagcacgccgtgtcccgcggcacggcgaagctccggtggttcgtggagcgcaacctggtcaagcccgaggggaaggtgatcgacctgggctgcggccgcggcgggtggagctactactgcgccgggctgaagaaggtgaccgaggtcaaggggtacaccaagggcggccccggccacgaggagcccatcccgatggccacctacgggtggaacctcgtgaagctgcactccggcaaggacgtgttcttcatcccgcccgagaagtgcgacacgctgctctgcgacatcggggagagctcccccaacccgaccatcgaggagggccgcaccctgcgggtcctgaagatggtggagccctggctccgcgggaaccagttctgcatcaagatcctgaacccctacatgcccagcgtggtcgagaccctggagcagatgcagcggaagcacggcggcatgctcgtgcgcaacccgctgtcccggaacagcacccacgagatgtactgggtgtcctgcgggacgggcaacatcgtcagcgccgtgaacatgacctcccgcatgctgctcaaccgcttcaccatggcccaccggaagcccacctacgagcgcgacgtggacctgggggcgggcacgcggcacgtcgccgtggagcccgaggtggccaacctggacatcatcggccagcgcatcgagaacatcaagcacgagcacaagagcacctggcactacgacgaggacaacccctacaagacctgggcctaccacgggtcctacgaggtcaagccgagcggctccgccagcagcatggtgaacggggtcgtgaagctcctgaccaagccctgggacgtgatccccatggtcacgcagatcgcgatgaccgacaccacccccttcggccagcagcgggtgttcaaggagaaggtggacacgcgcaccccgaaggccaagcgggggaccgcccagatcatggaggtcaccgccaagtggctgtggggcttcctctcccgcaacaagaagccccggatctgcacgcgcgaggagttcacccggaaggtgcgcagcaacgccgcgatcggcgccgtgttcgtcgacgagaaccagtggaactccgccaaggaggccgtggaggacgagcggttctgggacctggtgcaccgcgagcgggagctgcacaagcaggggaagtgcgcgacctgcgtctacaacatgatgggcaagcgcgagaagaagctcggggagttcggcaaggccaaggggagccgggccatctggtacatgtggctgggcgcccgcttcctggagttcgaggccctcggcttcatgaacgaggaccactggttctcccgggagaacagcctgtccggggtggagggcgaggggctgcacaagctcggctacatcctgcgcgacatcagcaagatccccgggggcaacatgtacgcggacgacaccgccggctgggacacgcggatcaccgaggacgacctgcagaacgaggcccgcatcaccgacatcatggagccggagcacgccctcctggccgggtccatcttcaagctgacctaccagaacaaggtggtccgcgtgcagcggcccgcgaagaacggcacggtgatggacgtcatcagccgccgggaccagcgcgggtccggccaggtgggcacctacgggctcaacaccttcaccaacatggaggcccagctgatccggcagatggagagcgagggcatcttctcccccagcgagctggagacgcccaacctcgccgagcgcgtgctggactggctggagaagtacggggtcgagcggctcaagcgcatggccatctccggcgacgactgcgtggtgaagccgatcgacgaccggttcgccaccgcgctgaccgccctgaacgacatggggaaggtccgcaaggacatcccccagtgggagcccagcaagggctggaacgactggcagcaggtccccttctgctcccaccacttccaccagctcatcatgaaggacggccgggagatcgtggtcccgtgccgcaaccaggacgagctggtggggcgggcccgcgtgagccagggcgccgggtggagcctgcgggagaccgcctgcctcggcaagtcctacgcgcagatgtggcagctgatgtacttccaccgccgggacctgcgcctcgccgccaacgccatctgcagcgcggtccccgtggactggatccccacgtcccggaccacctggagcatccacgcccaccaccagtggatgaccacggaggacatgctgtccgtgtggaaccgcgtctggatcgaggagaacccctggatggaggacaagacccacatcagctcctggggcgacgtgccgtacctgggcaagcgcgaggaccagtggtgcggcagcctcatcgggctgaccgcccgggccacctgggccaccaacatccaggtggcgatcaaccaggtccgccggctgatcggcaacgagaactacctcgactacatgacgtccatgaagcgcttcaagaacgagagcgaccccgagggggccctgtggtga

SEQ ID NO: 8294 - RNA, 9879 nt, synthetic construct
  misc_feature 1..9879: note = derived and/or modified CDS sequence (opt1) from DENV-1__EU677157__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtcacctacgggacctgcagccagacgggcgagcaccggcgggacaagcggtccgtggccctcgcgccccacgtgggcctggggctggagacccgcaccgagacctggatgagctccgagggcgcctggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgctggtggaccggggctgggggaacggctgcggcctgttcggcaaggggtccctgatcacgtgcgccaagttcaagtgcgtgaccaagctggagggcaagatcgtccagtacgagaacctcaagtacagcgtgatcgtgaccgtccacacgggcgaccagcaccaggtggggaacgagtccaccgagcacggcaccaccgccaccatcacgccccaggcgcccaccaccgagatccagctgaccgactacggggccctgacgctcgactgcagcccccgcaccggcctggacttcaacgagatggtcctgctcaccatgaaggagaagtcctggctggtgcacaagcagtggttcctggacctccccctgccctggaccagcggggccagcacgtcccaggagacctggaaccggcaggacctgctcgtgaccttcaagaccgcccacgccaagaagcaggaggtcgtggtgctgggcagccaggagggcgcgatgcacacggccctgaccggggccaccgagatccagacctccggcacgaccaccatcttcgccgggcacctcaagtgccgcctgaagatggacaagctgaccctcaagggcatgagctacgtcatgtgcacggggtccttcaagctggagaaggagctggccgagacccagcacggcaccgtgctggtgcagatcaagtacgagggcaccgacgcgccctgcaagatccccttcagcacgcaggacgagaagggggtcacccagaacggccggctcatcaccgccaacccgatcgtgaccgacaaggagaagcccgtgaacatcgaggccgagccgcccttcggggagtcctacatcgtcatcggcgccggcgagaaggcgctgaagctgagctggttcaagaaggggtccagcatcggcaagatgttcgaggccacggcccgcggggcccggcgcatggccatcctcggcgacaccgcgtgggacttcgggtccatcggcggcgtgttcaccagcgtggggaagctggtccaccagatcttcggcaccgcctacggggtgctgttctccggcgtgagctggacgatgaagatcgggatcggcgtcctcctgacctggctgggcctcaactcccgcagcacctccctgagcatgacctgcatcgccgtggggctggtgacgctctacctgggcgtcatggtgcaggccgactccgggtgcgtgatcaactggaagggccgggagctgaagtgcgggagcggcatcttcgtcaccaacgaggtgcacacctggaccgagcagtacaagttccaggccgacagcccgaagcgcctctccgcggccatcggcaaggcctgggaggagggggtgtgcggcatccggagcgccacccgcctggagaacatcatgtggaagcagatctccaacgagctgaaccacatcctcctggagaacgacatgaagttcacggtcgtggtgggggacgtcgccggcatcctggcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctcaagctgcgggacagctacacccaggtctgcgaccaccgcctgatgtccgcggccatcaaggacagcaaggccgtgcacgccgacatgggctactggatcgagtccgagaagaacgagacctggaagctcgcccgggcgagcttcatcgaggtgaagacgtgcatctggcccaagtcccacaccctgtggagcaacggcgtcctggagtccgagatgatcatccccaagatctacgggggcccgatcagccagcacaactaccgccccgggtacttcacccagaccgccggcccctggcacctcgggaagctggagctggacttcgacctctgcgagggcacgaccgtggtggtcgacgagcactgcggcaaccgggggccgtccctgcgcaccaccacggtgaccggcaagatcatccacgagtggtgctgccggagctgcaccctgccgcccctgcgcttccgcggggaggacggctgctggtacgggatggagatccgccccgtgaaggagaaggaggagaacctggtcaagtccatggtgagcgccggcagcggcgaggtggactccttcagcctggggctcctgtgcatctccatcatgatcgaggaggtcatgcggagccgctggtcccggaagatgctgatgaccggcacgctcgccgtgttcttcctgctgatcatggggcagctcacctggaacgacctgatccgcctgtgcatcatggtgggcgccaacgcgagcgaccgcatggggatgggcaccacctacctcgccctgatggccacgttcaagatgcggccgatgttcgccgtcggcctcctcttccgccggctgacctcccgcgaggtgctgctcctgaccatcgggctgagcctcgtggcctccgtcgagctgcccaacagcctggaggagctcggcgacgggctggcgatgggcatcatgatcctgaagctcctgaccgacttccagtcccaccagctgtgggccacgctcctgagcctgaccttcatcaagaccaccttctccctccactacgcctggaagacgatggccatggtgctgagcatcgtctccctgttccccctctgcctgagcaccacctcccagaagaccacgtggctgcccgtgctcctgggcagcctggggtgcaagccgctcaccatgttcctgatcgcggagaacaagatctggggccggcgctcctggcccctgaacgaggggatcatggccgtgggcatcgtcagcatcctcctgagctccctgctcaagaacgacgtgcccctggccgggcccctgatcgccggcggcatgctcatcgcctgctacgtgatcagcgggtccagcgcggacctgtccctggagaaggccgccgaggtcagctgggaggaggaggccgagcactccggcgccagccacaacatcctcgtggaggtgcaggacgacgggaccatgaagatcaaggacgaggagcgggacgacaccctgaccatcctgctcaaggcgacgctgctggccgtctccggcgtgtacccgctcagcatccccgccaccctgttcgtgtggtacttctggcagaagaagaagcagcgctccggggtcctgtgggacacccccagcccgcccgaggtggagcgggccgtgctggacgacggcatctaccgcatcatgcagcggggcctcctggggcgctcccaggtcggcgtgggggtgttccaggagaacgtcttccacaccatgtggcacgtgacgcggggcgccgtgctgatgtaccaggggaagcgcctcgagcccagctgggcgtccgtcaagaaggacctgatcagctacggcggcgggtggcggctgcagggctcctggaacaccggggaggaggtccaggtgatcgccgtcgagcccggcaagaaccccaagaacgtgcagaccgcccccgggaccttcaagacgcccgagggcgaggtgggcgccatcgccctcgacttcaagcccgggaccagcggctcccccatcgtcaaccgcgaggggaagatcgtgggcctgtacggcaacggggtggtcaccaccagcggcacgtacgtgagcgcgatcgcccaggccaaggcctcccaggaggggccgctgcccgagatcgaggacgaggtgttccggaagcgcaacctcaccatcatggacctgcaccccggcagcgggaagacccggcgctacctgccggcgatcgtccgggaggccatcaagcgcaagctccgcaccctgatcctggcccccacgcgggtggtggcctccgagatggccgaggcgctcaagggcatgcccatccgctaccagaccaccgccgtcaagagcgagcacaccggcaaggagatcgtggacctgatgtgccacgccacgttcaccatgcggctgctctcccccgtgcgcgtcccgaactacaacatgatcatcatggacgaggcccacttcaccgaccccagctccatcgccgcgcgggggtacatcagcacccgcgtgggcatgggggaggccgccgccatcttcatgacggccacgccgcccggctccgtggaggcgttcccgcagagcaacgccgtcatccaggacgaggagcgggacatccccgagcgctcctggaacagcgggtacgagtggatcaccgacttccccggcaagaccgtgtggttcgtgccctccatcaagagcggcaacgacatcgccaactgcctgcggaagaacgggaagcgcgtcatccagctgtcccggaagacgttcgacaccgagtaccagaagaccaagaacaacgactgggactacgtggtgaccacggacatcagcgagatgggcgccaacttccgcgcggaccgggtcatcgacccgcgccggtgcctcaagcccgtgatcctgaaggacgggcccgagcgcgtgatcctggccggccccatgccggtcaccgtggcctccgccgcccagcggcgcgggcggatcggccgcaaccacaacaaggagggcgaccagtacatctacatggggcagcccctcaacaacgacgaggaccacgcgcactggaccgaggccaagatgctgctggacaacatcaacacccccgagggcatcatccccgccctcttcgagccggagcgcgagaagtccgccgccatcgacggggagtaccggctgcgcggcgaggcgcggaagacgttcgtcgagctgatgcgccgcggggacctccccgtgtggctgtcctacaaggtggccagcgagggcttccagtacagcgaccgccggtggtgcttcgacggcgagcgcaacaaccaggtcctggaggagaacatggacgtggagatctggaccaaggagggggagcggaagaagctccgcccccggtggctggacgcccgcacctactccgaccccctggccctccgggagttcaaggagttcgccgcgggccgccggagcgtgtccggggacctgatcctggagatcggcaagctcccgcagcacctgacccagcgcgcccagaacgccctggacaacctcgtcatgctgcacaacagcgagcagggcgggcgggcctaccgccacgcgatggaggagctgcccgacacgatcgagaccctcatgctgctggccctcatcgccgtgctgaccggcggggtgaccctgttcttcctctccggccgggggctgggcaagaccagcatcggcctgctctgcgtcatggcctccagcgtgctgctgtggatggcctccgtggagccccactggatcgcggccagcatcatcctcgagttcttcctgatggtcctgctcatccccgagccggaccgccagcggacgccccaggacaaccagctggcctacgtggtgatcgggctcctcttcatgatcctgaccgtcgccgccaacgagatgggcctgctcgagaccaccaagaaggacctggggatcggccacgtggcggtggagaaccaccaccacgccgccatgctggacgtcgacctccaccccgcctccgcctggacgctgtacgcggtggccaccaccatcatcaccccgatgatgcgccacacgatcgagaacaccaccgccaacatcagcctgaccgccatcgccaaccaggcggccatcctcatggggctggacaagggctggcccatctccaagatggacatcggcgtgcccctgctcgccctggggtgctacagccaggtcaaccccctgacgctcaccgccgcggtgctgatgctggtggcccactacgccatcatcggcccggggctccaggccaaggccacccgcgaggcgcagaagcggaccgccgccggcatcatgaagaaccccacggtcgacgggatcgtggccatcgacctggaccccgtggtctacgacgccaagttcgagaagcagctgggccagatcatgctcctgatcctgtgcacctcccagatcctcctgatgcgcaccacctgggcgctgtgcgagagcatcacgctcgccaccggccccctgaccaccctgtgggaggggtccccgggcaagttctggaacacgaccatcgccgtgagcatggccaacatcttccgggggtcctacctcgccggcgcgggcctggccttcagcctgatgaagtccctcgggggcgggcgccggggcaccggggcccagggcgagaccctgggcgagaagtggaagcgccagctgaaccagctctccaagagcgagttcaacacgtacaagcggtccgggatcatggaggtggaccgcagcgaggccaaggagggcctgaagcgcggggagaccaccaagcacgcggtctcccgcggcaccgccaagctgcggtggttcgtggagcgcaacctggtgaagcccgaggggaaggtcatcgacctcggctgcggccgcggcgggtggagctactactgcgccgggctgaagaaggtgacggaggtgaaggggtacaccaagggcgggcccggccacgaggagcccatcccgatggccacctacgggtggaacctggtcaagctccactccggcaaggacgtgttcttcatcccgcccgagaagtgcgacaccctgctgtgcgacatcggggagagctcccccaacccgacgatcgaggagggccgcaccctccgggtgctgaagatggtcgagccctggctgcgcgggaaccagttctgcatcaagatcctcaacccctacatgcccagcgtggtggagaccctggagcagatgcagcggaagcacggcggcatgctggtccgcaacccgctctcccggaacagcacccacgagatgtactgggtgtcctgcgggaccggcaacatcgtgagcgccgtcaacatgacgtcccgcatgctgctgaaccgcttcaccatggcgcaccggaagcccacctacgagcgcgacgtggacctcggggccggcacccggcacgtggccgtcgagcccgaggtggccaacctggacatcatcggccagcgcatcgagaacatcaagcacgagcacaagagcacgtggcactacgacgaggacaacccctacaagacctgggcctaccacgggtcctacgaggtgaagccgagcggctccgcgagcagcatggtcaacggggtggtcaagctgctcaccaagccctgggacgtgatccccatggtgacccagatcgccatgacggacaccacccccttcggccagcagcgggtcttcaaggagaaggtggacacccgcacgccgaaggccaagcgggggaccgcccagatcatggaggtgaccgccaagtggctgtggggcttcctgtcccgcaacaagaagccccggatctgcacccgcgaggagttcacgcggaaggtccgcagcaacgcggccatcggcgccgtgttcgtggacgagaaccagtggaactccgccaaggaggcggtcgaggacgagcggttctgggacctcgtgcaccgcgagcgggagctgcacaagcaggggaagtgcgcgacctgcgtgtacaacatgatgggcaagcgcgagaagaagctgggggagttcggcaaggccaaggggagccgggccatctggtacatgtggctcggcgcccgcttcctggagttcgaggcgctgggcttcatgaacgaggaccactggttctcccgggagaacagcctctccggggtcgagggcgaggggctgcacaagctgggctacatcctccgcgacatcagcaagatccccgggggcaacatgtacgccgacgacaccgccggctgggacacccggatcacggaggacgacctgcagaacgaggcccgcatcaccgacatcatggagccggagcacgccctgctcgcgaagtccatcttcaagctgacctaccagaacaaggtggtgcgcgtccagcggcccgccaagaacgggaccgtgatggacgtgatcagccgccgggaccagcgcggctccgggcaggtcggcacgtacggcctgaacaccttcaccaacatggaggcccagctcatccggcagatggagagcgaggggatcttctcccccagcgagctggagacccccaacctggccaagcgcgtgctcgactggctggagaagtacggcgtggagcggctgaagcgcatggccatctccggggacgactgcgtcgtgaagccgatcgacgaccggttcgcgacggccctcaccgccctgaacgacatgggcaaggtgcgcaaggacatcccccagtgggagcccagcaaggggtggaacgactggcagcaggtccccttctgctcccaccacttccaccagctgatcatgaaggacggccgggagatcgtggtgccgtgccgcaaccaggacgagctcgtcggccgggcccgcgtgagccagggggccggctggagcctgcgggagaccgcgtgcctggggaagtcctacgcccagatgtggcagctcatgtacttccaccgccgggacctgcgcctggccgccaacgcgatctgcagcgccgtgcccgtcgactggatccccacctcccggacgacctggagcatccacgcccaccaccagtggatgaccaccgaggacatgctctccgtgtggaaccgcgtgtggatcgaggagaacccctggatggaggacaagacgcacatcagctcctggggcgacgtcccgtacctggggaagcgcgaggaccagtggtgcggcagcctgatcggcctcaccgcccgggccacctgggcgaccaacatccaggtggccatcaaccaggtgcgccggctgatcgggaacgagaactacctggactacatgacctccatgaagcgcttcaagaacgagagcgaccccgagggcgccctctggtga

SEQ ID NO: 8295 - RNA, 9879 nt, synthetic construct
  misc_feature 1..9879: note = derived and/or modified CDS sequence (opt1) from DENV-1__EU677158__SS-prME
  source 1..9879: mol_type = other RNA
agcgtgaccatgctgctgatgctgatgcccaccgccctggccttccacctcaccacccggggcggggagccccacatgatcgtgagcaagcaggagcggggcaagagcctgctgttcaagacctccgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtcacctacgggacctgcagccagacgggcgagcaccggcgggacaagcggtccgtggccctcgcgccccacgtgggcctggggctggagacccgcaccgagacctggatgagctccgagggcgcgtggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcctgacgcaggacgagaagggggtgacccagaacggccggctgatcaccgccaacccgatcgtgaccgacaaggagaagcccgtcaacatcgaggccgagccgcccttcggggagagctacatcatcatcggcgccggcgagaaggcgctcaagctgtcctggttcaagaaggggagctccatcggcaagatgttcgaggccacggcccgcggggcccggcgcatggccatcctgggcgacaccgcgtgggacttcgggagcatcggcggcgtgttcacctccgtggggaagctcgtccaccagatcttcggcaccgcctacggggtgctgttcagcggcgtgtcctggacgatgaagatcgggatcggcgtcctgctcacctggctgggcctgaacagccgctccaccagcctctccatgacctgcatcgccgtggggctggtgacgctgtacctcggcgtcatggtgcaggccgacagcgggtgcgtgatcaactggaagggccgggagctgaagtgcgggtccggcatcttcgtcaccaacgaggtgcacacctggaccgagcagtacaagttccaggccgacagcccgaagcgcctgagcgcggccatcggcaaggcctgggaggagggggtgtgcggcatccggtccgccacccgcctcgagaacatcatgtggaagcagatcagcaacgagctgaaccacatcctgctcgagaacgacatgaagttcacggtcgtggtgggggacgtcgccggcatcctggcgcaggggaagaagatgatccggccccagcccatggagtacaagtactcctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctgaagctccgggactcctacacccaggtctgcgaccaccgcctgatgagcgcggccatcaaggactccaaggccgtgcacgccgacatgggctactggatcgagagcgagaagaacgagacctggaagctggcccgggcgtccttcatcgaggtgaagacgtgcatctggcccaagagccacaccctctggtccaacggcgtcctggagagcgagatgatcatccccaagatctacgggggcccgatctcccagcacaactaccgccccgggtacttcacccagaccgccggcccctggcacctggggaagctcgagctggacttcgacctgtgcgagggcacgaccgtggtggtcgacgagcactgcggcaaccgggggccgagcctccgcaccaccacggtgaccggcaagatcatccacgagtggtgctgccggtcctgcaccctgccgcccctgcgcttccgcggggaggacggctgctggtacgggatggagatccgccccgtgaaggagaaggaggagaacctcgtcaagagcatggtgtccgccggcagcggcgaggtggacagcttctccctggggctgctctgcatcagcatcatcatcgaggaggtcatgcggtcccgctggagccggaagatgctgatgaccggcacgctggccgtgttcgtgctcctgatcatggggcagctgacctggaacgacctcatccgcctgtgcatcatggtcggcgccaacgcgtccgaccgcatggggatgggcaccacctacctggccctcatggccacgttcaagatgcggccgatgttcgccgtgggcctgctgttccgccggctcaccagccgcgaggtgctgctgctcaccatcgggctgtccctggtcgccagcgtggagctccccaactccctggaggagctgggcgacgggctcgcgatgggcatcatgatcctgaagctgctcaccgacttccagagccaccagctgtgggccacgctgctctccctgaccttcatcaagaccaccttcagcctgcactacgcctggaagacgatggccatggtcctctccatcgtgagcctgttccccctgtgcctctccaccaccagccagaagaccacgtggctgcccgtgctgctcggctccctggggtgcaagccgctgaccatgttcctcatcgcggagaacaagatctggggccggcgcagctggcccctgaacgaggggatcatggccgtcggcatcgtgtccatcctgctcagcagcctgctgaagaacgacgtgcccctcgccgggcccctgatcgccggcggcatgctgatcgcctgctacgtcatctccgggagctccgcggacctcagcctggagaaggccgccgaggtgtcctgggaggaggaggccgagcacagcggcgcctcccacaacatcctggtggaggtccaggacgacgggaccatgaagatcaaggacgaggagcgggacgacaccctcaccatcctgctgaaggcgacgctcctggccgtgagcggcgtgtacccgctgtccatccccgccaccctcttcgtctggtacttctggcagaagaagaagcagcgcagcggggtgctgtgggacacccccagcccgcccgaggtggagcgggccgtcctggacgacggcatctaccgcatcatgcagcggggcctgctcgggcgcagccaggtgggcgtgggggtcttccaggagaacgtgttccacaccatgtggcacgtgacgcggggcgccgtcctgatgtaccaggggaagcgcctggagccctcctgggcgagcgtgaagaaggacctcatctcctacggcggcgggtggcggctgcagggcagctggaacaccggggaggaggtgcaggtcatcgccgtggagcccggcaagaaccccaagaacgtgcagaccgcccccgggaccttcaagacgcccgagggcgaggtcggcgccatcgccctggacttcaagcccgggacctccggcagccccatcgtgaaccgcgaggggaagatcgtgggcctctacggcaacggggtcgtgaccacctccggcacgtacgtgagcgcgatcgcccaggccaaggccagccaggaggggccgctgcccgagatcgaggacgaggtcttccggaagcgcaacctgaccatcatggacctccaccccggctccgggaagacccggcgctacctgccggcgatcgtgcgggaggccatcaagcgcaagctgcgcaccctcatcctggcccccacgcgggtggtcgccagcgagatggccgaggcgctgaagggcatgcccatccgctaccagaccaccgccgtgaagtccgagcacaccggcaaggagatcgtggacctcatgtgccacgccacgttcaccatgcggctgctgagccccgtccgcgtgccgaactacaacatgatcatcatggacgaggcccacttcaccgacccctccagcatcgccgcgcgggggtacatctccacccgcgtgggcatgggggaggccgccgccatcttcatgacggccacgccgcccggcagcgtcgaggcgttcccgcagtccaacgccgtgatccaggacgaggagcgggacatccccgagcgcagctggaactccgggtacgagtggatcaccgacttccccggcaagaccgtgtggttcgtccccagcatcaagtccggcaacgacatcgccaactgcctccggaagaacgggaagcgcgtgatccagctgagccggaagacgttcgacaccgagtaccagaagaccaagaacaacgactgggactacgtggtcaccacggacatctccgagatgggcgccaacttccgcgcggaccgggtgatcgacccgcgccggtgcctgaagcccgtgatcctcaaggacgggcccgagcgcgtcatcctggccggccccatgccggtgaccgtcgccagcgccgcccagcggcgcgggcggatcggccgcaaccacaacaaggagggcgaccagtacatctacatggggcagcccctgaacaacgacgaggaccacgcgcactggaccgaggccaagatgctcctggacaacatcaacacccccgagggcatcatccccgccctgttcgagccggagcgcgagaagtccgccgccatcgacggggagtaccggctccgcggcgaggcgcggaagacgttcgtggagctgatgcgccgcggggacctgcccgtgtggctcagctacaaggtcgcctccgagggcttccagtacagcgaccgccggtggtgcttcgacggcgagcgcaacaaccaggtgctggaggagaacatggacgtggagatctggaccaaggagggggagcggaagaagctgcgcccccggtggctcgacgcccgcacctacagcgaccccctggccctgcgggagttcaaggagttcgccgcgggccgccggtccgtcagcggggacctcatcctggagatcggcaagctgccgcagcacctcacccagcgcgcccagaacgccctggacaacctggtgatgctccacaactccgagcagggcgggcgggcctaccgccacgcgatggaggagctgcccgacacgatcgagaccctgatgctcctggccctgatcgccgtgctcaccggcggggtcaccctgttcttcctgagcggccgggggctcggcaagacctccatcggcctgctgtgcgtgatggccagctccgtgctcctgtggatggccagcgtcgagccccactggatcgcggcctccatcatcctggagttcttcctcatggtgctgctgatccccgagccggaccgccagcggacgccccaggacaaccagctcgcctacgtggtcatcgggctgctgttcatgatcctcaccgtggccgccaacgagatgggcctgctggagaccaccaagaaggacctcgggatcggccacgtggcggtcgagaaccaccaccacgccgccatgctggacgtggacctgcaccccgccagcgcctggacgctctacgcggtggccaccaccatcatcaccccgatgatgcgccacacgatcgagaacaccaccgccaacatctccctgaccgccatcgccaaccaggcggccatcctgatggggctcgacaagggctggcccatcagcaagatggacatcggcgtccccctgctggccctcgggtgctactcccaggtgaaccccctgacgctgaccgccgcggtgctcatgctggtcgcccactacgccatcatcggcccggggctgcaggccaaggccacccgcgaggcgcagaagcggaccgccgccggcatcatgaagaaccccacggtggacgggatcgtggccatcgacctcgaccccgtcgtgtacgacgccaagttcgagaagcagctgggccagatcatgctgctcatcctgtgcaccagccagatcctgctcatgcgcaccacctgggcgctgtgcgagtccatcacgctggccaccggccccctcaccaccctgtgggaggggagcccgggcaagttctggaacacgaccatcgccgtgtccatggccaacatcttccgggggagctacctggccggcgcgggcctcgccttctccctgatgaagtccctcgggggcgggcgccgggggaccggggcccagggcgagaccctcggcgagaagtggaagcgccagctgaaccagctgagcaagtccgagttcaacacgtacaagcggagcgggatcatggaggtcgaccgctccgaggccaaggagggcctcaagcgcggggagaccaccaagcacgcggtgagccgcggcaccgccaagctgcggtggttcgtggagcgcaacctggtcaagcccgaggggaaggtgatcgacctgggctgcggccgcggcgggtggtcctactactgcgccgggctcaagaaggtgacggaggtcaaggggtacaccaagggcggccccggccacgaggagcccatcccgatggccacctacgggtggaacctggtgaagctgcacagcggcaaggacgtgttcttcatcccgcccgagaagtgcgacaccctcctgtgcgacatcggggagtccagccccaacccgacgatcgaggagggccgcaccctgcgggtcctcaagatggtggagccctggctgcgcgggaaccagttctgcatcaagatcctgaacccctacatgccctccgtggtcgagaccctcgagcagatgcagcggaagcacggcggcatgctggtgcgcaacccgctgagccggaactccacccacgagatgtactgggtgagctgcgggaccggcaacatcgtctccgccgtgaacatgacgagccgcatgctcctgaaccgcttcaccatggcgcaccggaagcccacctacgagcgcgacgtggacctgggggccggcacccggcacgtcgccgtggagcccgaggtggccaacctcgacatcatcggccagcgcatcgagaacatcaagcacgagcacaagtccacgtggcactacgacgaggacaacccctacaagacctgggcctaccacgggagctacgaggtcaagccgtccggcagcgcgtccagcatggtgaacggggtcgtgaagctgctgaccaagccctgggacgtgatccccatggtcacccagatcgccatgacggacaccacccccttcggccagcagcgggtgttcaaggagaaggtggacacccgcacgccgaaggccaagcgggggaccgcccagatcatggaggtcaccgccaagtggctctggggcttcctgagccgcaacaagaagccccggatctgcacccgcgaggagttcacgcggaaggtgcgctccaacgcggccatcggcgccgtgttcgtcgacgagaaccagtggaacagcgccaaggaggcggtggaggacgagcggttctgggacctggtgcaccgcgagcgggagctccacaagcaggggaagtgcgcgacctgcgtctacaacatgatgggcaagcgcgagaagaagctgggggagttcggcaaggccaaggggtcccgggccatctggtacatgtggctgggcgcccgcttcctcgagttcgaggcgctgggcttcatgaacgaggaccactggttcagccgggagaactccctgagcggggtggagggcgaggggctccacaagctgggctacatcctgcgcgacatctccaagatccccgggggcaacatgtacgccgacgacaccgccggctgggacacccggatcacggaggacgacctccagaacgaggcccgcatcaccgacatcatggagccggagcacgccctgctggccaagagcatcttcaagctcacctaccagaacaaggtggtccgcgtgcagcggcccgccaagaacgggaccgtgatggacgtcatctcccgccgggaccagcgcggcagcggccaggtggggacgtacggcctgaacaccttcaccaacatggaggcccagctgatccggcagatggagtccgaggggatcttcagcccctccgagctcgagacccccaacctggccgagcgcgtgctggactggctcgagaagtacggcgtcgagcggctgaagcgcatggccatcagcggggacgactgcgtggtgaagccgatcgacgaccggttcgcgacggccctgaccgccctcaacgacatgggcaaggtccgcaaggacatcccccagtgggagccctccaaggggtggaacgactggcagcaggtccccttctgcagccaccacttccaccagctgatcatgaaggacggccgggagatcgtggtcccgtgccgcaaccaggacgagctggtgggccgggcccgcgtgtcccagggggccggctggagcctccgggagaccgcgtgcctgggcaagagctacgcccagatgtggcagctgatgtacttccaccgccgggacctccgcctggccgccaacgcgatctgctccgccgtccccgtggactggatccccaccagccggacgacctggtccatccacgcccaccaccagtggatgaccaccgaggacatgctgagcgtgtggaaccgcgtctggatcgaggagaacccctggatggaggacaagacgcacatctccagctggggcgacgtgccgtacctcgggaagcgcgaggaccagtggtgcggctccctgatcggcctgaccgcccgggccacctgggcgaccaacatccaggtggccatcaaccaggtccgccggctcatcgggaacgagaactacctggactacatgaccagcatgaagcgcttcaagaacgagggcgaccccgagggggccctgtggtga

SEQ ID NO: 8296 - RNA, 9879 nt, synthetic construct
  misc_feature 1..9879: note = derived and/or modified CDS sequence (opt1) from DENV-1__EU677159__SS-prME
  source 1..9879: mol_type = other RNA
agcgtgaccatgctgctcatgctgatgcccaccgccctggccttccacctcaccacccgcggcggggagccccacatgatcgtgagcaagcaggagcggggcaagagcctgctgttcaagaccagcgcgggggtgaacatgtgcaccctcatcgccatggacctgggcgagctgtgcgaggacaccatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtcctcttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggccgactccgggtgcgtcatcaactggaagggccgggagctcaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctggagaacatcatgtggaagcagatctccaacgagctcaaccacatcctgctggagaacgacatgaagctcaccgtggtggtcggggacgtggcgggcatcctggggcagggcaagaagatgatccggccccagcccatggagtacaagtacagctggaagtcctggggcaaggccaagatcatcggggccgacgcccagaacacgaccttcatcatcgacggccccaacaccccggagtgccccgacgaccagcgcgcgtggaacatctgggaggtggaggactacgggttcggcatcttcaccacgaacatctggctgaagctccgggacagctacacccaggtctgcgaccaccgcctgatgtccgccgccatcaaggacagcaaggccgtgcacgccgacatgggctactggatcgagtccgagaagaacgagacctggaagctggcgcgggccagcttcatcgaggtgaagacctgcatctggcccaagtcccacacgctctggagcaacggggtcctggagtccgagatgatcatccccaagatctacggcgggccgatcagccagcacaactaccgccccggctacttcacccagaccgccgggccctggcacctgggcaagctcgagctggacttcgacctgtgcgagggcaccacggtggtggtcgacgagcactgcgggaaccggggcccgtccctccgcaccaccaccgtgacggggaagatcatccacgagtggtgctgccggagctgcaccctgccgcccctgcgcttccggggcgaggacgggtgctggtacggcatggagatccgccccgtgaaggagaaggaggagaacctcgtcaagtccatggtgagcgccggcagcggggaggtggactccttcagcctgggcctgctctgcatctccatcatgatcgaggaggtcatgcggagccgctggtcccggaagatgctgatgaccgggaccctggccgtgttcttcctcctgatcatgggccagctgacgtggaacgacctcatccgcctgtgcatcatggtgggggcgaacgccagcgaccgcatgggcatgggcaccacctacctggccctcatggccaccttcaagatgcggccgatgttcgccgtcgggctgctgttccgccggctcacgtcccgcgaggtgctgctgctcaccatcgggctgagcctggtggcgtccgtcgagctccccaacagcctggaggagctgggggacggcctcgccatgggcatcatgatcctgaagctgctcaccgacttccagtcccaccagctgtgggccaccctgctcagcctgacgttcatcaagaccaccttctccctgcactacgcctggaagaccatggcgatggtgctcagcatcgtctccctgttccccctgtgcctcagcacgacctcccagaagaccacctggctgcccgtgctgctcgggagcctgggctgcaagccgctgacgatgttcctcatcgccgagaacaagatctgggggcggaagtcctggcccctgaacgagggcatcatggccgtggggatcgtcagcatcctgctcagctccctgctgaagaacgacgtgcccctcgccggccccctgatcgccggcgggatgctgatcgcgtgctacgtgatcagcggctccagcgccgacctctccctggagaaggccgccgaggtcagctgggaggaggaggccgagcactccggggcgagccacaacatcctggtggaggtgcaggacgacggcaccatgaagatcaaggacgaggagcgcgacgacaccctcaccatcctgctgaaggccaccctcctggccgtctccggggtgtacccgatcagcatccccgccacgctgttcgtgtggtacttctggcagaagaagaagcagcggtccggcgtcctctgggacacccccagcccgcccgaggtggagcgcgccgtgctggacgacggcatctaccggatcatgcagcgcgggctgctgggccggtcccaggtcggggtgggcgtgttccaggagaacgtcttccacaccatgtggcacgtgacccgcggggcggtgctcatgtaccagggcaagcggctggagcccagctgggcctccgtcaagaaggacctgatcagctacggcgggggctggcgcctccgggggtcctggaacacgggcgaggaggtccaggtgatcgccgtcgagcccgggaagaaccccaagaacgtgcagaccgcccccggcaccttcaagacccccgagggcgaggtgggggccatcgcgctggacttcaagcccggcacgagcgggtcccccatcgtcaaccgcgagggcaagatcgtgggcctgtacgggaacggcgtggtcaccaccagcgggacctacgtgagcgccatcgcccaggccaaggcgtcccaggagggcccgctccccgagatcgaggacgaggtgttccggaagcgcaacctgacgatcatggacctgcaccccgggagcggcaagacccggcgctacctcccggccatcgtccgggaggccatcaagcgcaagctgcgcaccctgatcctcgcccccacccgggtggtggcctccgagatggcggaggccctgaagggcatgcccatccgctaccagacgaccgccgtcaagagcgagcacaccgggaaggagatcgtggacctgatgtgccacgccaccttcacgatgcggctcctgtcccccgtgcgcgtcccgaactacaacatgatcatcatggacgaggcccacttcaccgaccccagctccatcgcggcccggggctacatcagcacccgcgtggggatgggcgaggccgccgccatcttcatgaccgcgacgccgcccgggtccgtggaggccttcccgcagagcaacgccgtcatccaggacgaggagcgggacatccccgagcgctcctggaacagcggctacgagtggatcaccgacttccccggcaagaccgtgtggttcgtgccctccatcaagagcgggaacgacatcgccaactgcctgcggaagaacggcaagcgcgtcatccagctctcccggaagaccttcgacacggagtaccagaagaccaagaacaacgactgggactacgtggtgaccaccgacatcagcgagatgggggcgaacttccgcgccgaccgggtcatcgacccgcgccggtgcctgaagcccgtgatcctgaaggacggccccgagcgcgtgatcctcgccgggcccatgccggtcacggtggcctccgccgcgcagcggcgcggccggatcggccgcaaccacaacaaggagggggaccagtacatctacatgggccagcccctgaacaacgacgaggaccacgcccactggaccgaggccaagatgctgctcgacaacatcaacacccccgaggggatcatccccgccctgttcgagccggagcgcgagaagtccgccgcggtcgacggcgagtaccggctgcgcggggaggcccggaagaccttcgtggagctcatgcgccggggcgacctgcccgtgtggctgtcctacaaggtcgccagcgagggcttccagtacagcgaccgccggtggtgcttcgacggggagcgcaacaaccaggtgctcgaggagaacatggacgtggagatctggacgaaggagggcgagcggaagaagctgcgcccccggtggctggacgcccgcacctactccgaccccctcgccctgcgggagttcaaggagttcgcggccgggcgccggagcgtctccggcgacctgatcctcgagatcggcaagctgccgcagcacctgacccagcgcgcccagaacgccctcgacaacctggtgatgctgcacaacagcgagcagggcgggcgggcgtaccgccacgccatggaggagctccccgacaccatcgagacgctgatgctgctcgccctgatcgccgtgctgaccgggggcgtcaccctcttcttcctgtccgggcggggcctgggcaagaccagcatcgggctcctgtgcgtgatggcctccagcgtgctgctctggatggcgtccgtcgagccccactggatcgccgccagcatcatcctggagttcttcctgatggtgctcctgatccccgagccggaccgccagcggacgccccaggacaaccagctggcctacgtggtcatcggcctcctgttcatgatcctgacggtggccgcgaacgagatggggctcctggagaccaccaagaaggacctgggcatcgggcacgtggccgtcgagaaccaccaccacgccgccatgctcgacgtggacctgcaccccgcctccgcgtggaccctgtacgccgtggccacgaccatcatcaccccgatgatgcgccacaccatcgagaacacgaccgccaacatcagcctcaccgccatcgcgaaccaggccgccatcctgatgggcctggacaagggctggcccatctccaagatggacatcggggtccccctcctggccctgggctgctacagccaggtgaaccccctcaccctgacggcggccgtgctgatgctcgtcgcccactacgccatcatcgggccgggcctgcaggccaaggcgacccgcgaggcccagaagcggaccgccgccgggatcatgaagaaccccaccgtggacggcatcgtggccatcgacctggaccccgtcgtgtacgacgcgaagttcgagaagcagctcggccagatcatgctgctgatcctctgcacgtcccagatcctgctgatgcgcaccacctgggccctctgcgagagcatcaccctggccacggggcccctgaccaccctctgggagggctccccggggaagttctggaacaccacgatcgccgtgagcatggccaacatcttccggggctcctacctggcgggcgccgggctggccttcagcctcatgaagtccctgggcgggggccgccgggggaccggcgcccagggcgagaccctgggggagaagtggaagcgccagctcaaccagctgtccaagagcgagttcaacacctacaagcggtccggcatcatggaggtcgaccgcagcgaggcgaaggaggggctgaagcggggcgagacgaccaagcacgccgtgtcccgcgggaccgccaagctccggtggttcgtggagcgcaacctggtcaagcccgagggcaaggtgatcgacctgggctgcgggcggggcgggtggagctactactgcgccggcctgaagaaggtgaccgaggtcaaggggtacacgaagggcggccccgggcacgaggagcccatcccgatggccacctacggctggaacctcgtgaagctgcactccgggaaggacgtgttcttcatcccgcccgagaagtgcgacaccctgctctgcgacatcggcgagagctcccccaacccgaccatcgaggaggggcgcacgctgcgggtcctgaagatggtggagccctggctccgcggcaaccagttctgcatcaagatcctgaacccctacatgcccagcgtggtcgaggcgctggagcagatgcagcggaagcacggcgggatgctcgtgcgcaacccgctgtcccggaacagcacccacgagatgtactgggtgtcctgcggcaccgggaacatcgtcagcgccgtgaacatgacctcccgcatgctgctcaaccgcttcaccatggcccaccggaagcccacgtacgagcgcgacgtggacctgggcaccggcacccggcacgtcgccgtggagcccgaggtggccaacctggacatcatcgggcagcgcatcgagaacatcaagcacgagcacaagagcacctggcactacgacgaggacaacccctacaagacgtgggcgtaccacggctcctacgaggtcaagccgagcgggtccgccagcagcatggtgaacggcgtcgtgaagctcctgaccaagccctgggacgtgatccccatggtcacccagatcgccatgaccgacacgacccccttcgggcagcagcgggtgttcaaggagaaggtggacacccgcaccccgaaggccaagcggggcacggcccagatcatggaggtcaccgcgcgctggctgtggggcttcctctcccggaacaagaagccccgcatctgcacccgggaggagttcacccgcaaggtgcggagcaacgccgccatcggggccgtgttcgtcgacgagaaccagtggaactccgcgaaggaggccgtggaggacgagcgcttctgggacctggtgcaccgggagcgcgagctgcacaagcagggcaagtgcgccacgtgcgtctacaacatgatggggaagcgggagaagaagctcggcgagttcgggaaggccaagggcagccgcgccatctggtacatgtggctgggcgcgcggttcctggagttcgaggccctcgggttcatgaacgaggaccactggttctcccgcgagaacagcctgtccggcgtggagggggagggcctgcacaagctcgggtacatcctgcgggacatcagcaagatccccggcggcaacatgtacgccgacgacaccgccgggtgggacacccgcatcaccgaggacgacctgcagaacgaggccaagatcacggacatcatggagccggagcacgcgctcctggccaaggccatcttcaagctgacctaccagaacaaggtggtccgcgtgcagcggcccgccaagaacggcaccgtgatggacgtcatctcccgccgggaccagcgcgggagcggccaggtgggcacctacgggctcaacacgttcaccaacatggaggcccagctgatccggcagatggagtccgagggcatcttcagcccctccgagctggagacccccaacctcgcggagcgcgccctggactggctggggaagtacggcgtggagcggctcaagcgcatggccatcagcggggacgactgcgtcgtgaagccgatcgacgaccggttcgccaccgccctgacggcgctgaacgacatgggcaaggtgcgcaaggacatcccccagtgggagccctccaagggctggaacgactggcagcaggtccccttctgcagccaccacttccaccagctcatcatgaaggacgggcgggagatcgtggtgccgtgccgcaaccaggacgagctggtcggccgggcccgcgtgtcccagggggccggctggagcctgcgggagaccgcctgcctcggcaagagctacgcgcagatgtggcagctgatgtacttccaccgccgggacctgcgcctcgccgccaacgccatctgctccgccgtgcccgtcgactgggtgcccaccagccggaccacgtggtccatccacgcgcaccaccagtggatgaccaccgaggacatgctgagcgtgtggaaccgcgtctggatcgaggagaacccctggatggaggacaagacccacatctccagctgggaggacgtgccgtacctgggcaagcgcgaggaccagtggtgcggctccctcatcgggctgacggcccgggccacctgggccaccaacatccaggtggccatcaaccaggtccgccggctgatcggcaacgagaactacctcgactacatgatcagcatgaagcgcttcaagaacgagtccgaccccgagggggcgctgtggtga

SEQ ID NO: 8297 - RNA, 9879 nt, synthetic construct
  misc_feature 1..9879: note = derived and/or modified CDS sequence (opt1) from DENV-1__EU677160__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagaccagcgcgggggtgaacatgtgcaccctcatcgccatggacctgggcgagttctgcgaggacacgatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcgtgctggtcaccccctccatggccatgcggtgcgtgggcatcggcagccgcgacttcgtggaggggctgtccggcgccacgtgggtcgacgtggtgctcgagcacgggagctgcgtcaccaccatggccaaggacaagcccaccctggacatcgagctgctcaagacggaggtgaccaaccccgcggtgctgcggaagctgtgcatcgaggccaagatctccaacaccaccacggacagccgctgcccgacccagggcgaggccaccctcgtcgaggagcaggacgccaacttcgtgtgccggcgcaccttcgtggaccggggctgggggaacggctgcgggctgttcggcaaggggtccctgatcacgtgcgccaagttcaagtgcgtcaccaagctcgagggcaagaccgtgcagtacgagaacctgaagtacagcgtgatcgtcaccgtgcacacgggcgaccagcaccaggtcgggaacgagtccaccgagcacggcaccaccgcgaccatcacgccccaggcccccagcaccgagatccagctgaccgactacggggccctcaccctggactgcagcccccggacgggcctggacttcaacgagatggtgctcctgaccatgaaggagaagtcctggctggtgcacaagcagtggttcctcgacctgccgctgccctggaccagcggggcctccaccagccaggagacgtggaaccggaaggacctcctggtcaccttcaagaccgcccacgcgaagaagcaggaggtggtggtcctgggctcccaggagggcgccatgcacaccgccctcacgggggccaccgagatccagaccagcggcaccacgaccatcttcgccgggcacctgaagtgccgcctgaagatggacaagctcaccctgaagggcatgtcctacgtgatgtgcaccgggagcttcaagctggagaaggaggtggcggagacgcagcacggcaccgtcctcgtgcagatcaagtacgagggcaccgacgccccctgcaagatccccttctccacccaggacgagaagggggtgacgcagaacggccggctgatcaccgccaacccgatcgtcaccgacaaggagaagcccgtgaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacacggcctgggacttcgggagcatcggcggcgtcttcacctccgtggggaagctggtgcaccagatcttcggcaccgcctacggggtcctgttcagcggcgtgtcctggaccatgaagatcgggatcggcgtgctcctgacgtggctgggcctcaacagccgctccaccagcctgtccatgacctgcatcgccgtcgggctggtgaccctctacctgggcgtgatggtccaggccgacagcgggtgcgtgatcaactggaagggccgggagctgaagtgcgggagcggcatcttcgtgacgaacgaggtccacacctggaccgagcagtacaagttccaggcggactccccgaagcgcctcagcgccgccatcggcaaggcctgggaggagggggtgtgcggcatccggtccgccacccgcctggagaacatcatgtggaagcagatcagcaacgagctgaaccacatcctcctggagaacgacatgaagttcaccgtggtcgtgggggacgtggcgggcatcctggcccaggggaagaagatgatccggccccagcccatggagtacaagtactcctggaagtcctggggcaaggccaagatcatcggcgccgacgtccagaacacgaccttcatcatcgacgggcccaacaccccggagtgccccgacgaccagcgcgcgtggaacatctgggaggtggaggactacggcttcgggatcttcaccacgaacatctggctcaagctgcgggactcctacacccaggtgtgcgaccaccgcctgatgagcgccgccatcaaggactccaaggccgtccacgccgacatgggctactggatcgagagcgagaagaacgagacctggaagctcgcgcgggcctccttcatcgaggtgaagacctgcatctggcccaagagccacacgctgtggtccaacggcgtgctggagagcgagatgatcatccccaagatctacgggggcccgatctcccagcacaactaccgccccgggtacttcacccagaccgccggcccctggcacctcgggaagctggagctggacttcgacctctgcgagggcaccacggtcgtggtggacgagcactgcggcaaccgggggccgagcctgcgcaccaccaccgtcacgggcaagatcatccacgagtggtgctgccggtcctgcaccctgccgcccctgcgcttcaagggggaggacggctgctggtacgggatggagatccggcccgtgaaggagaaggaggagaacctggtcaagagcctggtcagcgccggctccggcgaggtggacagcttctccctcgggctgctgtgcatcagcatcatgatcgaggaggtgatgcgctcccggtggagccgcaagatgctcatgaccggcaccctggccgtcttcttcctgctcatcatggggcagctgacgtggaacgacctgatccggctctgcatcatggtgggcgcgaacgcctccgaccgcatggggatgggcaccacctacctggccctgatggccaccttcaagatgcgcccgatgttcgccgtgggcctcctgttccggcgcctgacgagccgggaggtcctcctgctgaccatcgggctctccctggtggcgagcgtcgagctgcccaactccctcgaggagctgggcgacgggctggccatgggcatcatgatcctcaagctgctgaccgacttccagagccaccagctctgggccaccctgctgtccctcacgttcatcaagaccaccttcagcctgcactacgcctggaagaccatggcgatggtgctgtccatcgtgagcctcttccccctgtgcctgtccacgaccagccagaagaccacctggctccccgtcctgctgggctccctcgggtgcaagccgctgacgatgttcctgatcgccgagaacaagatctggggccgcaagagctggcccctcaacgaggggatcatggccgtgggcatcgtgagcatcctgctgtccagcctcctgaagaacgacgtccccctggccgggcccctcatcgccggcggcatgctgatcgcgtgctacgtgatctccgggagctccgccgacctgagcctcgagaaggccgccgaggtgtcctgggaggaggaggccgagcacagcggcgcgtcccacaacatcctggtcgaggtgcaggacgacgggaccatgaagatcaaggacgaggagcgggacgacaccctgaccatcctcctgaaggccaccctgctcgccgtgagcggcgtctacccgctgtccatccccgccacgctgttcgtgtggtacttctggcagaagaagaagcagcgcagcggggtgctctgggacacccccagcccgcccgaggtcgagcgggccgtgctggacgacggcatctaccgcatcatgcagcggggcctgctggggcgcagccaggtgggcgtcggggtgttccaggagaacgtgttccacaccatgtggcacgtcacccggggcgcggtgctcatgtaccaggggaagcgcctggagccctcctgggccagcgtgaagaaggacctgatctcctacggcggcgggtggcggctccagggcagctggaacacgggggaggaggtccaggtgatcgccgtggagcccggcaagaaccccaagaacgtccagaccgcccccgggaccttcaagacctccgagggcgaggtgggcgccatcgcgctggacttcaagcccgggacgagcggcagccccatcgtgaaccgcgaggggaagatcgtcggcctgtacggcaacggggtggtgaccacctccggcacctacgtcagcgccatcgcccaggccaaggcgtcccaggaggggcccctcccggagatcgaggacgaggtgttccggaagcgcaacctgacgatcatggacctgcaccccggcagcgggaagacccggcgctacctccccgccatcgtgcgggaggccatcaagcgcaagctgcggaccctgatcctcgccccgacccgcgtcgtggcctccgagatggcggaggccctgaagggcatgcccatccgctaccagacgaccgccgtcaagagcgagcacaccggcaaggagatcgtcgacctgatgtgccacgccaccttcacgatgcggctcctgtcccccgtgcgcgtgcccaactacaacatgatcatcatggacgaggcccacttcaccgacccgagctccatcgcggcccgggggtacatcagcacccgcgtcggcatgggggaggccgccgccatcttcatgaccgcgacgccgcccggctccgtggaggccttcccccagagcaacgccgtgatccaggacgaggagcgggacatcccggagcgctcctggaacagcgggtacgagtggatcaccgacttccccggcaagaccgtctggttcgtgccctccatcaagagcggcaacgacatcgccaactgcctgcggaagaacgggaagcgcgtgatccagctctcccggaagaccttcgacacggagtaccagaagaccaagaacaacgactgggactacgtcgtgaccaccgacatcagcgagatgggcgcgaacttccgcgccgaccgggtgatcgacccccgccggtgcctgaagccggtcatcctgaaggacgggcccgagcgcgtgatcctcgccggccccatgcccgtcacggtggcctccgccgcgcagcggcgcgggcggatcggccgcaaccacaacaaggagggcgaccagtacatctacatggggcagccgctgaacaacgacgaggaccacgcccactggaccgaggccaagatgctgctcgacaacatcaacacccccgagggcatcatccccgccctgttcgagcccgagcgggagaagtccgccgcgatcgacggggagtaccgcctgcgcggcgaggcccggaagaccttcgtggagctcatgcgccgcggggacctgccggtctggctgagctacaaggtggcctccgagggcttccagtacagcgaccgccggtggtgcttcgacggcgagcgcaacaaccaggtgctcgaggagaacatggacgtcgagatctggacgaaggagggggagcggaagaagctgcgcccccggtggctggacgcccgcacctactccgaccccctcgccctgcgggagttcaaggagttcgcggccggccgccggagcgtgtccggggacctgatcctcgagatcggcaagctgccccagcacctgacccagcgcgcccagaacgccctcgacaacctggtgatgctgcacaacagcgagcagggcgggcgggcgtaccgccacgccatggaggagctcccggacaccatcgagacgctgatgctgctcgccctgatcgccgtcctgaccggcggggtgaccctcttcttcctgtccggccgggggctgggcaagaccagcatcggcctcctgtgcgtgatggcctccagcgtcctgctctggatggcgtccgtggagccccactggatcgccgccagcatcatcctggagttcttcctgatggtgctcctgatccccgagcccgaccgccagcggaccccgcaggacaaccagctggcctacgtcgtgatcgggctcctgttcatgatcctgacggtggccgcgaacgagatgggcctcctggagaccaccaagaaggacctggggatcggccacgtcgccgtggagaaccaccaccacgccgccatgctcgacgtggacctgcaccccgcctccgcgtggaccctgtacgccgtcgccacgaccatcatcacccccatgatgcgccacaccatcgagaacacgaccgccaacatcagcctcaccgccatcgcgaaccaggccgccatcctgatggggctggacaagggctggccgatctccaagatggacatcggcgtgcccctcctggccctggggtgctacagccaggtgaaccccctcaccctgacggcggccgtcctgatgctcgtggcccactacgccatcatcggccccgggctgcaggccaaggcgacccgggaggcccagaagcgcaccgccgccggcatcatgaagaacccgaccgtggacgggatcgtcgccatcgacctggaccccgtggtgtacgacgcgaagttcgagaagcagctcggccagatcatgctgctgatcctctgcacgtcccagatcctgctgatgcgcaccacctgggccctctgcgagagcatcaccctggccacgggccccctgaccaccctctgggaggggtcccccggcaagttctggaacaccacgatcgccgtcagcatggccaacatcttccgggggagctacctggcgggcgccggcctggccttctccctcatgaagtccctcgggggcgggcgccgggggaccggggcccagggcgagaccctgggcgagaagtggaagcgccagctcaaccagctgtccaagagcgagttcaacacctacaagcggtccgggatcatggaggtggaccgcagcgaggcgaaggagggcctgaagcgcggggagacgaccaagcacgccgtgtcccgcggcaccgccaagctccggtggttcgtcgagcgcaacctggtgaagccggaggggaaggtgatcgacctgggctgcggccgcggcgggtggagctactactgcgccgggctgaagaaggtcaccgaggtgaaggggtacacgaagggcggccccggccacgaggagcccatccccatggccacctacgggtggaacctcgtgaagctgcactccggcaaggacgtcttcttcatcccgcccgagaagtgcgacaccctgctctgcgacatcggggagagctcccccaaccccaccatcgaggagggccgcacgctgcgggtgctgaagatggtggagccgtggctccgcgggaaccagttctgcatcaagatcctgaacccctacatgcccagcgtcgtggagaccctggagcagatgcagcggaagcacggcggcatgctcgtgcgcaaccccctgtcccggaacagcacccacgagatgtactgggtctcctgcgggaccggcaacatcgtgagcgcggtgaacatgacctcccgcatgctgctcaaccggttcacgatggcccaccgcaagccgacctacgagcgcgacgtcgacctgggggccggcacccggcacgtggccgtggagcccgaggtcgccaacctggacatcatcggccagcgcatcgagaacatcaagcacgagcacaagagcacctggcactacgacgaggacaacccctacaagacgtgggcgtaccacgggtcctacgaggtgaagcccagcggcagcgcctccagcatggtcaacggggtggtgaagctcctgaccaagccgtgggacgtcatccccatggtgacccagatcgccatgaccgacacgacccccttcggccagcagcgggtgttcaaggagaaggtcgacacccgcacccccaaggccaagcgggggacggcccagatcatggaggtgaccgcgaagtggctgtggggcttcctctcccgcaacaagaagccgcggatctgcacccgcgaggagttcacccggaaggtgcgcagcaacgccgccatcggcgccgtcttcgtggacgagaaccagtggaactccgcgaaggaggccgtggaggacgagcggttctgggacctggtccaccgcgagcgggagctgcacaagcaggggaagtgcgccacgtgcgtgtacaacatgatgggcaagcgcgagaagaagctcggggagttcggcaaggccaaggggagccgggccatctggtacatgtggctgggcgcgcgcttcctggagttcgaggccctcggcttcatgaacgaggaccactggttctcccgggagaacagcctgtccggggtggagggcgaggggctgcacaagctcggctacatcctgcgcgacatcagcaagatccccgggggcaacatgtacgccgacgacaccgccggctgggacacccggatcaccgaggacgacctgcagaacgaggccaagatcacggacatcatggagcccgagcacgcgctcctggccaagtccatcttcaagctgacctaccagaacaaggtcgtgcgcgtgcagcggccggccaagaacgggaccgtcatggacgtgatcagccgccgcgaccagcggggctccggccaggtgggcacctacggcctcaacacgttcaccaacatggaggcccagctgatccgccagatggagagcgaggggatcttctcccccagcgagctggagacccccaacctcgcccggcgcgtcctggactggctggagaagcacggcgtggagcggctcaagcgcatggcgatctccggggacgactgcgtggtcaagcccatcgacgaccggttcgccaccgccctgacggccctgaacgacatgggcaaggtgcgcaaggacatcccgcagtgggagcccagcaaggggtggaacgactggcagcaggtccccttctgcagccaccacttccaccagctcatcatgaaggacggccgggagatcgtcgtgccctgccgcaaccaggacgagctggtgggccgggcccgcgtctcccagggggcgggctggagcctgcgggagaccgcctgcctcgggaagtcctacgcccagatgtggcagctgatgtacttccaccgccgggacctgcgcctcgccgcgaacgccatctgcagcgccgtgccggtggactgggtccccacctcccggaccacgtggagcatccacgcccaccaccagtggatgaccaccgaggacatgctgtccgtgtggaaccgcgtgtggatcgaggagaacccctggatggaggacaagacccacatcagctcctggggcgacgtcccctacctggggaagcgggaggaccagtggtgcggcagcctcatcggcctgacggcccgcgcgacctgggccaccaacatccaggtggccatcaaccaggtgcgccggctgatcgggaacgagaactacctcgactacatgacctccatgaagcgcttcaagaacgagagcgacccggagggcgccctgtggtga

SEQ ID NO: 8298 - RNA, 9879 nt, synthetic construct
  misc_feature 1..9879: note = derived and/or modified CDS sequence (opt1) from DENV-1__EU677162__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagaccagcgccggggtgaacatgtgcaccctcatcgccatggacctgggggagttctgcgaggacaccatgacctacaagtgcccccgcatcaccgaggccgagcccgacgacgtggactgctggtgcaacgccaccgacacgtgggtgacctacgggacctgcagccagaccggggagcaccggcgcgacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggaccagcggggcctccaccagccaggagacctggaaccggaaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctcgtccagatcaagtacgagggcaccgacgccccctgcaagatccccttctccacccaggacgagaagggggtgacccagaacggccggctgatcacggccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggccgcatgttcgaggccaccgcccgcggggcccgccgcatggcgatcctcggcgacaccgcctgggacttcgggagcatcggcggcgtgttcacgtccgtcgggaagctggtgcaccagatcttcggcaccgcctacggggtgctgttcagcggcgtctcctggaccatgaagatcgggatcggcgtgctcctgacctggctgggcctcaacagccggtccacgagcctgtccatgacctgcatcgccgtggggctggtcaccctctacctgggcgtgatggtgcaggccgacagcgggtgcgtcatcaactggaagggccgcgagctgaagtgcgggagcggcatcttcgtgaccaacgaggtgcacacgtggaccgagcagtacaagttccaggcggactccccgaagcggctcagcgccgccatcggcaaggcctgggaggagggggtctgcggcatccgctccgccacccggctggagaacatcatgtggaagcagatcagcaacgagctgaaccacatcctcctggagaacgacatgaagttcaccgtggtggtcggggacgtggcgggcatcctggcccaggggaagaagatgatccgcccccagcccatggagtacaagtactcctggaagtcctggggcaaggccaagatcatcggcgccgacgtgcagaacaccacgttcatcatcgacgggcccaacaccccggagtgccccgacgaccagcgggcgtggaacatctgggaggtcgaggactacggcttcgggatcttcaccaccaacatctggctcaagctgcgcgactcctacacccaggtgtgcgaccaccggctgatgagcgccgccatcaaggactccaaggccgtgcacgccgacatgggctactggatcgagagcgagaagaacgagacctggaagctcgcgcgcgcctccttcatcgaggtcaagacctgcatctggcccaagagccacaccctgtggtccaacggcgtgctggagagcgagatgatcatccccaagatctacgggggcccgatctcccagcacaactaccggcccgggtacttcacgcagaccgccggcccctggcacctcgggaagctggagctggacttcgacctctgcgagggcaccaccgtggtcgtggacgagcactgcggcaaccgcgggccgagcctgcggacgaccaccgtgaccggcaagatcatccacgagtggtgctgccgctcctgcacgctgccgcccctgcggttcaagggggaggacggctgctggtacgggatggagatccgccccgtcaaggagaaggaggagaacctggtcaagagcatggtgagcgccggctccggcgaggtcgacagcttctccctggggctcctgtgcatcagcatcatgatcgaggaggtgatgcggtcccgctggagccggaagatgctgatgaccggcaccctcgccgtgttcttcctgctgatcatggggcagctcacctggaacgacctgatccgcctgtgcatcatggtcggcgcgaacgcctccgaccgcatggggatgggcacgacctacctcgccctgatggccaccttcaagatgcggccgatgttcgccgtgggcctcctgttccgccggctgaccagccgcgaggtgctgctcctgacgatcgggctgtccctcgtcgcgagcgtggagctgcccaactccctggaggagctcggcgacgggctggccatgggcatcatgatcctgaagctcctgaccgacttccagagccaccagctgtgggccaccctcctgtccctgaccttcatcaagacgaccttcagcctccactacgcctggaagaccatggcgatggtcctgtccatcgtgagcctgttccccctctgcctgtccaccacgagccagaagaccacctggctgcccgtgctcctgggctccctggggtgcaagccgctcaccatgttcctgatcgccgagaacaagatctggggccgcaagagctggcccctgaacgaggggatcatggccgtcggcatcgtgagcatcctcctgtccagcctgctcaagaacgacgtgcccctggccgggcccctgatcgccggcggcatgctcatcgcgtgctacgtcatctccgggagctccgccgacctgagcctggagaaggccgccgaggtgtcctgggaggaggaggccgagcacagcggcgcgtcccacaacatcctcgtggaggtccaggacgacgggacgatgaagatcaaggacgaggagcgcgacgacaccctgaccatcctgctcaaggccaccctgctggccgtgagcggcgtgtacccgctctccatccccgccaccctgttcgtctggtacttctggcagaagaagaagcagcggagcggggtgctgtgggacacgcccagcccgcccgaggtggagcgcgccgtcctcgacgacggcatctaccggatcatgcagcgcggcctgctggggcggagccaggtgggcgtgggggtcttccaggagaacgtgttccacaccatgtggcacgtgacccgcggcgcggtcctgatgtaccaggggaagcggctcgagccctcctgggccagcgtgaagaaggacctgatctcctacggcggcgggtggcgcctgcagggcagctggaacaccggggaggaggtgcaggtcatcgccgtggagcccggcaagaaccccaagaacgtgcagacggcccccgggaccttcaagacctccgagggcgaggtcggcgccatcgcgctcgacttcaagcccgggaccagcggcagccccatcgtgaaccgggaggggaagatcgtgggcctgtacggcaacggggtcgtgacgacctccggcacctacgtgagcgccatcgcccaggccaaggcgtcccaggaggggcccctgccggagatcgaggacgaggtcttccgcaagcggaacctcaccatcatggacctgcaccccggcagcgggaagacgcgccggtacctgcccgccatcgtgcgcgaggccatcaagcggaagctccgcaccctgatcctggccccgacccgcgtggtcgcctccgagatggcggaggccctcaagggcatgcccatccggtaccagaccacggccgtcaagagcgagcacaccggcaaggagatcgtggacctgatgtgccacgccaccttcaccatgcgcctgctctcccccgtccgggtgcccaactacaacatgatcatcatggacgaggcccacttcacggacccgagctccatcgcggcccgcgggtacatcagcacccgggtgggcatgggggaggccgccgccatcttcatgaccgcgacgccgcccggctccgtcgaggccttcccccagagcaacgccgtgatccaggacgaggagcgcgacatcccggagcggtcctggaacagcgggtacgagtggatcacggacttccccggcaagaccgtgtggttcgtcccctccatcaagagcggcaacgacatcgccaactgcctgcgcaagaacgggaagcgggtgatccagctgtcccgcaagaccttcgacaccgagtaccagaagacgaagaacaacgactgggactacgtggtcaccaccgacatcagcgagatgggcgcgaacttccgggccgaccgcgtgatcgacccccggcgctgcctcaagccggtgatcctgaaggacgggcccgagcgggtcatcctggccggccccatgcccgtgaccgtcgcctccgccgcgcagcgccgggggcgcatcggccggaaccacaacaaggagggcgaccagtacatctacatggggcagccgctcaacaacgacgaggaccacgcccactggacggaggccaagatgctgctggacaacatcaacacccccgagggcatcatccccgccctcttcgagcccgagcgcgagaagtccgccgcgatcgacggggagtaccgcctgcggggcgaggcccgcaagaccttcgtggagctgatgcggcgcggggacctcccggtgtggctgagctacaaggtcgcctccgagggcttccagtacagcgaccggcgctggtgcttcgacggcgagcggaacaaccaggtgctggaggagaacatggacgtggagatctggaccaaggagggggagcgcaagaagctccggccccgctggctggacgcccggacgtactccgaccccctggccctccgcgagttcaaggagttcgcggccggccggcgcagcgtctccggggacctgatcctggagatcggcaagctcccccagcacctgacccagcgggcccagaacgccctggacaacctcgtgatgctgcacaacagcgagcagggcgggcgcgcgtaccggcacgccatggaggagctgccggacaccatcgagaccctcatgctgctggccctcatcgccgtgctgacgggcggggtcaccctgttcttcctctccggccgcgggctgggcaagaccagcatcggcctgctctgcgtgatggcctccagcgtgctgctgtggatggcgtccgtcgagccccactggatcgccgccagcatcatcctcgagttcttcctgatggtgctgctcatccccgagcccgaccggcagcgcaccccgcaggacaaccagctggcctacgtggtcatcgggctcctcttcatgatcctgaccgtggccgcgaacgagatgggcctgctcgagacgaccaagaaggacctggggatcggccacgtggccgtcgagaaccaccaccacgccgccatgctggacgtggacctccaccccgcctccgcgtggaccctgtacgccgtggccaccacgatcatcacccccatgatgcggcacaccatcgagaacaccacggccaacatcagcctgaccgccatcgcgaaccaggccgccatcctcatggggctggacaagggctggccgatctccaagatggacatcggcgtccccctgctcgccctggggtgctacagccaggtgaaccccctgaccctcaccgcggccgtgctgatgctggtcgcccactacgccatcatcggccccgggctccaggccaaggcgacgcgcgaggcccagaagcgcaccgccgccggcatcatgaagaacccgaccgtggacgggatcgtggccatcgacctggaccccgtcgtgtacgacgcgaagttcgagaagcagctgggccagatcatgctcctgatcctgtgcacctcccagatcctcctgatgcggacgacctgggccctgtgcgagagcatcaccctcgccaccggccccctgacgaccctgtgggaggggtcccccggcaagttctggaacaccaccatcgccgtgagcatggccaacatcttccgcgggagctacctcgcgggcgccggcctggccttctccctgatgaagtccctcgggggcgggcggcgcggcacgggggcccagggcgagaccctgggcgagaagtggaagcggcagctgaaccagctctccaagagcgagttcaacacctacaagcgctccgggatcatggaggtcgaccggagcgaggcgaaggagggcctgaagcgcggggagaccacgaagcacgccgtgtcccggggcaccgccaagctgcgctggttcgtggagcggaacctcgtcaagccggaggggaaggtgatcgacctgggctgcggccgcgggggctggagctactactgcgccgggctgaagaaggtgaccgaggtcaagggctacaccaagggcgggcccggccacgaggagcccatccccatggccacgtacgggtggaacctggtgaagctccactccggcaaggacgtgttcttcatcccgcccgagaagtgcgacaccctgctgtgcgacatcggggagagctcccccaaccccaccatcgaggagggccggaccctccgcgtcctgaagatggtggagccgtggctgcgggggaaccagttctgcatcaagatcctcaacccctacatgcccagcgtggtcgagacgctggagcagatgcagcgcaagcacggcggcatgctggtgcggaaccccctctcccgcaacagcacccacgagatgtactgggtgtcctgcgggaccggcaacatcgtcagcgcggtgaacatgacctcccggatgctgctgaaccgcttcaccatggcccaccgcaagccgacgtacgagcgggacgtggacctcggggccggcacccgccacgtcgccgtggagcccgaggtggccaacctggacatcatcggccagcggatcgagaacatcaagcacgagcacaagagcacctggcactacgacgaggacaacccctacaagacctgggcgtaccacgggtcctacgaggtcaagcccagcggcagcgcctccagcatggtgaacggggtcgtgaagctgctcacgaagccgtgggacgtgatccccatggtcacccagatcgccatgaccgacaccacgcccttcggccagcagcgcgtgttcaaggagaaggtggacacccggacccccaaggccaagcgcgggaccgcccagatcatggaggtcacggcgaagtggctgtggggcttcctgtcccggaacaagaagccgcgcatctgcacccgggaggagttcacccgcaaggtgcggagcaacgccgccatcggcgccgtgttcgtcgacgagaaccagtggaactccgcgaaggaggccgtggaggacgagcgcttctgggacctcgtgcaccgggagcgcgagctgcacaagcaggggaagtgcgcgacctgcgtctacaacatgatgggcaagcgggagaagaagctgggggagttcggcaaggccaaggggagccgcgccatctggtacatgtggctcggcgcgcggttcctggagttcgaggccctgggcttcatgaacgaggaccactggttctcccgcgagaacagcctctccggggtggagggcgaggggctgcacaagctgggctacatcctccgggacatcagcaagatccccgggggcaacatgtacgccgacgacacggccggctgggacacccgcatcaccgaggacgacctgcagaacgaggccaagatcaccgacatcatggagcccgagcacgcgctgctcgccaagtccatcttcaagctgacgtaccagaacaaggtggtccgggtgcagcgcccggccaagaacgggaccgtgatggacgtcatcagccgccgggaccagcgcggctccggccaggtgggcacctacggcctgaacaccttcacgaacatggaggcccagctcatccggcagatggagagcgaggggatcttctcccccagcgagctggagacccccaacctggccggccgcgtgctcgactggctggagaagcacggggtcgagcggctgaagcgcatggcgatctccggcgacgactgcgtggtgaagcccatcgacgaccggttcgccaccgccctcaccgccctgaacgacatggggaaggtccgcaaggacatcccgcagtgggagcccagcaagggctggaacgactggcagcaggtccccttctgcagccaccacttccaccagctgatcatgaaggacggccgggagatcgtggtcccctgccgcaaccaggacgagctcgtggggcgggcccgcgtgtcccagggcgcggggtggagcctgcgggagacggcctgcctgggcaagtcctacgcccagatgtggcagctcatgtacttccaccgccgggacctgcgcctggccgcgaacgccatctgcagcgccgtcccggtggactgggtgcccacctcccggaccacctggagcatccacgcccaccaccagtggatgacgaccgaggacatgctctccgtctggaaccgcgtgtggatcgaggagaacccctggatggaggacaagacccacatcagctcctggggcgacgtgccctacctgggcaagcgggaggaccagtggtgcggcagcctgatcgggctcaccgcccgcgcgacgtgggccaccaacatccaggtcgccatcaaccaggtgcgccggctgatcggcaacgagaactacctggactacatgacctccatgaagcgcttcaagaacgagagcgacccggagggggccctctggtga

SEQ ID NO: 8299 - RNA, 9879 nt, synthetic construct
  misc_feature 1..9879: note = derived and/or modified CDS sequence (opt1) from DENV-1__EU677164__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagaccagcgccggggtgaacatgtgcaccctcatcgccatggacctgggcgagttctgcgaggacaccatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagaccgtccagtacgagaacctgaagtacagcgtgatcgtgaccgtccacacgggcgaccagcaccaggtggggaacgagtccaccgagcacggcaccaccgcgaccatcacgccccaggcccccagcaccgagatccagctgaccgactacggggccctcaccctggactgcagcccccggacgggcctggacttcaacgagatggtcctcctgaccatgaaggagaagtcctggctggtgcacaagcagtggttcctcgacctgccgctgccctggaccagcggggcctccaccagccaggagacgtggaaccggaaggacctcctggtgaccttcaagaccgcccacgcgaagaagcaggaggtcgtggtgctgggctcccaggagggcgccatgcacaccgccctcacgggggccaccgagatccagaccagcggcaccacgaccatcttcgccgggcacctgaagtgccgcctgaagatggacaagctcaccctgaagggcatgtcctacgtcatgtgcaccgggagcttcaagctggagaaggaggtggcggagacgcagcacggcaccgtgctcgtccagatcaagtacgagggcaccgacgccccctgcaagatccccttctccacccaggacgagaagggggtgacgcagaacggccggctgatcaccgccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatcgcgatcctcggcgacacggcctgggacttcgggagcatcggcggcgtgttcacctccgtcgggaagctggtgcaccagatcttcggcaccgcctacggggtgctgttcagcggcgtctcctggaccatgaagatcgggatcggcgtgctcctgacgtggctgggcctcaacagccgctccaccagcctgtccatgacctgcatcgccgtggggctggtcaccctctacctgggcgtgatggtgcaggccgacagcgggtgcgtcatcaactggaagggccgggagctgaagtgcgggagcggcatcttcgtgacgaacgaggtgcacacctggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagttcaccgtggtggtcggggacgtggcgggcatcctggcccaggggaagaagatgatccggccccagcccatggagtacaagtactcctggaagtcctggggcaaggccaagatcatcggcgccgacgtgcagaacacgaccttcatcatcgacgggcccaacaccccggagtgccccgacgaccagcgcgcgtggaacatctgggaggtcgaggactacggcttcgggatcttcaccacgaacatctggctcaagctgcgggactcctacacccaggtgtgcgaccaccgcctgatgagcgccgccatcaaggactccaaggccgtgcacgccgacatgggctactggatcgagagcgagaagaacgagacctggaagctcgcgcgggcctccttcatcgaggtcaagacctgcatctggcccaagagccacacgctgtggtccaacggcgtgctggagagcgagatgatcatccccaagaactacgggggcccgatctcccagcacaactaccgccccgggtacttcacccagaccgccggcccctggcacctcgggaagctggagctggacttcgacctctgcgagggcaccacggtggtcgtggacgagcactgcggcaaccgggggccgagcctgcgcaccaccaccgtgacgggcaagatcatccacgagtggtgctgccggtcctgcaccctgccgcccctgcgcttcaagggggaggacggctgctggtacgggatggagatccggcccgtcaaggagaaggaggagaacctggtcaagagcatggtgagcgccggctccggcgaggtcgacagcttctccctggggctcctgtgcatcagcatcatgatcgaggaggtgatgcgctcccggtggagccgcaagatgctgatgaccggcaccctcgccgtgctgttcctgctcatcatggggcagctgacgtggaacgacctgatccggctctgcatcatggtcggcgcgaacgcctccgaccgcatggggatgggcaccacctacctggccctgatggccaccttcaagatgcgcccgatgttcgccgtgggcctcctgttccggcgcctgacgagccgggaggtgctcctgctgaccatcgggctctccctggtcgcgagcgtggagctgcccaactccctcgaggagctgggcgacgggctggccatgggcatcatgatcctcaagctgctgaccgacttccagagccaccagctctgggccaccctgctgtccctcacgttcatcaagaccaccttcagcctgcactacgcctggaagaccatggcgatggtcctgtccatcgtgagcctcttccccctgtgcctgtccacgaccagccagaagaccacctggctccccgtgctgctgggctccctcgggtgcaagccgctgacgatgttcctgatcgccgagaacaagatctggggccgcaagagctggcccctcaacgaggggatcatggccgtcggcatcgtgagcatcctgctgtccagcctcctgaagaacgacgtgcccctggccgggcccctcatcgccggcggcatgctgatcgcgtgctacgtcatctccgggagctccgccgacctgagcctcgagaaggccgccgaggtgtcctgggaggaggaggccgagcacagcggcgcgtcccacaacatcctggtggaggtccaggacgacgggaccatgaagatcaaggacgaggagcgggacgacaccctgaccaccctcctgaaggccacgctgctcgccgtgagcggcgtgtacccgctgtccatccccgccaccctgttcgtctggtacttctggcagaagaagaagcagcgcagcggggtgctctgggacacccccagcccgcccgaggtggagcgggccgtcctggacgacggcatctaccgcatcatgcagcggggcctgctggggcgcagccaggtgggcgtgggggtcttccaggagaacgtgttccacaccatgtggcacgtgacgcggggcgcggtcctcatgtaccaggggaagcgcctggagccctcctgggccagcgtgaagaaggacctgatctcctacggcggcgggtggcggctccagggcagctggaacaccggggaggaggtgcaggtcatcgccgtggagcccggcaagaaccccaagaacgtgcagaccgcccccgggaccttcaagacgtccgagggcgaggtcggcgccatcgcgctggacttcaagcccgggaccagcggcagccccatcgtgaaccgcgaggggaagatcgtgggcctgtacggcaacggggtcgtgaccacctccggcacgtacgtgagcgccatcgcccaggccaaggcgtcccaggaggggcccctcccggagatcgaggacgaggtcttccggaagcgcaacctgaccatcatggacctgcaccccggcagcgggaagacccggcgctacctccccgccatcgtgcgggaggccatcaagcgcaagctgcggaccctgatcctcgccccgacgcgcgtggtcgcctccgagatggcggaggccctgaagggcatgcccatccgctaccagaccaccgccgtcaagagcgagcacaccggcaaggagatcgtggacctgatgtgccacgccacgttcaccatgcggctcctgtcccccgtccgcgtgcccaactacaacatgatcatcatggacgaggcccacttcaccgacccgagctccatcgcggcccgggggtacatcagcacccgcgtgggcatgggggaggccgccgccatcttcatgacggcgacgccgcccggctccgtcgaggccttcccccagagcaacgccgtgatccaggacgaggagcgggacatcccggagcgctcctggaacagcgggtacgagtggatcaccgacttccccggcaagaccgtgtggttcgtcccctccatcaagagcggcaacgacatcgccaactgcctgcggaagaacgggaagcgcgtgatccagctctcccggaagacgttcgacaccgagtaccagaagaccaagaacaacgactgggactacgtggtcaccacggacatcagcgagatgggcgcgaacttccgcgccgaccgggtgatcgacccccgccggtgcctgaagccggtgatcctgaaggacgggcccgagcgcgtcatcctcgccggccccatgcccgtgaccgtcgcctccgccgcgcagcggcgcgggcggatcggccgcaaccacaacaaggagggcgaccagtacatctacatggggcagccgctgaacaacgacgaggaccacgcccactggaccgaggccaagatgctgctcgacaacatcaacacccccgagggcatcatccccgccctgttcgagcccgagcgggagaagtccgccgcgatcgacggggagtaccgcctgcgcggcgaggcccggaagacgttcgtggagctcatgcgccgcggggacctgccggtgtggctgagctacaaggtcgcctccgagggcttccagtacagcgaccgccggtggtgcttcgacggcgagcgcaacaaccaggtgctcgaggagaacatggacgtggagatctggaccaaggagggggagcggaagaagctgcgcccccggtggctggacgcccgcacctactccgaccccctcgccctgcgggagttcaaggagttcgcggccggccgccggagcgtctccggggacctgatcctcgagatcggcaagctgccccagcacctgacccagcgcgcccagaacgccctcgacaacctggtgatgctgcacaacagcgagcagggcgggcgggcgtaccgccacgccatggaggagctcccggacacgatcgagaccctgatgctgctcgccctgatcgccgtgctgaccggcggggtcaccctcttcttcctgtccggccgggggctgggcaagaccagcatcggcctcctgtgcgtgatggcctccagcgtgctgctctggatggcgtccgtcgagccccactggatcgccgccagcatcatcctggagttcttcctgatggtgctcctgatccccgagcccgaccgccagcggacgccgcaggacaaccagctggcctacgtggtcatcgggctcctgttcatgatcctgaccgtggccgcgaacgagatgggcctcctggagaccaccaagaaggacctggggatcggccacgtggccgtcgagaaccaccaccacgccgccatgctcgacgtggacctgcaccccgcctccgcgtggacgctgtacgccgtggccaccaccatcatcacccccatgatgcgccacacgatcgagaacaccaccgccaacatcagcctcaccgccatcgcgaaccaggccgccatcctgatggggctggacaagggctggccgatctccaagatggacatcggcgtccccctcctggccctggggtgctacagccaggtgaaccccctcacgctgaccgcggccgtgctgatgctcgtcgcccactacgccatcatcggccccgggctgcaggccaaggcgacccgggaggcccagaagcgcaccgccgccggcatcatgaagaacccgacggtggacgggatcgtggccatcgacctggaccccgtcgtgtacgacgcgaagttcgagaagcagctcggccagatcatgctgctgatcctctgcacctcccagatcctgctgatgcgcaccacctgggccctctgcgagagcatcacgctggccaccggccccctgaccaccctctgggaggggtcccccggcaagttctggaacacgaccatcgccgtgagcatggccaacatcttccgggggagctacctggcgggcgccggcctggccttctccctcatgaagtccctcgggggcgggcgccgggggaccggggcccagggcgagaccctgggcgagaagtggaagcgccagctcaaccagctgtccaagagcgagttcaacacgtacaagcggtccgggatcatggaggtcgaccgcagcgaggcgaaggagggcctgaagcgcggggagaccaccaagcacgccgtgtcccgcggcaccgccaagctccggtggttcgtggagcgcaacctggtcaagccggaggggaaggtgatcgacctgggctgcggccgcggcgggtggagctactactgcgccgggctgaagaaggtgacggaggtcaaggggtacaccaagggcgggcccggccacgaggagcccatccccatggccacctacgggtggaacctcgtgaagctgcactccggcaaggacgtgttcttcatcccgcccgagaagtgcgacaccctgctctgcgacatcggggagagctcccccaaccccacgatcgaggagggccgcaccctgcgggtcctgaagatggtggagccgtggctccgcgggaaccagttctgcatcaagatcctgaacccctacatgcccagcgtggtcgagaccctggagcagatgcagcggaagcacggcggcatgctcgtgcgcaaccccctgtcccggaacagcacccacgagatgtactgggtgtcctgcgggaccggcaacatcgtcagcgcggtgaacatgacgtcccgcatgctgctcaaccggttcaccatggcccaccgcaagccgacctacgagcgcgacgtggacctgggggccggcacccggcacgtcgccgtggagcccgaggtggccaacctggacatcatcggccagcgcatcgagaacatcaagcacgagcacaagagcacgtggcactacgacgaggacaacccctacaagacctgggcgtaccacgggtcctacgaggtcaagcccagcggcagcgcctccagcatggtgaacggggtcgtgaagctcctgaccaagccgtgggacgtgatccccatggtcacccagatcgccatgacggacaccacccccttcggccagcagcgggtgttcaaggagaaggtggacacccgcacgcccaaggccaagcgggggaccgcccagatcatggaggtcaccgcgaagtggctgtggggcttcctctcccgcaacaagaagccgcggatctgcacccgcgaggagttcacgcggaaggtgcgcagcaacgccgccatcggcgccgtgttcgtcgacgagaaccagtggaactccgcgaaggaggccgtggaggacgagcggttctgggacctggtgcaccgcgagcgggagctgcacaagcaggggaagtgcgcgacctgcgtctacaacatgatgggcaagcgcgagaagaagctcggggagttcggcaaggccaaggggagccgggccatctggtacatgtggctgggcgcgcgcttcctggagttcgaggccctcggcttcatgaacgaggaccactggttctcccgggagaacagcctgtccggggtggagggcgaggggctgcacaagctcggctacatcctgcgcgacatcagcaagatccccgggggcaacatgtacgccgacgacaccgccggctgggacacccggatcacggaggacgacctgcagaacgaggccaagatcaccgacatcatggagcccgagcacgcgctcctggccaagtccatcttcaagctgacctaccagaacaaggtggtccgcgtgcagcggccggccaagaacgggaccgtgatggacgtcatcagccgccgcgaccagcggggctccggccaggtgggcacgtacggcctcaacaccttcaccaacatggaggcccagctgatccgccagatggagagcgaggggatcttctcccccagcgagctggagacccccaacctcgccggccgggtgctggactggctggagaagcacggggtcgagcgcctcaagcggatggcgatctccggcgacgactgcgtggtgaagcccatcgacgaccgcttcgccacggccctgaccgccctgaacgacatggggaaggtccggaaggacatcccgcagtgggagcccagcaagggctggaacgactggcagcaggtccccttctgcagccaccacttccaccagctcatcatgaaggacggccgcgagatcgtggtcccctgccggaaccaggacgagctggtggggcgcgcccgggtgtcccagggcgcggggtggagcctgcgcgagaccgcctgcctcggcaagtcctacgcccagatgtggcagctgatgtacttccaccggcgcgacctgcggctcgccgcgaacgccatctgcagcgccgtcccggtggactgggtgcccacctcccgcacgacctggagcatccacgcccaccaccagtggatgaccaccgaggacatgctgtccgtctggaaccgggtgtggatcgaggagaacccctggatggaggacaagacgcacatcagctcctggggcgacgtgccctacctgggcaagcgcgaggaccagtggtgcggcagcctcatcgggctgaccgcccgggcgacctgggccaccaacatccaggtcgccatcaaccaggtgcgccgcctgatcggcaacgagaactacctcgactacatgacctccatgaagcggttcaagaacgagagcgacccggagggggccctgtggtga

SEQ ID NO: 8300 - RNA, 9879 nt, synthetic construct
  misc_feature 1..9879: note = derived and/or modified CDS sequence (opt1) from DENV-1__EU677165__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatcacctacaagtgcccccgcatcaccgagaccgagcccgacgacgtggactgctggtgcaacgccacggacacctgggtcacctacgggacctgcagccagacgggcgagcaccggcgcgacaagcggtccgtggccctcgcgccccacgtgggcctggggctggagacccgcaccgagacctggatgagctccgagggcgcctggaagcagatccagcgggtcgagacgtgggccctccgccaccccgggttcaccgtgatcgccctgttcctggcccacgcgatcggcaccagcatcacccagaaggggatcatcttcatcctcctgatgctggccacgccctccatggccatgcggtgcgtgggcatcggcagccgcgacttcgtcgaggggctctccggcgccacctgggtggacgtggtcctggagcacgggagctgcgtgaccaccatggccaaggacaagcccacgctggacatcgagctcctgaagaccgaggtgaccaaccccgcggtcctgcggaagctctgcatcgaggccaagatctccaacaccacgaccgacagccgctgcccgacccagggcgaggccaccctggtggaggagcaggacgccaacttcgtgtgccggcgcacgttcgtcgaccggggctgggggaacggctgcgggctgttcggcaaggggtccctcatcacgtgcgccaagttcaagtgcgtgaccaagctggagggcaagatcgtgcagtacgagaacctgaagtacagcgtcatcgtgaccgtgcacacgggcgaccagcaccaggtcgggaacgagtccaccgagcacggcaccaccgcgaccatcacgccccaggcccccaccaccgagatccagctcaccgactacggggccctgacgctggactgcagcccccgcaccggcctcgacttcaacgagatggtgctgctgaccatgaaggagaagtcctggctcgtccacaagcagtggttcctggacctgcccctcccctggaccagcggggccagcacgtcccaggagacctggaaccggcaggacctgctggtgaccttcaagaccgcccacgcgaagaagcaggaggtggtcgtgctcggcagccaggagggcgccatgcacacggccctgaccggggccaccgagatccagacctccggcacgaccaccatcttcgccgggcacctgaagtgccgcctcaagatggacaagctgaccctgcggggcatgagctacgtgatgtgcacggggtccttcaagctcgagaaggaggtcgcggagacccagcacggcaccgtgctggtgcagatcaagtacgagggcaccgacgccccctgcaagatccccttcagcacgcaggacgagaagggggtcacccagaacggccgcctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccacggcccgcggggcccgccgcatggcgatcctgggcgacaccgcctgggacttcgggtccatcggcggcgtgttcaccagcgtggggaagctggtccaccagatcttcggcaccgcctacggggtgctgttctccggcgtgagctggacgatgaagatcgggatcggcgtcctgctgacctggctcggcctgaactcccggagcacctccctgagcatgacctgcatcgccgtggggctcgtgacgctgtacctgggcgtcatggtgcaggccgactccgggtgcgtgatcaactggaagggccgcgagctcaagtgcgggagcggcatcttcgtcaccaacgaggtgcacacctggaccgagcagtacaagttccaggcggacagcccgaagcggctgtccgccgccatcggcaaggcctgggaggagggggtgtgcggcatccgcagcgccacccggctggagaacatcatgtggaagcagatctccaacgagctcaaccacatcctgctggagaacgacatgaagttcacggtcgtggtgggggacgtcgcgggcatcctcgcccaggggaagaagatgatccgcccccagcccatggagcacaagtacagctggaagtcctggggcaaggccaagatcatcggcgccgacgtgcagaacaccaccttcatcatcgacgggcccaacaccccggagtgccccgacgaccagcgggcgtggaacatctgggaggtggaggactacggcttcgggatcttcacgaccaacatctggctgaagctgcgcgacagctacacccaggtctgcgaccaccggctcatgtccgccgccatcaaggacagcaaggccgtgcacgccgacatgggctactggatcgagtccgagaagaacgagacctggaagctggcgcgcgccagcttcatcgaggtgaagacgtgcatctggcccaagtcccacaccctgtggagcaacggcgtcctcgagtccgagatgatcatccccaagatctacgggggcccgatcagccagcacaactaccggcccgggtacttcacccagaccgccggcccctggcacctggggaagctggagctcgacttcgacctgtgcgagggcacgaccgtggtggtcgacgagcactgcggcaaccgcgggccgtccctgcggaccaccacggtgaccggcaagatcatccacgagtggtgctgccgcagctgcaccctgccgcccctccggttccgcggggaggacggctgctggtacgggatggagatccggcccgtgaaggagaaggaggagaacctggtcaagtccatggtgagcgccggcagcggcgaggtggactccttcagcctcgggctgctgtgcatctccatcatgatcgaggaggtcatgcgcagccggtggtcccgcaagatgctcatgaccggcacgctggccgtgttcttcctgctcatcatggggcagctgacctggaacgacctgatccgcctctgcatcatggtgggcgcgaacgccagcgaccggatggggatgggcaccacctacctggccctgatggccacgttcaagatgcgcccgatgttcgccgtcggcctcctgttccggcgcctgacctcccgggaggtgctcctgctgaccatcgggctcagcctggtggcgtccgtcgagctgcccaacagcctcgaggagctgggcgacgggctggccatgggcatcatgatcctcaagctgctgaccgacttccagtcccaccagctctgggccacgctgctgagcctcaccttcatcaagaccaccttctccctgcactacgcctggaagacgatggcgatggtgctgagcatcgtctccctcttccccctgtgcctgagcaccacctcccagaagaccacgtggctccccgtgctgctgggcagcctcgggtgcaagccgctgaccatgttcctgatcgccgagaacaagatctggggccgccggtcctggcccctcaacgaggggatcatggccgtgggcatcgtcagcatcctgctgagctccctcctgaagaacgacgtgcccctggccgggcccctcatcgccggcggcatgctgatcgcgtgctacgtgatcagcgggtccagcgccgacctgtccctcgagaaggccgccgaggtcagctgggaggaggaggccgagcactccggcgcgagccacaacatcctggtggaggtgcaggacgacgggaccatgaagatcaaggacgaggagcgcgacgacaccctgaccatcctcctgaaggccacgctgctcgccgtctccggcgtgtacccgctgagcatccccgccaccctgttcgtgtggtacttctggcagaagaagaagcagcggtccggggtcctctgggacacccccagcccgcccgaggtggagcgcgccgtgctggacgacggcatctaccggatcatgcagcgcggcctgctggggcggtcccaggtcggcgtgggggtgttccaggagaacgtcttccacaccatgtggcacgtgacgcgcggcgcggtgctcatgtaccaggggaagcggctggagcccagctgggcctccgtcaagaaggacctgatcagctacggcggcgggtggcgcctccagggctcctggaacaccggggaggaggtccaggtgatcgccgtcgagcccggcaagaaccccaagaacgtgcagaccgcccccgggaccttcaagacgcccgagggcgaggtgggcgccatcgcgctggacttcaagcccgggaccagcggctcccccatcgtcaaccgggaggggaagatcgtgggcctgtacggcaacggggtggtcaccaccagcggcacgtacgtgagcgccatcgcccaggccaaggcgtcccaggaggggccgctccccgagatcgaggacgaggtgttccgcaagcggaacctgaccatcatggacctgcaccccggcagcgggaagacccgccggtacctcccggccatcgtccgcgaggccatcaagcgcaagctgcggaccctgatcctcgcccccacgcgcgtggtggcctccgagatggcggaggccctgaagggcatgcccatccggtaccagaccaccgccgtcaagagcgagcacaccggcaaggagatcgtggacctgatgtgccacgccacgttcaccatgcgcctcctgtcccccgtgcgggtcccgaactacaacatgatcatcatggacgaggcccacttcaccgaccccagctccatcgcggcccgcgggtacatcagcacccgggtgggcatgggggaggccgccgccatcttcatgacggcgacgccgcccggctccgtggaggccttcccgcagagcaacgccgtcatccaggacgaggagcgcgacatccccgagcggtcctggaacagcgggtacgagtggatcaccgacttccccggcaagaccgtgtggttcgtgccctccatcaagagcggcaacgacatcgccaactgcctgcgcaagaacgggaagcgggtcatccagctctcccgcaagacgttcgacaccgagtaccagaagaccaagaacaacgactgggactacgtggtgaccacggacatcagcgagatgggcgcgaacttccgggccgaccgcgtcatcgacccgcggcgctgcctgaagcccgtgatcctgaaggacgggcccgagcgggtgatcctcgccggccccatgccggtcaccgtggcctccgccgcgcagcgccgggggcgcatcggccgcaaccacaacaaggagggcgaccagtacatctacatggggcagcccctgaacaacgacgaggaccacgcccactggaccgaggccaagatgctgctcgacaacatcaacacccccgagggcatcatccccgccctgttcgagccggagcgggagaagtccgccgcgatcgacggggagtaccgcctgcggggcgaggcccgcaagacgttcgtcgagctcatgcggcgcggggacctgcccgtgtggctgtcctacaaggtggccagcgagggcttccagtacagcgaccggcgctggtgcttcgacggcgagcggaacaaccaggtcctcgaggagaacatggacgtggagatctggaccaaggagggggagcgcaagaagctgcggccccgctggctggacgcccggacctactccgaccccctcgccctgcgcgagttcaaggagttcgcggccggccggcgcagcgtgtccggggacctgatcctcgagatcggcaagctgccgcagcacctgacccagcgggcccagaacgccctcgacaacctggtcatgctgcacaacagcgagcagggcgggcgcgcgtaccggcacgccatggaggagctccccgacacgatcgagaccctgatgctgctcgccctgatcgccgtgctgaccggcggggtgaccctcttcttcctgtccggccgcgggctgggcaagaccagcatcggcctcctgtgcgtcatggcctccagcgtgctgctctggatggcgtccgtggagccccactggatcgccgccagcatcatcctggagttcttcctgatggtcctcctgatccccgagccggaccggcagcgcacgccccaggacaaccagctggcctacgtggtgatcgggctcctgttcatgatcctgaccgtcgccgcgaacgagatgggcctcctggagaccaccaagaaggacctggggatcggccacgtggccgtggagaaccaccaccacgccgccatgctcgacgtcgacctgcaccccgcctccgcgtggacgctgtacgccgtggccaccaccatcatcaccccgatgatgcgccacacgatcgagaacaccaccgccaacatcagcctcaccgccatcgcgaaccaggccgccatcctgatggggctggacaagggctggcccatctccaagatggacatcggcgtgcccctcctggccctggggtgctacagccaggtcaaccccctcacgctgaccgcggccgtgctgatgctcgtggcccactacgccatcatcggcccggggctgcaggccaaggcgacccgggaggcccagaagcgcaccgccgccggcatcatgaagaaccccacggtcgacgggatcgtggccatcgacctggaccccgtggtctacgacgcgaagttcgagaagcagctcggccagatcatgctgctgatcctctgcacctcccagatcctgctgatgcggaccacctgggccctctgcgagagcatcacgctggccaccggccccctgaccaccctctgggaggggtccccgggcaagttctggaacacgaccatcgccgtgagcatggccaacatcttccgcgggtcctacctggcgggcgccggcctggccttcagcctcatgaagtccctcgggggcgggcggcgcgggaccggggcccagggcgagaccctgggcgagaagtggaagcggcagctcaaccagctgtccaagagcgagttcaacacgtacaagcgctccgggatcatggaggtggaccggagcgaggcgaaggagggcctgaagcgcggggagaccaccaagcacgccgtctcccggggcaccgccaagctccgctggttcgtggagcggaacctggtgaagcccgaggggaaggtcatcgacctgggctgcggccgcgggggctggagctactactgcgccgggctgaagaaggtgacggaggtgaagggctacaccaagggcgggcccggccacgaggagcccatcccgatggccacctacgggtggaacctcgtcaagctgcactccggcaaggacgtgttcttcatcccgcccgagaagtgcgacaccctgctctgcgacatcggggagagctcccccaacccgacgatcgaggagggccggaccctgcgcgtgctgaagatggtcgagccctggctccgggggaaccagttctgcatcaagatcctgaacccctacatgcccagcgtggtggagaccctggagcagatgcagcgcaagcacggcggcatgctcgtccggaacccgctgtcccgcaacagcacccacgagatgtactgggtgtcctgcgggaccggcaacatcgtgagcgcggtcaacatgacgtcccgcatgctgctcaaccggttcaccatggcccaccgcaagcccacctacgagcgggacgtggacctgggggccggcacccgccacgtggccgtcgagcccgaggtggccaacctggacatcatcggccagcggatcgagaacatcaagcacgagcacaagagcacgtggcactacgacgaggacaacccctacaagacctgggcgtaccacgggtcctacgaggtgaagccgagcggctccgccagcagcatggtcaacggggtggtcaagctcctgaccaagccctgggacgtgatccccatggtgacccagatcgccatgacggacaccacccccttcggccagcagcgcgtcttcaaggagaaggtggacacccggacgccgaaggccaagcgcgggaccgcccagatcatggaggtgaccgcgaagtggctgtggggcttcctcgcccggaacaagaagccccgcatctgcacccgggaggagttcacgcgcaaggtccggtccaacgccgccatcggcgcggtgttcgtggacgagaaccagtggaacagcgccaaggaggccgtcgaggacgagcgcttctgggacctggtgcaccgggagcgcgagctgcacaagcaggggaagtgcgcgacctgcgtgtacaacatgatgggcaagcgggagaagaagctcggggagttcggcaaggccaaggggtcccgcgcgatctggtacatgtggctgggcgcccggttcctggagttcgaggccctcggcttcatgaacgaggaccactggttcagccgcgagaactccctgagcggggtcgagggcgaggggctgcacaagctcggctacatcctgcgggacatctccaagatccccgggggcaacatgtacgccgacgacaccgccggctgggacacccgcatcacggaggacgacctgcagaacgaggcgcgcatcaccgacatcatggagccggagcacgccctcctggccaagagcatcttcaagctgacctaccagaacaaggtggtgcgggtccagcgccccgccaagaacgggaccgtgatggacgtgatctcccggcgcgaccagcggggcagcgggcaggtcggcacgtacggcctcaacaccttcaccaacatggaggcccagctgatccgccagatggagtccgaggggatcttcagcccctccgagctggagacccccaacctcgcggagcgggtgctggactggctggagaagtacggcgtggagcgcctcaagcggatggccatcagcggggacgactgcgtcgtgaagccgatcgacgaccgcttcgccacggccctgaccgccctgaacgacatgggcaaggtgcggaaggacatcccccagtgggagccctccaaggggtggaacgactggcagcaggtccccttctgcagccaccacttccaccagctcatcatgaaggacggccgcgagatcgtggtgccgtgccggaaccaggacgagctggtcggccgcgcgcgggtgtcccagggggccggctggagcctgcgcgagaccgcctgcctcggcaagagctacgcccagatgtggcagctgatgtacttccaccggcgcgacctgcggctcgcggccaacgccatctgctccgccgtgcccgtcgactggatccccaccagccgcacgacctggtccatccacgcccaccaccagtggatgaccaccgaggacatgctgagcgtgtggaaccgcgtgtggatcgaggagaacccctggatggaggacaagacgcacatctccagctggggcgacgtcccgtacctggggaagcgggaggaccagtggtgcggctccctcatcggcctgaccgcgcgcgccacctgggccaccaacatccaggtggccatcaaccaggtgcggcgcctgatcgggaacgagaactacctcgactacatgaccagcatgaagcggttcaagaacgagtccgaccccgagggcgccctgtggtga

SEQ ID NO: 8301 - RNA, 9879 nt, synthetic construct
  misc_feature 1..9879: note = derived and/or modified CDS sequence (opt1) from DENV-1__EU677140__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtcacctacgggacctgcagccagacgggcgagcaccggcgggacaagcggtccgtggccctcgcgccccacgtgggcctggggctggagacccgcaccgagacctggatgagctccgagggcgcctggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcatcatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtggggaagctggtccaccagatcttcggcaccgcctacggggtgctgttctccggcgtgagctggacgatgaagatcgggatcggcgtcctgctgacctggctcggcctgaactcccgcagcacctccctgagcatgacctgcatcgccgtggggctcgtgacgctgtacctgggcgtcatggtgcaggccgactccgggtgcgtgatcaactggaagggccgggagctcaagtgcgggagcggcatcttcgtcaccaacgaggtgcacacctggaccgagcagtacaagttccaggccgacagcccgaagcgcctgtccgcggccatcggcaaggcctgggaggagggggtgtgcggcatccggagcgccacccgcctggagaacatcatgtggaagcagatctccaacgagctcaaccacatcctgctggagaacgacatgaagttcacggtcgtggtgggggacgtcgccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctgaagctgcgggacagccacacccaggtctgcgaccaccgcctcatgtccgcggccatcaaggacagcaaggccgtgcacgccgacatgggctactggatcgagtccgagaagaacgagacctggaagctggcccgggcgagcttcatcgaggtgaagacgtgcatctggcccaagtcccacaccctgtggagcaacggcgtcctcgagtccgagatgatcatccccaagatctacgggggcccgatcagccagcacaactaccgccccgggtacttcacccagaccgccggcccctggcacctggggaagctggagctcgacttcgacctgtgcgagggcacgaccgtggtggtcgacgagcactgcggcaaccgggggccgtccctgcgcaccaccacggtgaccggcaagatcatccacgagtggtgctgccggagctgcaccctgccgcccctccgcttccgcggggaggacggctgctggtacgggatggagatccgccccgtgaaggagaaggaggagaacctggtcaagtccatggtgagcgccggcagcggcgaggtggactccttcagcctcgggctgctgtgcatctccatcatgatcgaggaggtcatgcggagccgctggtcccggaagatgctcatgaccggcacgctggccgtgttcttcctgctcatcatggggcagctgacctggaacgacctgatccgcctctgcatcatggtgggcgccaacgcgagcgaccgcatggggatgggcaccacctacctggccctgatggccacgttcaagatgcggccgatgttcgccgtcggcctcctgttccgccggctgacctcccgcgaggtgctcctgctgaccatcgggctcagcctggtggcctccgtcgagctgcccaacagcctcgaggagctgggcgacgggctggcgatgggcatcatgatcctcaagctgctgaccgacttccagtcccaccagctctgggccacgctgctgagcctcaccttcatcaagaccaccttctccctgcactacgcctggaagacgatggccatggtgctgagcatcgtctccctcttccccctgtgcctgagcaccacctcccagaagaccacgtggctccccgtgctgctgggcagcctcgggtgcaagccgctgaccatgttcctgatcgcggagaacaagatctggggccggcgctcctggcccctcaacgaggggatcatggccgtgggcatcgtcagcatcctgctgagctccctcctgaagaacgacgtgcccctggccgggcccctcatcgccggcggcatgctgatcgcctgctacgtgatcagcgggtccagcgcggacctgtccctcgagaaggccgccgaggtcagctgggaggaggaggccgagcactccggcgccagccacaacatcctggtggaggtgcaggacgacgggaccatgaagatcaaggacgaggagcgggacgacaccctgaccatcctcctgaaggcgacgctgctcgccgtctccggcgtgtacccgctgagcatccccgccaccctgttcgtgtggtacttctggcagaagaagaagcagcgctccggggtcctctgggacacccccagcccgcccgaggtggagcgggccgtgctggacgacggcatctaccgcatcatgcagcggggcctgctggggcgctcccaggtcggcgtgggggtgttccaggagaacgtcttccacaccatgtggcacgtgacgcggggcgccgtgctcatgtaccaggggaagcgcctggagcccagctgggcgtccgtcaagaaggacctgatcagctacggcggcgggtggcggctccagggctcctggaacaccggggaggaggtccaggtgatcgccgtcgagcccggcaagaaccccaagaacgtgcagaccgcccccgggaccttcaagacgcccgagggcgaggtgggcgccatcgccctggacttcaagcccgggaccagcggctcccccatcgtcaaccgcgaggggaagatcgtgggcctgtacggcaacggggtggtcaccaccagcggcacgtacgtgagcgcgatcgcccaggccaaggcctcccaggaggggccgctccccgagatcgaggacgaggtgttccggaagcgcaacctgaccatcatggacctgcaccccggcagcgggaagacccggcgctacctcccggcgatcgtccgggaggccatcaagcgcaagctgcgcaccctgatcctcgcccccacgcgggtggtggcctccgagatggccgaggcgctgaagggcatgcccatccgctaccagaccaccgccgtcaagagcgagcacaccggcaaggagatcgtggacctgatgtgccacgccacgttcaccatgcggctcctgtcccccgtgcgcgtcccgaactacaacatgatcatcatggacgaggcccacttcaccgaccccagctccatcgccgcgcgggggtacatcagcacccgcgtgggcatgggggaggccgccgccatcttcatgacggccacgccgcccggctccgtggaggcgttcccgcagagcaacgccgtcatccaggacgaggagcgggacatccccgagcgctcctggaacagcgggtacgagtggatcaccgacttccccggcaagaccgtgtggttcgtgccctccatcaagagcggcaacgacatcgccaactgcctgcggaagaacgggaagcgcgtcatccagctctcccggaagacgttcgacaccgagtaccagaagaccaagaacaacgactgggactacgtggtgaccacggacatcagcgagatgggcgccaacttccgcgcggaccgggtcatcgacccgcgccggtgcctgaagcccgtgatcctgaaggacgggcccgagcgcgtgatcctcgccggccccatgccggtcaccgtggcctccgccgcccagcggcgcgggcggatcggccgcaaccacaacaaggagggcgaccagtacatctacatggggcagcccctgaacaacgacgaggaccacgcgcactggaccgaggccaagatgctgctcgacaacatcaacacccccgagggcatcatccccgccctgttcgagccggagcgcgagaagtccgccgccatcgacggggagtaccggctgcgcggcgaggcgcggaagacgttcgtcgagctcatgcgccgcggggacctgcccgtgtggctgtcctacaaggtggccagcgagggcttccagtacagcgaccgccggtggtgcttcgacggcgagcgcaacaaccaggtcctcgaggagaacatggacgtggagatctggaccaaggagggggagcggaagaagctgcgcccccggtggctggacgcccgcacctactccgaccccctcgccctgcgggagttcaaggagttcgccgcgggccgccggagcgtgtccggggacctgatcctcgagatcggcaagctgccgcagcacctgacccagcgcgcccagaacgccctcgacaacctggtcatgctgcacaacagcgagcagggcgggcgggcctaccgccacgcgatggaggagctccccgacacgatcgagaccctgatgctgctcgccctgatcgccgtgctgaccggcggggtgaccctcttcttcctgtccggccgggggctgggcaagaccagcatcggcctcctgtgcgtcatggcctccagcgtgctgctctggatggcctccgtggagccccactggatcgcggccagcatcatcctggagttcttcctgatggtcctcctgatccccgagccggaccgccagcggacgccccaggacaaccagctggcctacgtggtgatcgggctcctgttcatgatcctgaccgtcgccgccaacgagatgggcctcctggagaccaccaagaaggacctggggatcggccacgtggcggtggagaaccaccaccacgccgccatgctcgacgtcgacctgcaccccgcctccgcctggacgctgtacgcggtggccaccaccatcatcaccccgatgatgcgccacacgatcgagaacaccaccgccaacatcagcctcaccgccatcgccaaccaggcggccatcctgatggggctggacaagggctggcccatctccaagatggacatcggcgtgcccctcctggccctggggtgctacagccaggtcaaccccctcacgctgaccgccgcggtgctgatgctcgtggcccactacgccatcatcggcccggggctgcaggccaaggccacccgcgaggcgcagaagcggaccgccgccggcatcatgaagaaccccacggtcgacgggatcgtggccatcgacctggaccccgtggtctacgacgccaagttcgagaagcagctcggccagatcatgctgctgatcctctgcacctcccagatcctgctgatgcgcaccacctgggcgctctgcgagagcatcacgctggccaccggccccctgaccaccctctgggaggggtccccgggcaagttctggaacacgaccatcgccgtgagcatggccaacatcttccgggggtcctacctggccggcgcgggcctggccttcagcctcatgaagtccctcgggggcgggcgccgggggaccggggcccagggcgagaccctgggcgagaagtggaagcgccagctcaaccagctgtccaagagcgagttcaacacgtacaagcggtccgggatcatggaggtggaccgcagcgaggccaaggagggcctgaagcgcggggagaccaccaagcacgcggtctcccgcggcaccgccaagctccggtggttcgtggagcgcaacctggtgaagcccgaggggaaggtcatcgacctgggctgcggccgcgggggctggagctactactgcgccgggctgaagaaggtgacggaggtgaagggctacaccaagggcggccccggccacgaggagcccatcccgatggccacctacgggtggaacctcgtcaagctgcactccggcaaggacgtgttcttcatcccgcccgagaagtgcgacaccctgctctgcgacatcggggagagctcccccaacccgacgatcgaggagggccgcaccctgcgggtgctgaagatggtcgagccctggctccgcgggaaccagttctgcatcaagatcctgaacccctacatgcccagcgtggtggagaccctggagcagatgcagcggaagcacggcggcatgctcgtccgcaacccgctgtcccggaacagcacccacgagatgtactgggtgtcctgcgggaccggcaacatcgtgagcgccgtcaacatgacgtcccgcatgctgctcaaccgcttcaccatggcgcaccggaagcccacctacgagcgcgacgtggacctgggggccggcacccggcacgtggccgtcgagcccgaggtggccaacctggacatcatcggccagcgcatcgagaacatcaagcacgagcacaagagcacgtggcactacgacgaggacaacccctacaagacctgggcctaccacgggtcctacgaggtgaagccgagcggctccgcgagcagcatggtcaacggggtggtcaagctcctgaccaagccctgggacgtgatccccatggtgacccagatcgccatgacggacaccacccccttcggccagcagcgggtcttcaaggagaaggtggacacccgcacgccgaaggccaagcgggggaccgcccagatcatggaggtgaccgccaagtggctgtggggcttcctctcccgcaacaagaagccccggatctgcacccgcgaggagttcacgcggaaggtccgcagcaacgcggccatcggcgccgtgttcgtggacgagaaccagtggaactccgccaaggaggcggtcgaggacgagcggttctgggacctggtgcaccgcgagcgggagctgcacaagcaggggaagtgcgcgacctgcgtgtacaacatgatgggcaagcgcgagaagaagctcggggagttcggcaaggccaaggggagccgggccatctggtacatgtggctgggcgcccgcttcctggagttcgaggcgctcggcttcatgaacgaggaccactggttctcccgggagaacagcctgtccggggtcgagggcgaggggctgcacaagctcggctacatcctgcgcgacatcagcaagatccccgggggcaacatgtacgccgacgacaccgccggctgggacacccggatcacggaggacgacctgcagaacgaggcccgcatcaccgacatcatggagccggagcacgccctcctggcgaagtccatcttcaagctgacctaccagaacaaggtggtgcgcgtccagcggcccgccaagaacgggaccgtgatggacgtgatcagccgccgggaccagcgcggctccgggcaggtcggcacgtacggcctcaacaccttcaccaacatggaggcccagctgatccggcagatggagagcgaggggatcttctcccccagcgagctggagacccccaacctcgccgagcgcgtgctggactggctgaagaagtacggcgtggagcggctcaagcgcatggccatctccggggacgactgcgtcgtgaagccgatcgacgaccggttcgcgacggccctgaccgccctgaacgacatgggcaaggtgcgcaaggacatcccccagtgggagcccagcaaggggtggaacgactggcagcaggtccccttctgctcccaccacttccaccagctcatcatgaaggacggccgggagatcgtggtgccgtgccgcaaccaggacgagctggtcggccgggcccgcgtgagccagggggccggctggagcctgcgggagaccgcgtgcctcgggaagtcctacgcccagatgtggcagctgatgtacttccaccgccgggacctgcgcctcgccgccaacgcgatctgcagcgccgtgcccgtcgactggatccccacctcccggacgacctggagcatccacgcccaccaccagtggatgaccaccgaggacatgctgtccgtgtggaaccgcgtgtggatcgaggagaacccctggatggaggacaagacgcacatcagctcctggggcgacgtcccgtacctggggaagcgcgaggaccagtggtgcggcagcctcatcggcctgaccgcccgggccacctgggcgaccaacatccaggtggccatcaaccaggtgcgccggctgatcgggaacgagaactacctcgactacatgacctccatgaagcgcttcaagaacgagggcgaccccgagggggccctgtggtga

SEQ ID NO: 8302 - RNA, 9879 nt, synthetic construct
  misc_feature 1..9879: note = derived and/or modified CDS sequence (opt1) from DENV-1__EU677166__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgggacaagcggtccgtggccctcgcgccccacgtgggcctggggctggagacccgcaccgagacctggatgagctccgagggcgcctggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtcgggaagctggtgcaccagatcttcggcaccgcctacggggtgctgttctccggcgtcagctggacgatgaagatcgggatcggcgtgctgctgacctggctcggcctgaactcccgcagcacctccctgagcatgacctgcatcgccgtggggctcgtcacgctgtacctgggcgtgatggtgcaggccgactccgggtgcgtcatcaactggaagggccgggagctcaagtgcgggagcggcatcttcgtgaccaacgaggtgcacacctggaccgagcagtacaagttccaggccgacagcccgaagcgcctgtccgcggccatcggcaaggcctgggaggagggggtctgcggcatccggagcgccacccgcctggagaacatcatgtggaagcagatctccaacgagctcaaccacatcctgctggagaacgacatgaagttcacggtggtggtcggggacgtggccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtcgaggactacggcttcgggatcttcacgaccaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacgtgcatctggcccaagtcccacaccctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcacgaccgtggtcgtggacgagcactgcggcaaccgggggccgtccctgcgcaccaccacggtgaccggcaagatcatccacgagtggtgctgccggagctgcaccctgccgcccctccgcttccgcggggaggacggctgctggtacgggatggagatccgccccgtcaaggagaaggaggagaacctggtgaagtccatggtgagcgccggcagcggcgaggtcgactccttcagcctcgggctgctgtgcatctccatcatgatcgaggaggtgatgcggagccgctggtcccggaagatgctcatgaccggcacgctggccgtgttcttcctgctcatcatggggcagctgacctggaacgacctgatccgcctctgcatcatggtcggcgccaacgcgagcgaccgcatggggatgggcaccacctacctggccctgatggccacgttcaagatgcggccgatgttcgccgtgggcctcctgttccgccggctgacctcccgcgaggtgctcctgctgaccatcgggctcagcctggtcgcctccgtggagctgcccaacagcctcgaggagctgggcgacgggctggcgatgggcatcatgatcctcaagctgctgaccgacttccagtcccaccagctctgggccacgctgctgagcctcaccttcatcaagaccaccttctccctgcactacgcctggaagacgatggccatggtcctgagcatcgtgtccctcttccccctgtgcctgagcaccacctcccagaagaccacgtggctccccgtgctgctgggcagcctcgggtgcaagccgctgaccatgttcctgatcgcggagaacaagatctggggccggcgctcctggcccctcaacgaggggatcatggccgtcggcatcgtgagcatcctgctgagctccctcctgaagaacgacgtgcccctggccgggcccctcatcgccggcggcatgctgatcgcctgctacgtcatcagcgggtccagcgcggacctgtccctcgagaaggccgccgaggtgagctgggaggaggaggccgagcactccggcgccagccacaacatcctggtggaggtccaggacgacgggaccatgaagatcaaggacgaggagcgggacgacaccctgaccatcctcctgaaggcgacgctgctcgccgtgtccggcgtgtacccgctgagcatccccgccaccctgttcgtctggtacttctggcagaagaagaagcagcgctccggggtgctctgggacacccccagcccgcccgaggtggagcgggccgtcctggacgacggcatctaccgcatcatgcagcggggcctgctggggcgctcccaggtgggcgtgggggtcttccaggagaacgtgttccacaccatgtggcacgtgacgcggggcgccgtcctcatgtaccaggggaagcgcctggagcccagctgggcgtccgtgaagaaggacctgatcagctacggcggcgggtggcggctccagggctcctggaacaccggggaggaggtgcaggtcatcgccgtggagcccggcaagaaccccaagaacgtgcagaccgcccccgggaccttcaagacgcccgagggcgaggtcggcgccatcgccctggacttcaagcccgggaccagcggctcccccatcgtgaaccgcgaggggaagatcgtgggcctgtacggcaacggggtcgtgaccaccagcggcacgtacgtgagcgcgatcgcccaggccaaggcctcccaggaggggccgctccccgagatcgaggacgaggtcttccggaagcgcaacctgaccatcatggacctgcaccccggcagcgggaagacccggcgctacctcccggcgatcgtgcgggaggccatcaagcgcaagctgcgcaccctgatcctcgcccccacgcgggtggtcgcctccgagatggccgaggcgctgaagggcatgcccatccgctaccagaccaccgccgtcaagagcgagcacaccggcaaggagatcgtggacctgatgtgccacgccacgttcaccatgcggctcctgtcccccgtccgcgtgccgaactacaacatgatcatcatggacgaggcccacttcaccgaccccagctccatcgccgcgcgggggtacatcagcacccgcgtgggcatgggggaggccgccgccatcttcatgacggccacgccgcccggctccgtcgaggcgttcccgcagagcaacgccgtgatccaggacgaggagcgggacatccccgagcgctcctggaacagcgggtacgagtggatcaccgacttccccggcaagaccgtgtggttcgtcccctccatcaagagcggcaacgacatcgccaactgcctgcggaagaacgggaagcgcgtgatccagctctcccggaagacgttcgacaccgagtaccagaagaccaagaacaacgactgggactacgtggtcaccacggacatcagcgagatgggcgccaacttccgcgcggaccgggtgatcgacccgcgccggtgcctgaagcccgtgatcctgaaggacgggcccgagcgcgtcatcctcgccggccccatgccggtgaccgtcgcctccgccgcccagcggcgcgggcggatcggccgcaaccacaacaaggagggcgaccagtacatctacatggggcagcccctgaacaacgacgaggaccacgcgcactggaccgaggccaagatgctgctcgacaacatcaacacccccgagggcatcatccccgccctgttcgagccggagcgcgagaagtccgccgccatcgacggggagtaccggctgcgcggcgaggcgcggaagacgttcgtggagctcatgcgccgcggggacctgcccgtgtggctgtcctacaaggtcgccagcgagggcttccagtacagcgaccgccggtggtgcttcgacggcgagcgcaacaaccaggtgctcgaggagaacatggacgtggagatctggaccaaggagggggagcggaagaagctgcgcccccggtggctggacgcccgcacctactccgaccccctcgccctgcgggagttcaaggagttcgccgcgggccgccggagcgtctccggggacctgatcctcgagatcggcaagctgccgcagcacctgacccagcgcgcccagaacgccctcgacaacctggtgatgctgcacaacagcgagcagggcgggcgggcctaccgccacgcgatggaggagctccccgacacgatcgagaccctgatgctgctcgccctgatcgccgtgctgaccggcggggtcaccctcttcttcctgtccggccgggggctgggcaagaccagcatcggcctcctgtgcgtgatggcctccagcgtgctgctctggatggcctccgtcgagccccactggatcgcggccagcatcatcctggagttcttcctgatggtgctcctgatccccgagccggaccgccagcggacgccccaggacaaccagctggcctacgtggtcatcgggctcctgttcatgatcctgaccgtggccgccaacgagatgggcctcctggagaccaccaagaaggacctggggatcggccacgtggcggtcgagaaccaccaccacgccgccatgctcgacgtggacctgcaccccgcctccgcctggacgctgtacgcggtggccaccaccatcatcaccccgatgatgcgccacacgatcgagaacaccaccgccaacatcagcctcaccgccatcgccaaccaggcggccatcctgatggggctggacaagggctggcccatctccaagatggacatcggcgtccccctcctggccctggggtgctacagccaggtgaaccccctcacgctgaccgccgcggtgctgatgctcgtcgcccactacgccatcatcggcccggggctgcaggccaaggccacccgcgaggcgcagaagcggaccgccgccggcatcatgaagaaccccacggtggacgggatcgtggccatcgacctggaccccgtcgtgtacgacgccaagttcgagaagcagctcggccagatcatgctgctgatcctctgcacctcccagatcctgctgatgcgcaccacctgggcgctctgcgagagcatcacgctggccaccggccccctgaccaccctctgggaggggtccccgggcaagttctggaacacgaccatcgccgtgagcatggccaacatcttccgggggtcctacctggccggcgcgggcctggccttcagcctcatgaagtccctcgggggcgggcgccgggggaccggggcccagggcgagaccctgggcgagaagtggaagcgccagctcaaccagctgtccaagagcgagttcaacacgtacaagcggtccgggatcatggaggtcgaccgcagcgaggccaaggagggcctgaagcgcggggagaccaccaagcacgcggtgtcccgcggcaccgccaagctccggtggttcgtggagcgcaacctggtcaagcccgaggggaaggtgatcgacctgggctgcggccgcgggggctggagctactactgcgccgggctgaagaaggtgacggaggtcaagggctacaccaagggcggccccggccacgaggagcccatcccgatggccacctacgggtggaacctcgtgaagctgcactccggcaaggacgtgttcttcatcccgcccgagaagtgcgacaccctgctctgcgacatcggggagagctcccccaacccgacgatcgaggagggccgcaccctgcgggtcctgaagatggtggagccctggctccgcgggaaccagttctgcatcaagatcctgaacccctacatgcccagcgtggtcgagaccctggagcagatgcagcggaagcacggcggcatgctcgtgcgcaacccgctgtcccggaacagcacccacgagatgtactgggtgtcctgcgggaccggcaacatcgtcagcgccgtgaacatgacgtcccgcatgctgctcaaccgcttcaccatggcgcaccggaagcccacctacgagcgcgacgtggacctgggggccggcacccggcacgtcgccgtggagcccgaggtggccaacctggacatcatcggccagcgcatcgagaacatcaagcacgagcacaagagcacgtggcactacgacgaggacaacccctacaagacctgggcctaccacgggtcctacgaggtcaagccgagcggctccgcgagcagcatggtgaacggggtcgtgaagctcctgaccaagccctgggacgtgatccccatggtcacccagatcgccatgacggacaccacccccttcggccagcagcgggtgttcaaggagaaggtggacacccgcacgccgaaggccaagcgggggaccgcccagatcatggaggtcaccgccaagtggctgtggggcttcctctcccgcaacaagaagccccggatctgcacccgcgaggagttcacgcggaaggtgcgcagcaacgcggccatcggcgccgtgttcgtcgacgagaaccagtggaactccgccaaggaggcggtggaggacgagcggttctgggacctggtgcaccgcgagcgggagctgcacaagcaggggaagtgcgcgacctgcgtctacaacatgatgggcaagcgcgagaagaagctcggggagttcggcaaggccaaggggagccgggccatctggtacatgtggctgggcgcccgcttcctggagttcgaggcgctcggcttcatgaacgaggaccactggttctcccgggagaacagcctgtccggggtggagggcgaggggctgcacaagctcggctacatcctgcgcgacatcagcaagatccccgggggcaacatgtacgccgacgacaccgccggctgggacacccggatcacggaggacgacctgcagaacgaggcccgcatcaccgacatcatggagccggagcacgccctcctggcgcgctccatcttcaagctgacctaccagaacaaggtggtccgggtgcagcgccccgccaagaacgggaccgtgatggacgtcatcagccggcgcgaccagcggggctccggccaggtggggacgtacggcctcaacaccttcaccaacatggaggcccagctgatccgccagatggagagcgaggggatcttctcccccagcgagctggagacccccaacctcgccgagcgggtgctggactggctggagaagtacggcgtcgagcgcctcaagcggatggccatctccggggacgactgcgtggtgaagccgatcgacgaccgcttcgcgacggccctgaccgccctgaacgacatgggcaaggtccggaaggacatcccccagtgggagcccagcaaggggtggaacgactggcagcaggtccccttctgctcccaccacttccaccagctcatcatgaaggacggccgcgagatcgtggtcccgtgccggaaccaggacgagctggtgggccgcgcccgggtgagccagggggccggctggagcctgcgcgagaccgcgtgcctcgggaagtcctacgcccagatgtggcagctgatgtacttccaccggcgcgacctgcggctcgccgccaacgcgatctgcagcgccgtccccgtgaactggatccccacctcccgcacgacctggagcatccacgcccaccaccagtggatgaccaccgaggacatgctgtccgtgtggaaccgcgtctggatcgaggagaacccctggatggaggacaagacgcacatcagctcctggggcgacgtgccgtacctggggaagcgggaggaccagtggtgcggcagcctcatcggcctgaccgcccgcgccacctgggcgaccaacatccaggtggccatcaaccaggtccggcgcctgatcgggaacgagaactacctcgactacatgacctccatgaagcggttcaagaacgagagcgaccccgagggcgccctgtggtga

SEQ ID NO: 8303 - RNA, 9879 nt, synthetic construct
  misc_feature 1..9879: note = derived and/or modified CDS sequence (opt1) from DENV-1__EU677170__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgggacaagcggtccgtggccctcgcgccccacgtgggcctggggctggagacccgcaccgagacctggatgagctccgagggcgcctggaagcagatccagcgggtggagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtcgggaagctggtgcaccagatcttcggcaccgcctacggggtcctgttctccggcgtcagctggacgatgaagatcgggatcggcgtgctgctgacctggctcggcctgaactcccgcagcacctccctgagcatgacctgcatcgccgtggggctcgtcacgctgtacctgggcgtgatggtgcaggccgactccgggtgcgtcatcaactggaagggccgggagctcaagtgcgggagcggcatcttcgtgaccaacgaggtgcacacctggaccgagcagtacaagttccaggccgacagcccgaagcgcctgtccgcggccatcggcaaggcctgggaggagggggtctgcggcatccggagcgccacccgcctggagaacatcatgtggaagcagatctccaacgagctcaaccacatcctgctggagaacgacatgaagttcacggtggtggtcggggacgtggccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtcgaggactacggcttcgggatcttcacgaccaacatctggatgaagctgcgggacagctacacccaggtgtgcgaccaccgcctgatgtccgcggccatcaaggacagcaaggccgtgcacgccgacatgggctactggatcgagtccgagaagaacgagacctggaagctcgcccgggcgagcttcatcgaggtcaagacgtgcatctggcccaagtcccacaccctgtggagcaacggcgtgctggagtccgagatgatcatccccaagatctacgggggcccgatcagccagcacaactaccgccccgggtacttcacccagaccgccggcccctggcacctcgggaagctggagctggacttcgacctctgcgagggcacgaccgtggtcgtggacgagcactgcggcaaccgggggccgtccctgcgcaccaccacggtgaccggcaagatcatccacgagtggtgctgccggagctgcaccctgccgcccctgcgcttccgcggggaggacggctgctggtacgggatggagatccgccccgtcaaggagaaggaggagaacctggtgaagtccatggtgagcgccggcagcggcgaggtcgactccttcagcctggggctcctgtgcatctccatcatgatcgaggaggtgatgcggagccgctggtcccggaagatgctgatgaccggcacgctcgccgtgttcttcctgctgatcatggggcagctcacctggaacgacctgatccgcctgtgcatcatggtcggcgccaacgcgagcgaccgcatggggatgggcaccacctacctcgccctgatggccacgttcaagatgcggccgatgttcgccgtgggcctcctcttccgccggctgacctcccgcgaggtgctgctcctgaccatcgggctgagcctcgtcgcctccgtggagctgcccaacagcctggaggagctcggcgacgggctggcgatgggcatcatgatcctgaagctcctgaccgacttccagtcccaccagctgtgggccacgctcctgagcctgaccttcatcaagaccaccttctccctccactacgcctggaagacgatggccatggtcctgagcatcgtgtccctgttccccctctgcctgagcaccacctcccagaagaccacgtggctgcccgtgctcctgggcagcctggggtgcaagccgctcaccatgttcctgatcgcggagaacaagatctggggccggcgctcctggcccctgaacgaggggatcatggccgtcggcatcgtgagcatcctcctgagctccctgctcaagaacgacgtgcccctggccgggcccctgatcgccggcggcatgctcatcgcctgctacgtcatcagcgggtccagcgcggacctgtccctggagaaggccgccgaggtgagctgggaggaggaggccgagcactccggcgccagccacaacatcctcgtggaggtccaggacgacgggaccatgaagatcaaggacgaggagcgggacgacaccctgaccatcctgctcaaggcgacgctgctggccgtgtccggcgtgtacccgctcagcatccccgccaccctgttcgtctggtacttctggcagaagaagaagcagcgctccggggtgctgtgggacacccccagcccgcccgaggtggagcgggccgtcctcgacgacggcatctaccgcatcatgcagcggggcctgctggggcgctcccaggtgggcgtgggggtcttccaggagaacgtgttccacaccatgtggcacgtgacgcggggcgccgtcctgatgtaccaggggaagcgcctcgagcccagctgggcgtccgtgaagaaggacctgatcagctacggcggcgggtggcggctgcagggctcctggaacaccggggaggaggtgcaggtcatcgccgtggagcccggcaagaaccccaagaacgtgcagaccgcccccgggaccttcaagacgcccgagggcgaggtcggcgccatcgccctcgacttcaagcccgggaccagcggctcccccatcgtgaaccgcgaggggaagatcgtgggcctgtacggcaacggggtcgtgaccaccagcggcacgtacgtgagcgcgatcgcccaggccaaggcctcccaggaggggccgctgcccgagatcgaggacgaggtcttccggaagcgcaacctcaccatcatggacctgcaccccggcagcgggaagacccggcgctacctgccggcgatcgtgcgggaggccatcaagcgcaagctccgcaccctgatcctggcccccacgcgggtggtcgcctccgagatggccgaggcgctcaagggcatgcccatccgctaccagaccaccgccgtcaagagcgagcacaccggcaaggagatcgtggacctgatgtgccacgccacgttcaccatgcggctgctctcccccgtccgcgtgccgaactacaacatgatcatcatggacgaggcccacttcaccgaccccagctccatcgccgcgcgggggtacatcagcacccgcgtgggcatgggggaggccgccgccatcttcatgacggccacgccgcccggctccgtcgaggcgttcccgcagagcaacgccgtgatccaggacgaggagcgggacatccccgagcgctcctggaacagcgggtacgagtggatcaccgacttccccggcaagaccgtgtggttcgtcccctccatcaagagcggcaacgacatcgccaactgcctgcggaagaacgggaagcgcgtgatccagctgtcccggaagacgttcgacaccgagtaccagaagaccaagaacaacgactgggactacgtggtcaccacggacatcagcgagatgggcgccaacttccgcgcggaccgggtgatcgacccgcgccggtgcctcaagcccgtgatcctgaaggacgggcccgagcgcgtcatcctggccggccccatgccggtgaccgtcgcctccgccgcccagcggcgcgggcggatcggccgcaaccacaacaaggagggcgaccagtacatctacatggggcagcccctcaacaacgacgaggaccacgcgcactggaccgaggccaagatgctgctggacaacatcaacacccccgagggcatcatccccgccctcttcgagccggagcgcgagaagtccgccgccatcgacggggagtaccggctgcgcggcgaggcgcggaagacgttcgtggagctgatgcgccgcggggacctccccgtgtggctgtcctacaaggtcgccagcgagggcttccagtacagcgaccgccggtggtgcttcgacggcgagcgcaacaaccaggtgctggaggagaacatggacgtggagatctggaccaaggagggggagcggaagaagctccgcccccggtggctggacgcccgcacctactccgaccccctggccctccgggagttcaaggagttcgccgcgggccgccggagcgtctccggggacctgatcctggagatcggcaagctcccgcagcacctgacccagcgcgcccagaacgccctggacaacctcgtgatgctgcacaacagcgagcagggcgggcgggcctaccgccacgcgatggaggagctgcccgacacgatcgagaccctcatgctgctggccctcatcgccgtgctgaccggcggggtcaccctgttcttcctctccggccgggggctgggcaagaccagcatcggcctgctctgcgtgatggcctccagcgtgctgctgtggatggcctccgtcgagccccactggatcgcggccagcatcatcctcgagttcttcctgatggtgctgctcatccccgagccggaccgccagcggacgccccaggacaaccagctggcctacgtggtcatcgggctcctcttcatgatcctgaccgtggccgccaacgagatgggcctgctcgagaccaccaagaaggacctggggatcggccacgtggcggtcgagaaccaccaccacgccgccatgctggacgtggacctccaccccgcctccgcctggacgctgtacgcggtggccaccaccatcatcaccccgatgatgcgccacacgatcgagaacaccaccgccaacatcagcctgaccgccatcgccaaccaggcggccatcctcatggggctggacaagggctggcccatctccaagatggacatcggcgtccccctgctcgccctggggtgctacagccaggtgaaccccctgacgctcaccgccgcggtgctgatgctggtcgcccactacgccatcatcggcccggggctccaggccaaggccacccgcgaggcgcagaagcggaccgccgccggcatcatgaagaaccccacggtggacgggatcgtggccatcgacctggaccccgtcgtgtacgacgccaagttcgagaagcagctgggccagatcatgctcctgatcctgtgcacctcccagatcctcctgatgcgcaccacctgggcgctgtgcgagagcatcacgctcgccaccggccccctgaccaccctgtgggaggggtccccgggcaagttctggaacacgaccatcgccgtgagcatggccaacatcttccgggggtcctacctcgccggcgcgggcctggccttcagcctgatgaagtccctcgggggcgggcgccggggcaccggggcccagggcgagaccctgggcgagaagtggaagcgccagctgaaccagctctccaagagcgagttcaacacgtacaagcggtccgggatcatggaggtcgaccgcagcgaggccaaggagggcctgaagcgcggggagaccaccaagcacgcggtgtcccgcggcaccgccaagctgcggtggttcgtggagcgcaacctcgtcaagcccgaggggaaggtgatcgacctgggctgcggccgcggcgggtggagctactactgcgccgggctgaagaaggtgacggaggtcaaggggtacaccaagggcggccccggccacgaggagcccatcccgatggccacctacgggtggaacctggtgaagctccactccggcaaggacgtgttcttcatcccgcccgagaagtgcgacaccctgctgtgcgacatcggggagagctcccccaacccgacgatcgaggagggccgcaccctccgggtcctgaagatggtggagccctggctgcgcgggaaccagttctgcatcaagatcctcaacccctacatgcccagcgtggtcgagaccctggagcagatgcagcggaagcacggcggcatgctggtgcgcaacccgctctcccggaacagcacccacgagatgtactgggtgtcctgcgggaccggcaacatcgtcagcgccgtgaacatgacgtcccgcatgctgctgaaccgcttcaccatggcgcaccggaagcccacctacgagcgcgacgtggacctcggggccggcacccggcacgtcgccgtggagcccgaggtggccaacctggacatcatcggccagcgcatcgagaacatcaagcacgagcacaagagcacgtggcactacgacgaggacaacccctacaagacctgggcctaccacgggtcctacgaggtcaagccgagcggctccgcgagcagcatggtgaacggggtcgtgaagctgctcaccaagccctgggacgtgatccccatggtcacccagatcgccatgacggacaccacccccttcggccagcagcgggtgttcaaggagaaggtggacacccgcacgccgaaggccaagcgggggaccgcccagatcatggaggtcaccgccaagtggctgtggggcttcctgtcccgcaacaagaagccccggatctgcacccgcgaggagttcacgcggaaggtgcgcagcaacgcggccatcggcgccgtgttcgtcgacgagaaccagtggaactccgccaaggaggcggtggaggacgagcggttctgggacctcgtgcaccgcgagcgggagctgcacaagcaggggaagtgcgcgacctgcgtctacaacatgatgggcaagcgcgagaagaagctgggggagttcggcaaggccaaggggagccgggccatctggtacatgtggctcggcgcccgcttcctggagttcgaggcgctgggcttcatgaacgaggaccactggttctcccgggagaacagcctctccggggtggagggcgaggggctgcacaagctgggctacatcctccgcgacatcagcaagatccccgggggcaacatgtacgccgacgacaccgccggctgggacacccggatcacggaggacgacctgcagaacgaggcccgcatcaccgacatcatggagccggagcacgccctgctcgcgcgctccatcttcaagctgacctaccagaacaaggtggtccgggtgcagcgccccgccaagaacgggaccgtgatggacgtcatcagccggcgcgaccagcggggctccggccaggtggggacgtacggcctgaacaccttcaccaacatggaggcccagctcatccgccagatggagagcgaggggatcttctcccccagcgagctggagacccccatcctggccgagcgggtgctcgactggctggagaagtacggcgtcgagcgcctgaagcggatggccatctccggggacgactgcgtggtgaagccgatcgacgaccgcttcgcgacggccctcaccgccctgaacgacatgggcaaggtccggaaggacatcccccagtgggagcccagcaaggggtggaacgactggcagcaggtccccttctgctcccaccacttccaccagctgatcatgaaggacggccgcgagatcgtggtcccgtgccggaaccaggacgagctcgtgggccgcgcccgggtgagccagggggccggctggagcctgcgcgagaccgcgtgcctggggaagtcctacgcccagatgtggcagctcatgtacttccaccggcgcgacctgcggctggccgccaacgcgatctgcagcgccgtccccgtggactggatccccacctcccgcacgacctggagcatccacgcccaccaccagtggatgaccaccgaggacatgctctccgtgtggaaccgcgtctggatcgaggagaacccctggatggaggacaagacgcacatcagctcctggggcgacgtgccgtacctggggaagcgggaggaccagtggtgcggcagcctgatcggcctcaccgcccgcgccacctgggcgaccaacatccaggtggccatcaaccaggtccggcgcctgatcgggaacgagaactacctggactacatgacctccatgaagcggttcaagaacgagagcgaccccgagggcgccctctggtga

SEQ ID NO: 8304 - RNA, 9879 nt, synthetic construct
  misc_feature 1..9879: note = derived and/or modified CDS sequence (opt1) from DENV-1__EU677171__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgggacaagcggtccgtggccctcgcgccccacgtgggcctggggctggagacccgcaccgagacctggatgagctccgagggcgcctggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtcgggaagctggtgcaccagatcttcggcaccgcctacggggtgctgttctccggcgtcagctggacgatgaagatcgggatcggcgtgctgctgacctggctcggcctgaactcccgcagcacctccctgagcatgacctgcatcgccgtggggctcgtcacgctgtacctgggcgtgatggtgcaggccgactccgggtgcgtcatcaactggaagggccgggagctcaagtgcgggagcggcatcttcgtgaccaacgaggtgcacacctggaccgagcagtacaagttccaggccgacagcccgaagcgcctgtccgcggccatcggcaaggcctgggaggagggggtctgcggcatccggagcgccacccgcctggagaacatcatgtggaagcagatctccaacgagctcaaccacatcctgctggagaacgacatgaagttcacggtggtggtcggggacgtggccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtcgaggactacggcttcgggatcttcacgaccaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacgtgcatctggcccaagtcccacaccctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcacgaccgtggtcgtggacgagcactgcggcaaccgggggccgtccctgcgcaccaccacggtgaccggcaagatcatccacgagtggtgctgccggagctgcaccctgccgcccctccgcttccgcggggaggacggctgctggtacgggatggagatccgccccgtcaaggagaaggaggagaacctggtgaagtccatggtgagcgccggcagcggcgaggtcgactccttcagcctcgggctgctgtgcatctccatcatgatcgaggaggtgatgcggagccgctggtcccggaagatgctcatgaccggcacgctggccgtgttcttcctgctcatcatggggcagctgacctggaacgacctgatccgcctctgcatcatggtcggcgccaacgcgagcgaccgcatggggatgggcaccacctacctggccctgatggccacgttcaagatgcggccgatgttcgccgtgggcctcctgttccgccggctgacctcccgcgaggtgctcctgctgaccatcgggctcagcctggtcgcctccgtggagctgcccaacagcctcgaggagctgggcgacgggctggcgatgggcatcatgatcctcaagctgctgaccgacttccagtcccaccagctctgggccacgctgctgagcctcaccttcatcaagaccaccttctccctgcactacgcctggaagacgatggccatggtcctgagcatcgtgtccctcttccccctgtgcctgagcaccacctcccagaagaccacgtggctccccgtgctgctgggcagcctcgggtgcaagccgctgaccatgttcctgatcgcggagaacaagatctggggccggcgctcctggcccctcaacgaggggatcatggccgtcggcatcgtgagcatcctgctgagctccctcctgaagaacgacgtgcccctggccgggcccctcatcgccggcggcatgctgatcgcctgctacgtcatcagcgggtccagcgcggacctgtccctcgagaaggccgccgaggtgagctgggaggaggaggccgagcactccggcgccagccacaacatcctggtggaggtccaggacgacgggaccatgaagatcaaggacgaggagcgggacgacaccctgaccatcctcctgaaggcgacgctgctcgccgtgtccggcgtgtacccgctgagcatccccgccaccctgttcgtctggtacttctggcagaagaagaagcagcgctccggggtgctctgggacacccccagcccgcccgaggtggagcgggccgtcctggacgacggcatctaccgcatcatgcagcggggcctgctggggcgctcccaggtgggcgtgggggtcttccaggagaacgtgttccacaccatgtggcacgtgacgcggggcgccgtcctcatgtaccaggggaagcgcctggagcccagctgggcgtccgtgaagaaggacctgatcagctacggcggcgggtggcggctccagggctcctggaacaccggggaggaggtgcaggtcatcgccgtggagcccggcaagaaccccaagaacgtgcagaccgcccccgggaccttcaagacgcccgagggcgaggtcggcgccatcgccctggacttcaagcccgggaccagcggctcccccatcgtgaaccgcgaggggaagatcgtgggcctgtacggcaacggggtcgtgaccaccagcggcacgtacgtgagcgcgatcgcccaggccaaggcctcccaggaggggccgctccccgagatcgaggacgaggtcttccggaagcgcaacctgaccatcatggacctgcaccccggcagcgggaagacccggcgctacctcccggcgatcgtgcgggaggccatcaagcgcaagctgcgcaccctgatcctcgcccccacgcgggtggtcgcctccgagatggccgaggcgctgaagggcatgcccatccgctaccagaccaccgccgtcaagagcgagcacaccggcaaggagatcgtggacctgatgtgccacgccacgttcaccatgcggctcctgtcccccgtccgcgtgccgaactacaacatgatcatcatggacgaggcccacttcaccgaccccagctccatcgccgcgcgggggtacatcagcacccgcgtgggcatgggggaggccgccgccatcttcatgacggccacgccgcccggctccgtcgaggcgttcccgcagagcaacgccgtgatccaggacgaggagcgggacatccccgagcgctcctggaacagcgggtacgagtggatcaccgacttccccggcaagaccgtgtggttcgtcccctccatcaagagcggcaacgacatcgccaactgcctgcggaagaacgggaagcgcgtgatccagctctcccggaagacgttcgacaccgagtaccagaagaccaagaacaacgactgggactacgtggtcaccacggacatcagcgagatgggcgccaacttccgcgcggaccgggtgatcgacccgcgccggtgcctgaagcccgtgatcctgaaggacgggcccgagcgcgtcatcctcgccggccccatgccggtgaccgtcgcctccgccgcccagcggcgcgggcggatcggccgcaaccacaacaaggagggcgaccagtacatctacatggggcagcccctgaacaacgacgaggaccacgcgcactggaccgaggccaagatgctgctcgacaacatcaacacccccgagggcatcatccccgccctgttcgagccggagcgcgagaagtccgccgccatcgacggggagtaccggctgcgcggcgaggcgcggaagacgttcgtggagctcatgcgccgcggggacctgcccgtgtggctgtcctacaaggtcgccagcgagggcttccagtacagcgaccgccggtggtgcttcgacggcgagcgcaacaaccaggtgctcgaggagaacatggacgtggagatctggaccaaggagggggagcggaagaagctgcgcccccggtggctggacgcccgcacctactccgaccccctcgccctgcgggagttcaaggagttcgccgcgggccgccggagcgtctccggggacctgatcctcgagatcggcaagctgccgcagcacctgacccagcgcgcccagaacgccctcgacaacctggtgatgctgcacaacagcgagcagggcgggcgggcctaccgccacgcgatggaggagctccccgacacgatcgagaccctgatgctgctcgccctgatcgccgtgctgaccggcggggtcaccctcttcttcctgtccggccgggggctgggcaagaccagcatcggcctcctgtgcgtgatggcctccagcgtgctgctctggatggcctccgtcgagccccactggatcgcggccagcatcatcctggagttcttcctgatggtgctcctgatccccgagccggaccgccagcggacgccccaggacaaccagctggcctacgtggtcatcgggctcctgttcatgatcctgaccgtggccgccaacgagatgggcctcctggagaccaccaagaaggacctggggatcggccacgtggcggtcgagaaccaccaccacgccgccatgctcgacgtggacctgcaccccgcctccgcctggacgctgtacgcggtggccaccaccatcatcaccccgatgatgcgccacacgatcgagaacaccaccgccaacatcagcctcaccgccatcgccaaccaggcggccatcctgatggggctggacaagggctggcccatctccaagatggacatcggcgtccccctcctggccctggggtgctacagccaggtgaaccccctcacgctgaccgccgcggtgctgatgctcgtcgcccactacgccatcatcggcccggggctgcaggccaaggccacccgcgaggcgcagaagcggaccgccgccggcatcatgaagaaccccacggtggacgggatcgtggccatcgacctggaccccgtcgtgtacgacgccaagttcgagaagcagctcggccagatcatgctgctgatcctctgcacctcccagatcctgctgatgcgcaccacctgggcgctctgcgagagcatcacgctggccaccggccccctgaccaccctctgggaggggtccccgggcaagttctggaacacgaccatcgccgtgagcatggccaacatcttccgggggtcctacctggccggcgcgggcctggccttcagcctcatgaagtccctcgggggcgggcgccgggggaccggggcccagggcgagaccctgggcgagaagtggaagcgccagctcaaccagctgtccaagagcgagttcaacacgtacaagcggtccgggatcatggaggtcgaccgcagcgaggccaaggagggcctgaagcgcggggagaccaccaagcacgcggtgtcccgcggcaccgccaagctccggtggttcgtggagcgcaacctggtcaagcccgaggggaaggtgatcgacctgggctgcggccgcgggggctggagctactactgcgccgggctgaagaaggtgacggaggtcaagggctacaccaagggcggccccggccacgaggagcccatcccgatggccacctacgggtggaacctcgtgaagctgcactccggcaaggacgtgttcttcatcccgcccgagaagtgcgacaccctgctctgcgacatcggggagagctcccccaacccgacgatcgaggagggccgcaccctgcgggtcctgaagatggtggagccctggctccgcgggaaccagttctgcatcaagatcctgaacccctacatgcccagcgtggtcgagaccctggagcagatgcagcggaagcacggcggcatgctcgtgcgcaacccgctgtcccggaacagcacccacgagatgtactgggtgtcctgcgggaccggcaacatcgtcagcgccgtgaacatgacgtcccgcatgctgctcaaccgcttcaccatggcgcaccggaagcccacctacgagcgcgacgtggacctgggggccggcacccggcacgtcgccgtggagcccgaggtggccaacctggacatcatcggccagcgcatcgagaacatcaagcacgagcacaagagcacgtggcactacgacgaggacaacccctacaagacctgggcctaccacgggtcctacgaggtcaagccgagcggctccgcgagcagcatggtgaacggggtcgtgaagctcctgaccaagccctgggacgtgatccccatggtcacccagatcgccatgacggacaccacccccttcggccagcagcgggtgttcaaggagaaggtggacacccgcacgccgaaggccaagcgggggaccgcccagatcatggaggtcaccgccaagtggctgtggggcttcctctcccgcaacaagaagccccggatctgcacccgcgaggagttcacgcggaaggtgcgcagcaacgcggccatcggcgccgtgttcgtcgacgagaaccagtggaactccgccaaggaggcggtggaggacgagcggttctgggacctggtgcaccgcgagcgggagctgcacaagcaggggaagtgcgcgacctgcgtctacaacatgatgggcaagcgcgagaagaagctcggggagttcggcaaggccaaggggagccgggccatctggtacatgtggctgggcgcccgcttcctggagttcgaggcgctcggcttcatgaacgaggaccactggttctcccgggagaacagcctgtccggggtggagggcgaggggctgcacaagctcggctacatcctgcgcgacatcagcaagatccccgggggcaacatgtacgccgacgacaccgccggctgggacacccggatcacggaggacgacctgcagaacgaggcccgcatcaccgacatcatggagccggagcacgccctcctggcgcgctccatcttcaagctgacctaccagaacaaggtggtccgggtgcagcgccccgccaagaacgggaccgtgatggacgtcatcagccggcgcgaccagcggggctccggccaggtggggacgtacggcctcaacaccttcaccaacatggaggcccagctgatccgccagatggagagcgaggggatcttctcccccagcgagctggagacccccaacctcgccgagcgggtgctggactggctggagaagtacggcgtcgagcgcctcaagcggatggccatctccggggacgactgcgtggtgaagccgatcgacgaccgcttcgcgacggccctgaccgccctgaacgacatgggcaaggtccggaaggacatcccccagtgggagcccagcaaggggtggaacgactggcagcaggtccccttctgctcccaccacttccaccagctcatcatgaaggacggccgcgagatcgtggtcccgtgccggaaccaggacgagctggtgggccgcgcccgggtgagccagggggccggctggagcctgcgcgagaccgcgtgcctcgggaagtcctacgcccagatgtggcagctgatgtacttccaccggcgcgacctgcggctcgccgccaacgcgatctgcagcgccgtccccgtggactggatccccacctcccgcacgacctggagcatccacgcccaccaccagtggatgaccaccgaggacatgctgtccgtgtggaaccgcgtctggatcgaggagaacccctggatggaggacaagacgcacatcagctcctggggcgacgtgccgtacctggggaagcgggaggaccagtggtgcggcagcctcatcggcctgaccgcccgcgccacctgggcgaccaacatccaggtggccatcaaccaggtccggcgcctgatcgggaacgagaactacctcgactacatgacctccatgaagcggttcaagaacgagagcgaccccgagggcgccctgtggtga

SEQ ID NO: 8305 - RNA, 9879 nt, synthetic construct
  misc_feature 1..9879: note = derived and/or modified CDS sequence (opt1) from DENV-1__EU677172__SS-prME
  source 1..9879: mol_type = other RNA
agcgtgaccatgctgctgatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccaccgacacctgggtgacctacgggacctgcagccagacgggcgagcaccggcgggacaagcggtccgtggccctcgcgccccacgtgggcctggggctggagacccgcaccgagacctggatgagctccgagggcgcctggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggagctggccgagacccagcacggcaccgtgctggtgcagatcaagtacgagggcaccgacgcgccctgcaagatccccttcagcacgcaggacgagaagggggtcacccagaacggccggctgatcaccgccaacccgatcgtgaccgacaaggagaagcccgtgaacatcgaggccgagccgcccttcggggagtcctacatcgtcatcggcgccggcgagaaggcgctcaagctgagctggttcaagaaggggtccagcatcggcaagatgttcgaggccacggcccgcggggcccggcgcatggccatcctgggcgacaccgcgtgggacttcgggtccatcggcggcgtgttcaccagcgtggggaagctcgtccaccagatcttcggcaccgcctacggggtgctgttctccggcgtgagctggacgatgaagatcgggatcggcgtcctgctcacctggctgggcctgaactcccgcagcacctccctcagcatgacctgcatcgccgtggggctggtgacgctgtacctcggcgtcatggtgcaggccgactccgggtgcgtgatcaactggaagggccgggagctgaagtgcgggagcggcatcttcgtcaccaacgaggtgcacacctggaccgagcagtacaagttccaggccgacagcccgaagcgcctgtccgcggccatcggcaaggcctgggaggagggggtgtgcggcatccggagcgccacccgcctcgagaacatcatgtggaagcagatctccaacgagctgaaccacatcctgctcgagaacgacatgaagttcacggtcgtggtgggggacgtcgccggcatcctggcgcaggggaagaagatgatccggccccagcccatggagtacaagtacagctggaagtcctggggcaaggccaagatcatcggcgccgacgcccagaacaccaccttcatcatcgacgggcccaacaccccggagtgccccgacgaccagcgcgcgtggaacatctgggaggtggaggactacggcttcgggatcttcacgaccaacatctggctgaagctccgggacagctacacccaggtgtgcgaccaccgcctgatgtccgccgccatcaaggacagcaaggccgtccacgccgacatgggctactggatcgagtccgagaagaacgagacctggaagctggcgcgggccagcttcatcgaggtgaagacgtgcatctggcccaagtcccacaccctctggagcaacggcgtgctggagtccgagatgatcatccccaagatctacgggggcccgatcagccagcacaactaccgccccgggtacttcacccagaccgccggcccctggcacctggggaagctcgagctggacttcgacctgtgcgagggcacgaccgtcgtggtggacgagcactgcggcaaccgggggccgtccctccgcaccaccacggtcaccggcaagatcatccacgagtggtgctgccggagctgcaccctgccgcccctgcgcttccgcggggaggacggctgctggtacgggatggagatccgccccgtgaaggagaaggaggagaacctcgtgaagtccatggtcagcgccggcagcggcgaggtggactccttcagcctggggctgctctgcatctccatcatgatcgaggaggtgatgcggagccgctggtcccggaagatgctgatgaccggcacgctggccgtcttcttcctcctgaccatggggcagctgacctggaacgacctcatccgcctgtgcatcatggtgggcgcgaacgccagcgaccgcatggggatgggcaccacgtacctggccctcatggccaccttcaagatgcggccgatgttcgccgtgggcctgctgttccgccggctcacctcccgcgaggtcctgctgctcaccatcgggctgagcctggtggcgtccgtggagctccccaacagcctggaggagctgggcgacgggctcgccatgggcatcatgatcctgaagctgctcacggacttccagtcccaccagctgtgggccaccctgctcagcctgaccttcatcaagaccacgttctccctgcactacgcctggaagaccatggcgatggtcctcagcatcgtgtccctgttccccctgtgcctcagcaccacctcccagaagacgacctggctgcccgtcctgctcggcagcctggggtgcaagccgctgaccatgttcctcatcgccgagaacaagatctggggccggcgctcctggcccctgaacgaggggatcatggccgtgggcatcgtgagcatcctgctcagctccctgctgaagaacgacgtccccctcgccgggcccctgatcgccggcggcatgctgatcgcgtgctacgtgatcagcgggtccagcgccgacctctccctggagaaggccgccgaggtgagctgggaggaggaggccgagcactccggcgcgagccacaacatcctggtcgaggtgcaggacgacgggaccatgaagatcaaggacgaggagcgggacgacaccctcacgatcctgctgaaggccaccctcctggccgtgtccggcgtctacccgctgagcatccccgccaccctcttcgtgtggtacttctggcagaagaagaagcagcgctccggggtgctgtgggacacccccagcccgcccgaggtcgagcgggccgtgctggacgacggcatctaccgcatcatgcagcggggcctgctcgggcgctcccaggtgggcgtcggggtgttccaggagaacgtgttccacacgatgtggcacgtcacccggggcgcggtgctgatgtaccaggggaagcgcctggagcccagctgggcctccgtgaagaaggacctcatcagctacggcggcgggtggcggctgcagggctcctggaacaccggggaggaggtccaggtgatcgccgtggagcccggcaagaaccccaagaacgtccagaccgcccccgggacgttcaagacccccgagggcgaggtgggcgccatcgcgctggacttcaagcccgggaccagcggctcccccatcgtgaaccgcgaggggaagatcgtcggcctctacggcaacggggtggtgaccacgagcggcacctacgtcagcgccatcgcccaggccaaggcgtcccaggaggggccgctgcccgagatcgaggacgaggtgttccggaagcgcaacctgaccatcatggacctccaccccggcagcgggaagacccggcgctacctgccggccatcgtgcgggaggccatcaagcgcaagctgcgcacgctcatcctggcccccacccgggtcgtggcctccgagatggcggaggccctgaagggcatgcccatccgctaccagaccaccgccgtcaagagcgagcacacgggcaaggagatcgtcgacctcatgtgccacgccaccttcaccatgcggctgctgtcccccgtgcgcgtgccgaactacaacatgatcatcatggacgaggcccacttcaccgaccccagctccatcgcggcccgggggtacatcagcacgcgcgtcggcatgggggaggccgccgccatcttcatgaccgcgacgccgcccggctccgtggaggccttcccgcagagcaacgccgtgatccaggacgaggagcgggacatccccgagcgctcctggaacagcgggtacgagtggatcaccgacttccccggcaagacggtctggttcgtgccctccatcaagagcggcaacgacatcgccaactgcctccggaagaacgggaagcgcgtgatccagctgtcccggaagaccttcgacaccgagtaccagaagaccaagaacaacgactgggactacgtcgtgacgaccgacatcagcgagatgggcgcgaacttccgcgccgaccgggtgatcgacccgcgccggtgcctgaagcccgtcatcctcaaggacgggcccgagcgcgtgatcctggccggccccatgccggtgaccgtcgcctccgccgcgcagcggcgcgggcggatcggccgcaaccacaacaaggagggcgaccagtacatctacatggggcagcccctgaacaacgacgaggaccacgcccactggaccgaggccaagatgctcctggacaacatcaacacgcccgagggcatcatccccgccctgttcgagccggagcgcgagaagtccgccgcgatcgacggggagtaccggctccgcggcgaggcccggaagaccttcgtggagctgatgcgccgcggggacctgcccgtctggctctcctacaaggtggccagcgagggcttccagtacagcgaccgccggtggtgcttcgacggcgagcgcaacaaccaggtgctggaggagaacatggacgtcgagatctggaccaaggagggggagcggaagaagctgcgcccccggtggctcgacgcccgcacctactccgaccccctggccctgcgggagttcaaggagttcgcggccggccgccggagcgtgtccggggacctcatcctggagatcggcaagctgccgcagcacctcacgcagcgcgcccagaacgccctggacaacctggtgatgctccacaacagcgagcagggcgggcgggcgtaccgccacgccatggaggagctgcccgacaccatcgagaccctgatgctcctggccctgatcgccgtcctcaccggcggggtgaccctgttcttcctgtccggccgggggctcggcaagacgagcatcggcctgctgtgcgtgatggcctccagcgtcctcctgtggatggcgtccgtggagccccactggatcgccgccagcatcatcctggagttcttcctcatggtgctgctgatccccgagccggaccgccagcggacgccccaggacaaccagctcgcctacgtcgtgatcgggctgctgttcatgatcctcaccgtggccgcgaacgagatgggcctgctggagaccacgaagaaggacctcgggatcggccacgtcgccgtggagaaccaccaccacgccgccatgctggacgtggacctgcaccccgcctccgcgtggaccctctacgccgtcgccaccaccatcatcacgccgatgatgcgccacaccatcgagaacaccaccgccaacatcagcctgacggccatcgcgaaccaggccgccatcctgatggggctcgacaagggctggcccatctccaagatggacatcggcgtgcccctgctggccctcgggtgctacagccaggtgaaccccctgaccctgaccgcggccgtcctcatgctggtggcccactacgccatcatcggcccggggctgcaggccaaggcgacccgcgaggcccagaagcggacggccgccggcatcatgaagaaccccaccgtggacgggatcgtcgccatcgacctcgaccccgtggtgtacgacgcgaagttcgagaagcagctgggccagatcatgctgctcatcctgtgcacctcccagatcctgctcatgcgcaccacgtgggccctgtgcgagagcatcaccctggccaccggccccctcaccacgctgtgggaggggtccccgggcaagttctggaacaccaccatcgccgtcagcatggccaacatcttccgggggtcctacctggcgggcgccggcctcgccttcagcctgatgaagtccctcgggggcgggcgccgggggaccggggcccagggcgagacgctcggcgagaagtggaagcgccagctgaaccagctgtccaagagcgagttcaacacctacaagcggtccgggatcatggaggtggaccgcagcgaggcgaaggagggcctcaagcgcggggagaccaccaagcacgccgtgtcccgcggcacggccaagctgcggtggttcgtcgagcgcaacctggtgaagcccgaggggaaggtgatcgacctgggctgcggccgcgggggctggagctactactgcgccgggctcaagaaggtcaccgaggtgaagggctacaccaagggcggccccggccacgaggagcccatcccgatggccacctacgggtggaacctggtgaagctgcactccggcaaggacgtcttcttcatcccgcccgagaagtgcgacacgctcctgtgcgacatcggggagagctcccccaacccgaccatcgaggagggccgcaccctgcgggtgctcaagatggtggagccctggctgcgcgggaaccagttctgcatcaagatcctgaacccctacatgcccagcgtcgtggagaccctcgagcagatgcagcggaagcacggcggcatgctggtgcgcaacccgctgtcccggaacagcacccacgagatgtactgggtctcctgcgggacgggcaacatcgtgagcgcggtgaacatgacctcccgcatgctcctgaaccgcttcaccatggcccaccggaagcccacctacgagcgcgacgtcgacctgggggccggcacgcggcacgtggccgtggagcccgaggtcgccaacctcgacatcatcggccagcgcatcgagaacatcaagcacgagcacaagagcacctggcactacgacgaggacaacccctacaagacctgggcgtaccacgggtcctacgaggtgaagccgagcggctccgccagcagcatggtgaacggggtcgtgaagctgctgaccaagccctgggacgtcatccccatggtgacgcagatcgccatgaccgacaccacccccttcggccagcagcgggtgttcaaggagaaggtcgacacgcgcaccccgaaggccaagcgggggaccgcccagatcatggaggtgaccgcgaagtggctctggggcttcctgtcccgcaacaagaagccccggatctgcacgcgcgaggagttcacccggaaggtgcgcagcaacgccgccatcggcgccgtcttcgtggacgagaaccagtggaactccgcgaaggaggccgtggaggacgagcggttctgggacctggtccaccgcgagcgggagctccacaagcaggggaagtgcgcgacctgcgtgtacaacatgatgggcaagcgcgagaagaagctgggggagttcggcaaggccaaggggagccgggccatctggtacatgtggctgggcgcgcgcttcctcgagttcgaggccctgggcttcatgaacgaggaccactggttctcccgggagaacagcctgtccggggtggagggcgaggggctccacaagctgggctacatcctgcgcgacatcagcaagatccccgggggcaacatgtacgccgacgacaccgccggctgggacacgcggatcaccgaggacgacctccagaacgaggcccgcatcaccgacatcatggagccggagcacgcgctgctggccaagtccatcttcaagctcacctaccagaacaaggtcgtgcgcgtgcagcggcccgccaagaacgggacggtcatggacgtgatcagccgccgggaccagcgcggctccggccaggtggggacctacggcctgaacaccttcaccaacatggaggcccagctgatccggcagatggagagcgaggggatcttctcccccagcgagctcgagacgcccaacctggccgagcgcgtcctggactggctcgagaagtacggcgtggagcggctgaagcgcatggcgatctccggggacgactgcgtggtcaagccgatcgacgaccggttcgccaccgccctgaccgccctcaacgacatgggcaaggtgcgcaaggacatcccccagtgggagcccagcaaggggtggaacgactggcagcaggtccccttctgctcccaccacttccaccagctgatcatgaaggacggccgggagatcgtcgtgccgtgccgcaaccaggacgagctggtgggccgggcccgcgtcagccagggggcgggctggagcctccgggagaccgcctgcctggggaagtcctacgcccagatgtggcagctgatgtacttccaccgccgggacctccgcctggccgcgaacgccatctgcagcgccgtgcccgtggactggatccccacgtcccggaccacctggagcatccacgcccaccaccagtggatgaccacggaggacatgctgtccgtctggaaccgcgtgtggatcgaggagaacccctggatggaggacaagacccacatcagctcctggggcgacgtgccgtacctcgggaagcgcgaggaccagtggtgcggcagcctgatcggcctgaccgcccgggcgacctgggccaccaacatccaggtcgccatcaaccaggtgcgccggctcatcgggaacgagaactacctggactacatgacgtccatgaagcgcttcaagaacgagagcgaccccgagggcgccctgtggtga

SEQ ID NO: 8306 - RNA, 9879 nt, synthetic construct
  misc_feature 1..9879: note = derived and/or modified CDS sequence (opt1) from DENV-1__EU677173__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgcgggggtgaacatgtgcaccctcatcgccatggacctgggggagctgtgcgaggacaccatgacctacaagtgcccccggatcaccgaggccgagcccgacgacgtggactgctggtgcaacgccaccgacacctgggtgacctacgggacctgctcccagacgggggagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccaccacgagccaggagacctggaaccggcaggacctgctggtgaccttcaagaccgcccacgcgaagaagcaggaggtggtcgtgctcggctcccaggagggcgccatgcacacggccctgaccggggccaccgagatccagaccagcggcacgaccaccatcttcgccgggcacctgaagtgccgcctcaagatggacaagctgaccctgaagggcatgtcctacgtgatgtgcacggggagcttcaagctcgagaaggaggtcgcggagacccagcacggcaccgtgctggtgcagatcaagtacgagggcaccgacgccccctgcaagatccccttctccacgcaggacgagaagggggtcacccagaacggccggctgatcaccgccaacccgatcgtgaccgacaaggagaagcccgtgaacatcgaggccgagccgcccttcggggagagctacatcgtcatcggcgcgggcgagaaggccctgaagctctcctggttcaagaaggggagctccatcggcaagatgttcgaggccacggcccgcggggcccggcgcatggcgatcctgggcgacaccgcctgggacttcgggagcatcggcggcgtgttcacctccgtggggaagctggtccaccagatcttcggcaccgcctacggggtcctgttcagcggcgtgtcctggacgatgaagatcgggatcggcgtcctgctgacctggctcggcctgaacagccgctccaccagcctgtccatgacctgcatcgccgtggggctcgtgacgctgtacctgggcgtcatggtgcaggccgacagcgggtgcgtgatcaactggaagggccgggagctcaagtgcgggtccggcatcttcgtcaccaacgaggtgcacacctggaccgagcagtacaagttccaggcggacagcccgaagcgcctgagcgccgccatcggcaaggcctgggaggagggggtgtgcggcatccggtccgccacccgcctggagaacatcatgtggaagcagatcagcaacgagctcaaccacatcctgctggagaacgacatgaagttcacggtcgtggtgggggacgtcgtgggcatcctcgcgcaggggaagaagatgatccggccccagcccatggagcacaagtactcctggaagtcctggggcaaggccaagatcatcggcgccgacgtgcagaacaccaccttcatcatcgacgggcccaacaccccggagtgccccgacgaccagcgcgcctggaacatctgggaggtcgaggactacggcttcgggatcttcacgaccaacatctggctgaagctgcgggactcctacacccagatgtgcgaccaccgcctcatgagcgcggccatcaaggactccaaggccgtgcacgccgacatgggctactggatcgagagcgagaagaacgagacctggaagctggcccgggcgtccttcatcgaggtgaagacgtgcatctggcccaagagccacaccctgtggtccaacggcgtcctcgagagcgagatgatcatccccaagatctacgggggcccgatctcccagcacaactaccgccccgggtacttcacccagaccgccggcccctggcacctggggaagctggagctcgacttcgacctgtgcgagggcacgaccgtggtggtcgacgagcactgcggcaaccgggggccgagcctgcgcaccaccacggtgaccggcaagatcatccacgagtggtgctgccggtcctgcaccctgccgcccctccgcttcaagggggaggacggctgctggtacgggatggagatccggcccgtgaaggagaaggaggagaacctggtcaagagcatggtgtccgccggcagcggcgaggtggacagcttctccctcgggctgctgtgcatcagcatcatgatcgaggaggtcatgcgctcccggtggagccgcaagatgctcatgaccggcacgctggccgtgttcctgctcctgatcatggggcagctgacctggaacgacctcatccggctgtgcatcatggtgggcgccaacgcgtccgaccgcatggggatgggcaccacctacctggccctcatggccacgttcaagatgcgcccgatgttcgccgtcggcctgctgttccggcgcctcaccagccgggaggtgctgctgctcaccatcgggctgtccctggtggccagcgtcgagctccccaactccctggaggagctgggcgacgggctcgcgatgggcatcatgatcctgaagctgctcaccgacttccagagccaccagctgtgggccacgctgctctccctgaccttcatcaagaccaccctgagcctccactacgcctggaagacgatggccatggtgctgtccatcgtcagcctgttccccctctgcctgtccaccaccagccagaagaccacgtggctgcccgtgctcctgggctccctggggtgcaagccgctcaccatgttcctgatcaccgagaacaagatctggggccgcaagagctggcccctgaacgaggggatcatggcggtgggcgtcgtgtccatcctcctgagcagcctgctcaagaacgacgtgcccctggccgggcccctgatcgccggcggcatgctcatcgcctgctacgtcatctccgggagctccgccgacctgagcctggagaaggcggccgaggtgtcctgggaggaggaggccgagcacagcggcgcctcccacaacatcctcgtggaggtccaggacgacgggaccatgaagatcaaggacgaggagcgggacgacaccctgacgatcctgctcaaggccaccctgctggcggtgagcggcgtgtacccgctctccatccccgccaccctgttcgtctggtacttctggcagaagaagaagcagcgcagcggggtgctgtgggacacccccagcccgcccgaggtggagcgggccgtcctggacgacggcatctaccgcatcatgcagcggggcctcctggggcgcagccaggtgggcgtgggggtcttccaggagaacgtgttccacacgatgtggcacgtgacccggggcgccgtcctgatgtaccaggggaagcgcctcgagccctcctgggccagcgtgaagaaggacctgatctcctacggcggcgggtggcggctgcagggcagctggaacgcgggggaggaggtgcaggtcatcgccgtggagcccggcaagaaccccaagaacgtgcagaccgcccccgggaccttcaagacgcccgagggcgaggtcggcgccatcgccctcgacttcaagcccgggacctccggcagccccatcgtgaaccgcgaggggaagatcgtgggcctgtacggcaacggggtcgtgaccacctccggcacgtacgtgagcgcgatcgcccaggccaaggccagccaggaggggccgctgcccgagatcgaggacgaggtcttccggaagcgcaacctcaccatcatggacctgcaccccggctccgggaagacccggcgctacctgccggcgatcgtgcgggaggccatcaagcgcaagctccggaccctgatcctggcccccacgcgcgtggtcgccagcgagatggccgaggcgctcaagggcatgcccatccgctaccagaccaccgccgtgaagtccgagcacaccggcaaggagatcgtggacctgatgtgccacgccacgttcaccatgcggctgctcagccccgtccgcgtgccgaactacaacatgatcatcatggacgaggcccacttcaccgacccctccagcatcgccgcgcgggggtacatctccacccgcgtgggcatgggggaggccgccgccatcttcatgacggccacgccgcccggcagcgtcgaggcgttcccgcagtccaacgccgtgatccaggacgaggagcgggacatccccgagcgcagctggaactccgggtacgagtggatcaccgacttccccggcaagaccgtgtggttcgtccccagcatcaagtccggcaacgacatcgccaactgcctgcggaagaacgggaagcgcgtgatccagctgagccggaagacgttcgacaccgagtaccagaagaccaagaacaacgactgggactacgtggtcaccacggacatctccgagatgggcgccaacttccgcgcggaccgggtgatcgacccgcgccggtgcctcaagcccgtgatcctgaaggacgggcccgagcgcgtcatcctggccggccccatgccggtgaccgtcgccagcgccgcccagcggcgcgggcggatcggccgcaaccacaacaaggagggcgaccagtacatctacatggggcagcccctcaacaacgacgaggaccacgcgcactggaccgaggccaagatgctgctggacaacatcaacacccccgagggcatcatccccgccctcttcgagccggagcgggagaagtccgccgccatcgacggggagtaccgcctgcgcggcgaggcgcggaagacgttcgtggagctgatgcgccgcggggacctccccgtgtggctgagctacaaggtcgcctccgagggcttccagtacagcgaccgccggtggtgcttcgacggcgagcgcaacaaccaggtgctggaggagaacatggacgtggagatctggaccaaggagggggagcggaagaagctccgcccccggtggctggacgcccgcacctacagcgaccccctggccctccgggagttcaaggagttcgccgcgggccgccggtccgtcagcggggacctgatcctggagatcggcaagctcccgcagcacctgacccagcgcgcccagaacgccctggacaacctcgtgatgctgcacaactccgagcagggcgggcgggcctaccgccacgcgatggaggagctgcccgacacgatcgagaccctcatgctgctggccctcatcgccgtgctgaccggcggggtcaccctgttcttcctcagcggccgggggctgggcaagacctccatcggcctgctctgcgtgatggccagctccgtgctgctgtggatggccagcgtcgagccccactggatcgcggcctccatcatcctcgagttcttcctgatggtgctgctcatccccgagccggaccgccagcggacgccccaggacaaccagctggcctacgtggtcatcgggctcctcttcatgatcctgaccgtggccgccaacgagatgggcctgctcgagaccaccaagaaggacctggggatcggccacgtggcggtcgagaaccaccaccacgccacgatgctggacgtggacctccaccccgccagcgcctggaccctgtacgccgtggcgaccaccatcatcacgccgatgatgcgccacaccatcgagaacaccaccgccaacatctccctgacggccatcgccaaccaggccgcgatcctcatggggctggacaagggctggcccatcagcaagatggacatcggcgtccccctgctcgccctggggtgctactcccaggtgaaccccctgaccctcaccgccgccgtgctgatgctggtcgcgcactacgccatcatcggcccggggctccaggccaaggccacccgggaggcccagaagcgcacggcggccggcatcatgaagaaccccaccgtggacgggatcgtggccatcgacctggaccccgtcgtgtacgacgccaagttcgagaagcagctgggccagatcatgctcctgatcctgtgcaccagccagatcctcctgatgcgcaccacgtgggccctgtgcgagtccatcaccctcgcgaccggccccctgaccacgctgtgggaggggagcccgggcaagttctggaacaccaccatcgccgtgtccatggccaacatcttccgggggagctacctcgccggcgccggcctggcgttctccctgatgaagtccctcgggggcgggcgccggggcaccggggcccagggcgagacgctgggcgagaagtggaagcgccagctgaaccagctcagcaagtccgagttcaacatctacaagcggagcgggatcatggaggtcgaccgctccgaggccaaggagggcctgaagcgcggggagaccacccgccacgccgtgagccggggcaccgcgaagctgcgctggttcgtggagcggaacctggtcaagcccgaggggaaggtgatcgacctcggctgcggccgcgggggctggtcctactactgcgccgggctgaagaaggtgacggaggtcaagggctacaccaagggcgggcccggccacgaggagcccatcccgatggccacctacgggtggaacctggtgaagctccacagcggcaaggacgtgttcttcacgccgcccgagaagtgcgacacgctgctgtgcgacatcggggagtccagccccaacccgaccatcgaggagggccggaccctccgcgtcctgaagatggtggagccctggctgcgggggaaccagttctgcatcaagatcctcaacccctacatgccctccgtggtcgagaccctggagcagatgcagcgcaagtacggcggcatgctggtgcggaacccgctcagccgcaactccacccacgagatgtactgggtgagctgcgggacgggcaacatcgtctccgccgtgaacatgaccagccggatgctgctgaaccgcttcaccatggcccaccgcaagcccacctacgagcgggacgtggacctcggggcgggcacgcgccacgtcgccgtggagcccgaggtggccaacctggacatcatcggccagcggatcgagaacatcaagcacgagcacaagtccacctggcactacgacgaggacaacccctacaagacctgggcctaccacgggagctacgaggtcaagccgtccggcagcgcctccagcatggtgaacggggtcgtgaagctgctcaccaagccctgggacgtgatccccatggtcacgcagatcgcgatgaccgacaccacccccttcggccagcagcgcgtgttcaaggagaaggtggacacgcggaccccgaaggccaagcgcgggaccgcccagatcatggaggtcaccgcccggtggctgtggggcttcctgagccgcaacaagaagccccggatctgcacgcgcgaggagttcacccggaaggtgcgctccaacgccgcgatcggcgccgtgttcgtcgacgagaaccagtggaacagcgccaaggaggccgtggaggacgagcggttctgggacctcgtgcagaaggagcgcgagctgcacaagcaggggaagtgcgcgacctgcgtctacaacatgatgggcaagcgggagaagaagctgggggagttcggcaaggccaaggggtcccgcgccatctggtacatgtggctcggcgcccggttcctggagttcgaggccctgggcttcatgaacgaggaccactggttcagccgcgagaactccctcagcggggtggagggcgaggggctgcacaagctgggctacatcctccgggacatctccaagatccccgggggcaacatgtacgcggacgacaccgccggctgggacacgcgcatcaccgaggacgacctgcagaacgaggccaagatcaccgacatcatggagccggagcacgccctgctcgccaccagcatcttcaagctgacgtaccagaacaaggtggtccgggtgcagcgccccgcgaagaacgggaccgtgatggacgtcatctcccgccgggaccagcgcggcagcggccaggtgggcacctacggcctgaacaccttcacgaacatggaggcccagctcatccggcagatggagtccgaggggatcttcctgcccagcgagctggagacccccaacctcgccgagcgcgtgctggactggctggagaagtacggcgtcgagcggctcaagcgcatggccatctccggggacgactgcgtggtgaagccgatcgacgaccggttcgccaccgcgctgaccgccctgaacgacatgggcaaggtccgcaaggacatcccccagtgggagcccagcaaggggtggaacgactggcagcaggtccccttctgctcccaccacttccaccagctcatcatgaaggacggccgggagatcgtggtcccgtgccgcaaccaggacgagctggtgggccgggcccgcgtgagccagggggccggctggtccctgcgggagacggcctgcctcggcaagagctacgcgcagatgtggcagctgatgtacttccaccgccgggacctgcgcctcgccgccaacgccatctgcagcgcggtccccgtggactgggtgcccacctcccggaccacctggagcatccacgcccaccaccagtggatgacgaccgaggacatgctgtccgtctggaaccgcgtgtggatcgaggagaacccctggatggaggacaagacccacgtgagctcctggggcgacgtcccgtacctggggaagcgggaggaccagtggtgcggcagcctcatcggcctgaccgcccgcgccacctgggcctccaacatccaggtggcgatcaaccaggtgcgccggctgatcgggaacgagaactacctcgactacatgacgagcatgaagcgcttcaagaacgagggcgaccccgagggggccctgtggtga

SEQ ID NO: 8307 - RNA, 9879 nt, synthetic construct
  misc_feature 1..9879: note = derived and/or modified CDS sequence (opt1) from DENV-1__EU726779__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgcgacaagcggtccgtggccctcgcgccccacgtgggcctggggctggagacccgcaccgagacctggatgagctccgagggcgcctggaagcagatccagcgggtggagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtcgggaagctggtgcaccagatcttcggcaccgcctacggggtcctgttctccggcgtcagctggacgatgaagatcgggatcggcgtgctgctgacctggctcggcctgaactcccgcagcacctccttcagcatgacctgcatcgccgtggggctggtcacgctctacctgggcgtgatggtgcaggccgactccgggtgcgtcatcaactggaagggccgggagctgaagtgcgggagcggcatcttcgtgaccaacgaggtgcacacctggaccgagcagtacaagttccaggccgacagcccgaagcgcctctccgcggccatcggcaaggcctgggaggagggggtctgcggcatccggagcgccacccgcctggagaacatcatgtggaagcagatctccaacgagctgaaccacatcctcctggagaacgacatgaagttcacggtggtggtcggggacgtggccggcatcctggcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtcgaggactacggcttcgggatcttcacgaccaacatctggctcaagctgcgggacagctacacccaggtgtgcgaccaccgcctgatgtccgcggccatcaaggacagcaaggccgtgcacgccgacatgggctactggatcgagtccgagaagaacgagacctggaagctcgcccgggcgagcttcatcgaggtcaagacgtgcatctggcccaagtcccacaccctgtggagcaacggcgtgctggagtccgagatgatcatccccaagatctacgggggcccgatcagccagcacaactaccgccccgggtacttcacccagaccgccggcccctggcacctcgggaagctggagctggacttcgacctctgcgagggcacgaccgtggtcgtggacgagcactgcggcaaccgggggccgtccctgcgcaccaccacggtgaccggcaagatcatccacgagtggtgctgccggagctgcaccctgccgcccctgcgcttccgcggggaggacggctgctggtacgggatggagatccgccccgtcaaggagaaggaggagaacctggtgaagtccatggtgagcgccggcagcggcgaggtcgactccttcagcctggggctcctgtgcatctccatcatgatcgaggaggtgatgcggagccgctggtcccggaagatgctgatgaccggcacgctcgccgtgttcttcctgctgatcatggggcagctcacctggaacgacctgatccgcctgtgcatcatggtcggcgccaacgcgagcgaccgcatggggatgggcaccacctacctcgccctgatggccacgttcaagatgcggccgatgttcgccgtggggctcctcttccgccggctgacctcccgcgaggtgctgctcctgaccatcgggctgagcctcgtcgcctccgtggagctgcccaacagcctggaggagctcggcgacgggctggcgatgggcatcatgatcctgaagctcctgaccgacttccagtcccaccagctgtgggccacgctcctgagcctgaccttcatcaagaccaccttctccctccactacgcctggaagacgatggccatggtcctgagcatcgtgtccctgttccccctctgcctgagcaccacctcccagaagaccacgtggctgcccgtgctcctgggcagcctggggtgcaagccgctcaccatgttcctgatcgcggagaacaagatctggggccggcgctcctggcccctgaacgaggggatcatggccgtcggcatcgtgagcatcctcctgagctccctgctcaagaacgacgtgcccctggccgggcccctgatcgccggcggcatgctcatcgcctgctacgtcatcagcgggtccagcgcggacctgtccctggagaaggccgccgaggtgagctgggaggaggaggccgagcactccggcgccagccacaacatcctcgtggaggtccaggacgacgggaccatgaagatcaaggacgaggagcgggacgacaccctgaccatcctgctcaaggcgacgctgctggccgtgtccggcgtgtacccgctcagcatccccgccaccctgttcgtctggtacttctggcagaagaagaagcagcgctccggggtgctgtgggacacccccagcccgcccgaggtgggccgggccgtcctcgacgacggcatctaccgcatcatgcagcgggggctgctgggccgctcccaggtgggggtgggcgtcttccaggagaacgtgttccacaccatgtggcacgtgacgcgcggggccgtcctgatgtaccagggcaagcgcctcgagcccagctgggcgtccgtgaagaaggacctgatcagctacggcgggggctggcggctgcaggggtcctggaacaccggcgaggaggtgcaggtcatcgccgtggagcccgggaagaaccccaagaacgtgcagaccgcccccggcaccttcaagacgcccgagggcgaggtcggggccatcgccctcgacttcaagcccggcaccagcgggtcccccatcgtgaaccgcgagggcaagatcgtgggcctgtacgggaacggcgtcgtgaccaccagcgggacgtacgtgagcgcgatcgcccaggccaaggcctcccaggagggcccgctgcccgagatcgaggacgaggtcttccggaagcgcaacctcaccatcatggacctgcaccccgggagcggcaagacccggcgctacctgccggcgatcgtgcgggaggccatcaagcgcaagctccgcaccctgatcctggcccccacgcgggtggtcgcctccgagatggccgaggcgctcaagggcatgcccatccgctaccagaccaccgccgtcaagagcgagcacaccgggaaggagatcgtggacctgatgtgccacgccacgttcaccatgcggctgctctcccccgtccgcgtgccgaactacaacatgatcatcatggacgaggcccacttcaccgaccccagctccatcgccgcgcggggctacatcagcacccgcgtggggatgggcgaggccgccgccatcttcatgacggccacgccgcccgggtccgtcgaggcgttcccgcagagcaacgccgtgatccaggacgaggagcgggacatccccgagcgctcctggaacagcggctacgagtggatcaccgacttccccggcaagaccgtgtggttcgtcccctccatcaagagcgggaacgacatcgccaactgcctgcggaagaacggcaagcgcgtgatccagctgtcccggaagacgttcgacaccgagtaccagaagaccaagaacaacgactgggactacgtggtcaccacggacatcagcgagatgggggccaacttccgcgcggaccgggtgatcgacccgcgccggtgcctcaagcccgtgatcctgaaggacggccccgagcgcgtcatcctggccgggcccatgccggtgaccgtcgcctccgccgcccagcggcgcggccggatcggccgcaaccacaacaaggagggggaccagtacatctacatgggccagcccctcaacaacgacgaggaccacgcgcactggaccgaggccaagatgctgctggacaacatcaacacccccgaggggatcatccccgccctcttcgagccggagcgcgagaagtccgccgccatcgacggcgagtaccggctgcgcggggaggcgcggaagacgttcgtggagctgatgcgccggggcgacctccccgtgtggctgtcctacaaggtcgccagcgagggcttccagtacagcgaccgccggtggtgcttcgacggggagcgcaacaaccaggtgctggaggagaacatggacgtggagatctggaccaaggagggcgagcggaagaagctccgcccccggtggctggacgcccgcacctactccgaccccctggccctccgggagttcaaggagttcgccgcggggcgccggagcgtctccggcgacctgatcctggagatcggcaagctcccgcagcacctgacccagcgcgcccagaacgccctggacaacctcgtgatgctgcacaacagcgagcagggcgggcgggcctaccgccacgcgatggaggagctgcccgacacgatcgagaccctcatgctgctggccctcatcgccgtgctgaccgggggcgtcaccctgttcttcctctccgggcggggcctgggcaagaccagcatcgggctgctctgcgtgatggcctccagcgtgctgctgtggatggcctccgtcgagccccactggatcgcggccagcatcatcctcgagttcttcctgatggtgctgctcatccccgagccggaccgccagcggacgccccaggacaaccagctggcctacgtggtcatcggcctcctcttcatgatcctgaccgtggccgccaacgagatggggctgctcgagaccaccaagaaggacctgggcatcgggcacgtggcggtcgagaaccaccaccacgccgccatgctggacgtggacctccaccccgcctccgcctggacgctgtacgcggtggccaccaccatcatcaccccgatgatgcgccacacgatcgagaacaccaccgccaacatcagcctgaccgccatcgccaaccaggcggccatcctcatgggcctggacaagggctggcccatctccaagatggacatcggggtccccctgctcgccctgggctgctacagccaggtgaaccccctgacgctcaccgccgcggtgctgatgctggtcgcccactacgccatcatcgggccgggcctccaggccaaggccacccgcgaggcgcagaagcggaccgccgccgggatcatgaagaaccccacggtggacggcatcgtggccatcgacctggaccccgtcgtgtacgacgccaagttcgagaagcagctgggccagatcatgctcctgatcctgtgcacctcccagatcctcctgatgcgcaccacctgggcgctgtgcgagagcatcacgctcgccaccgggcccctgaccaccctgtgggagggctccccggggaagttctggaacacgaccatcgccgtgagcatggccaacatcttccggggctcctacctcgccggcgcggggctggccttcagcctgatgaagtccctcggcgggggccgccgggggaccggcgcccagggcgagaccctgggggagaagtggaagcgccagctgaaccagctctccaagagcgagttcaacacgtacaagcggtccggcatcatggaggtcgaccgcagcgaggccaaggaggggctgaagcggggcgagaccaccaagcacgcggtgtcccgcgggaccgccaagctgcggtggttcgtggagcgcaacctcgtcaagcccgagggcaaggtgatcgacctgggctgcgggcggggcgggtggagctactactgcgccggcctgaagaaggtgacggaggtcaaggggtacaccaagggcggccccgggcacgaggagcccatcccgatggccacctacggctggaacctggtgaagctccactccgggaaggacgtgttcttcatcccgcccgagaagtgcgacaccctgctgtgcgacatcggcgagagctcccccaacccgacgatcgaggaggggcgcaccctccgggtcctgaagatggtggagccctggctgcgcggcaaccagttctgcatcaagatcctcaacccctacatgcccagcgtggtcgagaccctggagcagatgcagcggaagcacggcgggatgctggtgcgcaacccgctctcccggaacagcacccacgagatgtactgggtgtcctgcggcaccgggaacatcgtcagcgccgtgaacatgacgtcccgcatgctgctgaaccgcttcaccatggcgcaccggaagcccacctacgagcgcgacgtggacctcggcgccggcacccggcacgtcgccgtggagcccgaggtggccaacctggacatcatcgggcagcgcatcgagaacatcaagcacgagcacaagagcacgtggcactacgacgaggacaacccctacaagacctgggcctaccacggctcctacgaggtcaagccgagcgggtccgcgagcagcatggtgaacggcgtcgtgaagctgctcaccaagccctgggacgtgatccccatggtcacccagatcgccatgacggacaccacccccttcgggcagcagcgggtgttcaaggagaaggtggacacccgcacgccgaaggccaagcggggcaccgcccagatcatggaggtcaccgccaagtggctgtggggcttcctgtcccgcaacaagaagccccggatctgcacccgcgaggagttcacgcggaaggtgcgcagcaacgcggccatcggggccgtgttcgtcgacgagaaccagtggaactccgccaaggaggcggtggaggacgagcggttctgggacctcgtgcaccgcgagcgggagctgcacaagcagggcaagtgcgcgacctgcgtctacaacatgatggggaagcgcgagaagaagctgggcgagttcgggaaggccaagggcagccgggccatctggtacatgtggctcggcgcccgcttcctggagttcgaggcgctggggttcatgaacgaggaccactggttctcccgggagaacagcctctccggcgtggagggggagggcctgcacaagctggggtacatcctccgcgacatcagcaacatccccggcggcaacatgtacgccgacgacaccgccgggtgggacacccggatcacggaggacgacctgcagaacgaggcccgcatcaccgacatcatggagccggagcacgccctgctcgcgaagtccatcttcaagctgacctaccagaacaaggtggtccgcgtgcagcggcccgccaagaacggcaccgtgatggacgtcatcagccgccgggaccagcgcgggtccggccaggtgggcacgtacgggctgaacaccttcaccaacatggaggcccagctcatccggcagatggagagcgagggcatcttctcccccagcgagctggagacccccaacctggccgagcgcgtgctcgactggctggagaagtacggggtcgagcggctgaagcgcatggccatctccggcgacgactgcgtggtgaagccgatcgacgaccggttcgcgacggccctcaccgccctgaacgacatggggaaggtccgcaaggacatcccccagtgggagcccagcaagggctggaacgactggcagcaggtccccttctgctcccaccacttccaccagctgatcatgaaggacggccgggagatcgtggtcccgtgccgcaaccaggacgagctcgtggggcgggcccgcgtgagccagggcgccgggtggagcctgcgggagaccgcgtgcctgggcaagtcctacgcccagatgtggcagctcatgtacttccaccgccgggacctgcgcctggccgccaacgcgatctgcagcgccgtccccgtggactggatccccacctcccggacgacctggagcatccacgcccaccaccagtggatgaccaccgaggacatgctctccgtgtggaaccgcgtctggatcgaggagaacccctggatggaggacaagacgcacatcagctcctggggcgacgtgccgtacctgggcaagcgcgaggaccagtggtgcggcagcctgatcgggctcaccgcccgggccacctgggcgaccaacatccaggtggccatcaaccaggtccgccggctgatcggcaacgagaactacctggactacatgacctccatgaagcgcttcaagaacgagagcgaccccgagggggccctctggtga

SEQ ID NO: 8308 - RNA, 9879 nt, synthetic construct
  misc_feature 1..9879: note = derived and/or modified CDS sequence (opt1) from DENV-1__EU677176__SS-prME
  source 1..9879: mol_type = other RNA
tccgtgaccatgctgctcatgctgatgcccaccgccctggccttccacctcaccacccggggcggggagccccacatgatcgtgtccaagcaggagcggggcaagagcctgctgttcaagacctccgccggggtgaacatgtgcaccctcatcgccatggacctgggcgagctgtgcgaggacaccatgacctacaagtgcccccggatcaccgaggtggagcccgacgacgtggactgctggtgcaacaccaccgacacctgggtgacctacgggacctgcagccagacgggcgagcaccggcgcgacaagcggtccgtggccctcgcgccccacgtcggcctggggctggagacccgcgccgagacctggatgagctccgagggcgcgtggaagcagatccagaaggtggagacctgggccctccggcaccccgggttcacggtgatcgccctgttcctggcccacgcgatcggcaccagcatcacccagaaggggatcatcttcatcctcctgatgctggtcaccccctccatggccatgcgctgcgtgggcatcggcagccgggacttcgtggaggggctctccggcgccacgtgggtcgacgtggtgctggagcacgggagctgcgtcaccaccatggccaaggacaagcccaccctggacatcgagctcctgaagacggaggtgaccaaccccgccgtgctgcgcaagctctgcatcgaggcgaagatctccaacaccaccacggacagccggtgcccgacccagggcgaggccaccctggtcgaggagcaggacgccaacttcgtgtgccgccggaccttcgtggaccgcggctgggggaacggctgcgggctgttcggcaaggggtccctcatcacgtgcgccaagttcaagtgcgtcaccaagctggagggcaagatcgtgcagtacgagaacctgaagtacagcgtgatcgtcaccgtgcacaccggcgaccagcaccaggtcgggaacgagtccacggagcacggcaccaccgccaccatcacgccccaggcgcccacgagcgagatccagctcaccgactacggggccctgaccctggactgcagcccccggaccggcctcgacttcaacgagatggtgctgctgacgatgaaggagaagtcctggctcgtgcacaagcagtggttcctggacctgcccctcccctggaccagcggggcctccaccagccaggagacctggaaccgccaggacctgctggtcacgttcaagaccgcccacgccaagaagcaggaggtggtggtcctcggctcccaggagggcgcgatgcacaccgccctgaccggggccacggagatccagaccagcggcaccaccacgatcttcgccgggcacctgaagtgccggctcaagatggacaagctgaccctgaagggcatgtcctacgtgatgtgcaccgggctgttcaagctggagaaggaggtggccgagacccagcacggcacggtcctggtgcagatcaagtacgagggcaccgacgcgccctgcaagatccccttcagcacccaggacgagaagggggtgacccagaacggccgcctgatcacggccaacccgatcgtcaccgacaaggagaagcccgtgaacatcgaggccgagccgcccttcggggagtcctacatcgtgatcggcgccggcgagaaggcgctcaagctgagctggttcaagaaggggtccagcatcggcaagatgttcgaggccaccgcccgcggggcccgccggatggccatcctgggcgacaccgcgtgggacttcgggtccatcggcggcgtcttcacgagcgtggggaagctcgtgcaccagatcttcggcaccgcctacggggtcctgttctccggcgtgagctggaccatgaagatcgggatcggcgtgctgctcacctggctgggcctgaactcccgcagcacgtccctcagcatgacctgcatcgccgtcgggctggtgaccctgtacctcggcgtgatggtccaggccgactccgggtgcgtgatcaactggaagggccgcgagctgaagtgcgggagcggcatcttcgtgaccaacgaggtccacacgtggaccgagcagtacaagttccaggccgacagcccgaagcggctgtccgcggccatcggcaaggcctgggaggagggggtgtgcggcatccgcagcgccacccggctcgagaacatcatgtggcgccagatctccaacgagctgaaccacatcctgctcgagaacgacatgaagttcaccgtggtcgtgggggacgtggtcggcatcctggcccaggggaagaagatgatccggccccagcccatggagcacaagtacagctggaagtcctggggcaaggcgaagatcatcggcgccgacgtgcagaacaccacgttcatcatcgacgggcccaacaccccggagtgccccgacgaccagcgcgcctggaacatctgggaggtggaggactacggcttcgggatcttcaccaccaacatctggctgaagctccgggacagctacacgcaggtctgcgaccaccgcctgatgtccgccgcgatcaaggacagcaaggccgtgcacgccgacatgggctactggatcgagtccgagaagaacgagacctggaagctggcccgggccagcttcatcgaggtgaagacctgcatctggcccaagtcccacaccctctggagcaacggcgtcctggagtccgagatgatcatccccaagatctacgggggcccgatcagccagcacaactaccgccccgggtacttcacgcagaccgcgggcccctggcacctggggaagctcgagctggacttcgacctgtgcgagggcaccaccgtggtggtcgacgagcactgcggcaaccgggggccgtccctccgcacgaccaccgtgaccggcaagatcatccacgagtggtgctgccggagctgcacgctgccgcccctgcgcttcaagggggaggacggctgctggtacgggatggagatccggcccgtgaaggagaaggaggagaacctcgtcaagtccatggtgagcgccggcagcggcgaggtggactccttcagcctggggctgctctgcatctccatcatgatcgaggaggtcatgcgcagccggtggtcccgcaagatgctgatgaccggcaccctggccgtgttcttcctcctgatcatggggcagctgacctggaacgacctcatccggagctgcatcatggtgggcgccaacgcctccgaccgcatggggatgggcacgacctacctggcgctgatggccaccttcaagatgcgcccgatgttcgccgtcgggctcctgttccggcgcctgaccagccgggaggtgctcctgctgacgatcgggctctccctggtcgccagcgtggagctgcccaactccctcgaggagctgggcgacgggctggccatgggcatcatgatcctcaagctgctgaccgacttccagagctaccagctctgggcgaccctgctgtccctcaccttcatcaagacgaccttcagcctgcactacgcctggaagaccatggccatggtgctgtccatcgtcagcctcctgcccctgtgcctctccaccacgagccagaagaccacctggctgcccgtgctgctcggctccctggggtgcaagccgctgaccatgttcctcatcgccgagaacaagatctggggccgcaagagctggcccctgaacgaggggatcatggcggtgggcatcgtcagcatcctgctctccagcctgctgaagaacgacgtgcccctcgccgggcccctgatcgccggcggcatgctgatcgcctgctacgtgatctccgggagctccgccgacctcagcctggagaaggcggccgaggtctcctgggaggaggaggccgagcacagcggcgcctcccacaacatcctggtggaggtgcaggacgacgggacgatgaagatcaaggacgaggagcgggacgacaccctcaccatcctgctgaaggccaccctcctggcggtcagcggcgtgtacccgctgtccatccccgccaccctcttcgtgtggtacttctggcagaagaagaagcagcgcagcggggtcctgtgggacacgcccagcccgcccgaggtggagcgggccgtgctggacgacggcatctaccgcatcatgcagcggggcctgctcgggcgcagccaggtcggcgtgggggtgttccaggagaacgtcttccacaccatgtggcacgtgacccggggcgccgtgctgatgtaccaggggaagcgcctggagccctcctgggccagcgtcaagaaggacctcatctcctacggcggcgggtggcggctgcagggcagctggaacaccggggaggaggtccaggtgatcgcggtcgagcccggcaagaaccccaagaacgtgcagacggcccccgggaccttcaagacccccgagggcgaggtgggcgccatcgccctggacttcaagcccgggacctccggcagccccatcgtcaaccgcgaggggaagatcgtgggcctctacggcaacggggtggtcacgaccagcggcacctacgtgtccgccatcgcgcaggccaaggccagccaggaggggccgctgcccgagatcgaggacgaggtgttccggaagcgcaacctgaccatcatggacctccaccccggctccgggaagacgaagcggtacctgccggccatcgtccgcgaggcgatcaagcggaagctgcgcaccctcatcctggcccccacccgggtggtggccagcgagatggccgaggccctgaagggcatgcccatccgctaccagaccacggcggtcaagtccgagcacaccggccgcgagatcgtggacctcatgtgccacgccaccttcaccatgcggctgctgagccccgtgcgcgtcccgaactacaacatgatcatcatggacgaggcccacttcacggacccctccagcatcgccgcccgggggtacatctccacccgcgtgggcatgggggaggcggccgccatcttcatgaccgccacgccgcccggcagcgtggaggccttcccgcagtccaacgcggtcatccaggacgaggagcgggacatccccgagcgcagctggaactccgggtacgagtggatcacggacttccccggcaagaccgtgtggttcgtgcccagcatcaagtccggcaacgacatcgccaactgcctccggaagaacgggaagcgcgtcatccagctgagccggaagaccttcgacaccgagtaccagaagacgaagaacaacgactgggactacgtggtgaccaccgacatctccgagatgggcgccaacttccgcgccgaccgggtcatcgacccgcgccggtgcctgaagcccgtgatcctcaaggacgggcccgagcgcgtcatcctggcgggccccatgccggtgaccgtggccagcgccgcccagcggcgcgggcggatcggccgcaaccacaacaaggagggcgaccagtacatctacatggggcagcccctgaacaacgacgaggaccacgcccactggacggaggcgaagatgctcctggacaacatcaacacccccgagggcatcatccccgccctgttcgagccggagcgggagaagtccgccgccatcgacggggagtaccgcctccgcggcgaggcccggaagaccttcgtcgagctgatgcgccgcggggacctgcccgtgtggctcagctacaaggtggcgagcgagggcttccagtactccgaccgccggtggtgcttcgacggcgagcgcaacaaccaggtcctggaggagaacatggacgtggagatctggaccaaggagggggagcggaagaagctgcgcccccggtggctcgacgcccgcacgtacagcgaccccctggccctgcgggagttcaaggagttcgccgccggccgccggtccgtgagcggggacctcatcctggagatcggcaagctgccgcagcacctcacccagcgcgcgcagaacgccctggacaacctggtcatgctccacaactccgagcagggcgggcgggcctaccgccacgccatggaggagctgcccgacaccatcgagaccctgatgctcctggcgctgatcgccgtgctcacgggcggggtgaccctgttcttcctgagcggccgggggctcggcaagacctccatcggcctgctgtgcgtcatggccagctccgccctcctgtggatggccagcgtggagccccactggatcgcggcctccatcatcctggagttcttcctcatggtgctgctgatccccgagccggaccgccagcggacgccccaggacaaccagctcgcctacgtcgtgatcgggctgctgttcatgatcctcaccgtggccgccaacgagatgggcctgctggagacgaccaagaaggacctcgggatcggccacgtcgcggtggagaaccaccaccacgccaccatgctggacgtggacctgcaccccgccagcgcctggaccctctacgccgtcgcgacgaccatcatcaccccgatgatgcgccacaccatcgagaacacgaccgccaacatctccctgaccgccatcgccaaccaggccgcgatcctgatggggctcgacaagggctggcccatcagcaagatggacatcggcgtgcccctgctggccctcgggtgctactcccaggtgaaccccctgaccctgacggccgccgtcctcatgctggtggcgcactacgccatcatcggcccggggctgcaggccaaggccacccgggaggcccagaagcgcaccgcggccggcatcatgaagaaccccaccgtggacgggatcgtcgccatcgacctcgaccccgtggtgtacgacgccaagttcgagaagcagctgggccagatcatgctgctcatcctgtgcacgagccagatcctgctcatgcgcaccacctgggccctgtgcgagtccatcaccctggcgacgggccccctcaccaccctgtgggaggggagcccgggcaagttctggaacaccacgatcgccgtctccatggccaacatcttccgggggagctacctggccggcgccggcctcgcgttcagcctgatgaagtccctcgggggcgggcgccgggggaccggggcccagggcgagaccctcggcgagaagtggaagcgccagctgaaccagctgagcaagtccgagttcaacacctacaagcggagcgggatcatggaggtggaccgctccgaggccaaggagggcctccggcgcggggagacgaccaagcacgccgtgagccggggcaccgcgaagctgcgctggttcgtcgagcggaacctggtgaagcccgaggggaaggtgatcgacctgggctgcggccgcgggggctggtcctactactgcgccgggctcaagaaggtcaccgaggtgaagggctacacgaagggcgggcccggccacgaggagcccatcccgatggccacctacgggtggaacctggtgaagctgcacagcggcaaggacgtcttcttcatcccgcccgagaagtgcgacaccctcctgtgcgacatcggggagtccagccccaacccgaccatcgaggagggccggacgctgcgcgtgctcaagatggtggagccctggctgcgggggaaccagttctgcatcaagatcctgaacccctacatgccctccgtcgtggagaccctcgagcagatgcagcgcaagcacggcggcatgctggtgcggaacccgctgagccgcaactccacccacgagatgtactgggtcagctgcgggaccggcaacatcgtgtccgccgtgaacatgaccagccggatgctcctgaaccgcttcacgatggcccaccgcaagcccacctacgagcgggacgtcgacctgggggcgggcacccgccacgtggccgtggagcccgaggtcgccaacctcgacatcatcggccagcggatcgagaacatcaagcacgagcacaagtccacctggcactacgacgaggacaacccctacaagacgtgggcctaccacgggagctacgaggtgaagccgtccggcagcgccagctccatggtcaacggggtggtgaagctgctgaccaagccctgggacgtcatccccatggtgacccagatcgcgatgaccgacacgacccccttcggccagcagcgcgtgttcaaggagaaggtcgacacccggaccccgaaggccaagcgcgggacggcccagatcatggaggtgaccgcccggtggctctggggcttcctgagccgcaacaagaagccccggatctgcacccgcgaggagttcacccggaaggtgcgctccaacgccgcgatcggcgccgtcttcgtggacgagaaccagtggaacagcgccaaggaggccgtggaggacgagcggttctgggacctggtccaccgcgagcgggagctccacaagcaggggaagtgcgcgacgtgcgtgtacaacatgatgggcaagcgcgagaagaagctgggggagttcggcaaggccaaggggtcccgggccatctggtacatgtggctgggcgcccgcttcctcgagttcgaggccctgggcttcatgaacgaggaccactggttcagccgggagaactccctgagcggggtggagggcgaggggctccacaagctgggctacatcctgcgcgacatctccaagatccccgggggcaacatgtacgcggacgacaccgccggctgggacacccggatcaccgaggacgacctccagaacgaggccaagatcacggacatcatggagccggagcacgccctgctggccaccagcatcttcaagctcacctaccagaacaaggtcgtgcgcgtgcagcgccccgcgcggaacgggaccgtcatggacgtgatctcccgccgggaccagcgcggcagcggccaggtgggcacgtacggcctgaacaccttcaccaacatggaggcccagctgatccggcagatggagtccgagcgcatcttcagcccctccgagctcgagacccccaacctggccgagcgggtcctggactggctcgagaagcacggggtggagcgcctgaagcggatggccatcagcggcgacgactgcgtggtcaagccgatcgacgaccgcttcgccacggcgctgtccgccctcaacgacatggggaaggtgcggaaggacatcccccagtgggagcccagcaagggctggaacgactggcagcaggtccccttctgcagccaccacttccaccagctgatcatgaaggacgggcgcgagatcgtcgtgccgtgccggaaccaggacgagctggtgggccgcgcccgggtctcccagggcgccgggtggagcctccgcgagaccgcctgcctgggcaagtcctacgcgcagatgtggcagctgatgtacttccaccggcgcgacctccggctggccgccaacgccatctgcagcgcggtgcccgtggactgggtccccacctcccgcaccacgtggagcatccacgcccaccaccagtggatgaccaccgaggacatgctgtccgtgtggaaccgcgtgtggatcgaggagaacccctggatggaggacaagacccacatcagctcctggggcgacgtcccgtacctcggcaagcgggaggaccagtggtgcgggagcctgatcggcctgacggcccgcgccacctgggccaccaacatccaggtggcgatcaaccaggtgcggcgcctcatcggcaacgagaactacctggactacatgacctccatgaagcggttcaagaacgacagcgaccccgagggggccctgtggtga

SEQ ID NO: 8309 - RNA, 9879 nt, synthetic construct
  misc_feature 1..9879: note = derived and/or modified CDS sequence (opt1) from DENV-1__EU726780__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagacctccgccggggtgaacatgtgcaccctcatcgccatggacctgggcgagctgtgcgaggacaccatgacctacaagtgcccccggatcaccgagaccgagcccgacgacgtggactgctggtgcaacgccaccgacacctgggtgacctacgggacctgcagccagacgggcgagcaccggcgggacaagcggtccgtggccctcgcgccccacgtgggcctggggctggagacccgcaccgagacctggatgagctccgagggcgcctggaagcagatccagcgggtggagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcgtgatcggcgccggcgagaagacgctgaagctcagctggttcaagaaggggtccagcatcggcaagatgttcgaggcgaccgcccgcggggcccggcgcatggccatcctgggcgacaccgcctgggacttcgggtccatcggcggcgtgttcaccagcgtcgggaagctggtgcaccagatcttcggcacggcgtacggggtcctgttctccggcgtcagctggaccatgaagatcgggatcggcgtgctgctgacctggctcggcctgaactcccgcagcacctccctgagcatgacgtgcatcgccgtggggctcgtcaccctgtacctgggcgtgatggtgcaggccgactccgggtgcgtcatcaactggaagggccgggagctcaagtgcgggagcggcatcttcgtgaccaacgaggtgcacacctggaccgagcagtacaagttccaggccgacagcccgaagcgcctgtccgccgcgatcggcaaggcctgggaggagggggtctgcggcatccggagcgccacgcgcctggagaacatcatgtggaagcagatctccaacgagctcaaccacatcctgctggagaacgacatgaagttcaccgtggtggtcggggacgtggccggcatcctcgcccaggggaagaagatgatccggccccagcccatggagtacaagtacagctggaagtcctggggcaaggcgaagatcatcggcgccgacgtgcagaacaccaccttcatcatcgacgggcccaacacgccggagtgccccgacgaccagcgcgcctggaacatctgggaggtcgaggactacggcttcgggatcttcaccaccaacatctggctgaagctgcgggacagctacacccaggtgtgcgaccaccgcctcatgtccgccgcgatcaaggacagcaaggccgtgcacgccgacatgggctactggatcgagtccgagaagaacgagacgtggaagctggcccgggccagcttcatcgaggtcaagacctgcatctggcccaagtcccacaccctgtggagcaacggcgtgctcgagtccgagatgatcatccccaagatctacgggggcccgatcagccagcacaactaccgccccgggtacttcacccagacggcgggcccctggcacctggggaagctggagctcgacttcgacctgtgcgagggcaccaccgtggtcgtggacgagcactgcggcaaccgggggccgtccctgcgcaccacgaccgtgaccggcaagatcatccacgagtggtgctgccggagctgcaccctgccgcccctccgcttccgcggggaggacggctgctggtacgggatggagatccgccccgtcaaggagaaggaggagaacctggtgaagtccatggtgagcgccggcagcggcgaggtcgactccttcagcctcgggctgctgtgcatctccatcatgatcgaggaggtgatgcggagccgctggtcccggaagatgctcatgacgggcaccctggccgtgttcttcctgctcatcatggggcagctgacctggaacgacctgatccgcctctgcatcatggtcggcgccaacgccagcgaccgcatggggatgggcaccacgtacctggcgctgatggccaccttcaagatgcggccgatgttcgccgtgggcctcctgttccgccggctgacctcccgcgaggtgctcctgctgaccatcgggctcagcctggtcgcctccgtggagctgcccaacagcctcgaggagctgggcgacgggctggccatgggcatcatgatcctcaagctgctgacggacttccagtcccaccagctctgggtcaccctgctgagcctcaccttcatcaagaccacgttctccctgcactacgcgtggaagaccatggccatggtgctgagcatcgtgtccctcttccccctgtgcctgagcaccacctcccagaagacgacctggctccccgtcctgctgggcagcctcgggtgcaagccgctgaccatgttcctgatcgccgagaacaagatctggggccggcgctcctggcccctcaacgaggggatcatggccgtgggcatcgtgagcatcctgctgagctccctcctgaagaacgacgtccccctggcggggcccctcatcgccggcggcatgctgatcgcctgctacgtgatcagcgggtccagcgccgacctgtccctcgagaaggccgcggaggtgagctgggaggaggaggccgagcactccggcgccagccacaacatcctggtcgaggtgcaggacgacgggaccatgaagatcaaggacgaggagcgggacgacaccctgacgatcctcctgaaggccaccctgctcgccgtgtccggcgtctacccgctgagcatccccgcgaccctgttcgtgtggtacttctggcagaagaagaagcagcgctccggggtgctctgggacacccccagcccgcccgaggtcgagcgggccgtgctggacgacggcatctaccgcatcatgcagcggggcctgctggggcgctcccaggtgggcgtcggggtgttccaggagaacgtgttccacacgatgtggcacgtcacccggggcgccgtgctcatgtaccaggggaagcgcctggagcccagctgggcctccgtgaagaaggacctgatcagctacggcggcgggtggcggctccagggctcctggaacaccggggaggaggtccaggtgatcgccgtggagcccggcaagaaccccaagaacgtccagaccgcgcccgggacgttcaagacccccgagggcgaggtgggcgccatcgccctggacttcaagcccgggaccagcggctcccccatcgtgaaccgcgaggggaagatcgtcggcctgtacggcaacggggtggtgaccacgagcggcacctacgtcagcgccatcgcccaggcgaaggcctcccaggaggggccgctccccgagatcgaggacgaggtgttccggaagcgcaacctgaccatcatggacctgcaccccggcagcgggaagacccggcgctacctcccggccatcgtgcgggaggccatcaagcgcaagctgcgcacgctgatcctcgcgcccacccgggtcgtggcctccgagatggccgaggccctgaagggcatgcccatccgctaccagaccaccgccgtcaagagcgagcacacgggcaaggagatcgtcgacctgatgtgccacgcgaccttcaccatgcggctcctgtcccccgtgcgcgtgccgaactacaacatgatcatcatggacgaggcccacttcaccgaccccagctccatcgccgcccgggggtacatcagcacgcgcgtcggcatgggggaggccgcggccatcttcatgaccgccacgccgcccggctccgtggaggccttcccgcagagcaacgccgtgatccaggacgaggagcgggacatccccgagcgctcctggaacagcgggtacgagtggatcaccgacttccccggcaagacggtctggttcgtgccctccatcaagagcggcaacgacatcgcgaactgcctgcggaagaacgggaagcgcgtgatccagctctcccggaagaccttcgacaccgagtaccagaagaccaagaacaacgactgggactacgtcgtgacgaccgacatcagcgagatgggcgccaacttccgcgccgaccgggtgatcgacccgcgccggtgcctgaagcccgtcatcctgaaggacgggcccgagcgcgtgatcctcgccggccccatgccggtcaccgtggcgtccgccgcccagcggcgcgggcggatcggccgcaaccacaacaaggagggcgaccagtacatctacatggggcagcccctgaacaacgacgaggaccacgcccactggaccgaggccaagatgctgctcgacaacatcaacacgcccgagggcatcatccccgcgctgttcgagccggagcgcgagaagtccgccgccatcgacggggagtaccggctgcgcggcgaggcccggaagaccttcgtggagctcatgcgccgcggggacctgcccgtctggctgtcctacaaggtggccagcgagggcttccagtacagcgaccgccggtggtgcttcgacggcgagcgcaacaaccaggtgctcgaggagaacatggacgtcgagatctggaccaaggagggggagcggaagaagctgcgcccccggtggctggacgcgcgcacctactccgaccccctcgccctgcgggagttcaaggagttcgccgccggccgccggagcgtgtccggggacctgatcagcgagatcggcaagctcccgcagcacctgacgcagcgcgcccagaacgcgctggacaacctcgtgatgctgcacaactccgagcagggcgggcgggcctaccgccacgccatggaggagctgcccgacaccatcgagaccctcatgctgctggccctcatcgcggtcctgaccggcggggtgaccctgttcttcctcagcggccgggggctgggcaagacgtccatcggcctgctctgcgtgatggccagctccgtcctgctgtggatggccagcgtggagccccactggatcgccgcctccatcatcctcgagttcttcctgatggtgctgctcatccccgagccggaccgccagcggacgccccaggacaaccagctggcgtacgtcgtgatcgggctcctcttcatgatcctgaccgtggccgccaacgagatgggcctgctcgagaccacgaagaaggacctggggatcggccacgtcgccgtggagaaccaccaccacgccgcgatgctggacgtggacctccaccccgccagcgcctggaccctgtacgccgtcgccaccaccatcatcacgccgatgatgcgccacaccatcgagaacaccaccgcgaacatctccctgacggccatcgccaaccaggccgccatcctcatggggctggacaagggctggcccatcagcaagatggacatcggcgtgcccctgctcgcgctggggtgctactcccaggtgaaccccctgaccctcaccgccgccgtcctgatgctggtggcccactacgcgatcatcggcccggggctccaggccaaggccacccgcgaggcccagaagcggacggccgcgggcatcatgaagaaccccaccgtggacgggatcgtcgccatcgacctggaccccgtggtgtacgacgccaagttcgagaagcagctgggccagatcatgctcctgatcctgtgcaccagccagatcctcctgatgcgcaccacgtgggccctgtgcgagtccatcaccctcgccaccggccccctgaccacgctgtgggaggggagcccgggcaagttctggaacaccaccatcgcggtctccatggccaacatcttccgggggagctacctcgccggcgccggcctggccttcagcctgatgaagtccctcgggggcgggcgccggggcaccggggcgcagggcgagacgctgggcgagaagtggaagcgccagctgaaccagctcagcaagtccgagttcaacacctacaagcggagcgggatcatggaggtggaccgctccgaggccaaggagggcctgaagcgcggggagaccaccaagcacgccgtgagccgcggcacggccaagctgcggtggttcgtcgagcgcaacctcgtgaagcccgaggggaaggtgatcgacctgggctgcggccgcggcgggtggtcctactactgcgcggggctgaagaaggtcaccgaggtgaaggggtacaccaagggcgggcccggccacgaggagcccatcccgatggccacctacgggtggaacctggtgaagctccacagcggcaaggacgtcttcttcatcccgcccgagaagtgcgacacgctgctgtgcgacatcggggagtccagccccaacccgaccatcgaggagggccgcaccctccgggtgctgaagatggtggagccctggctgcgcgggaaccagttctgcatcaagatcctcaacccctacatgccctccgtcgtggagaccctggagcagatgcagcggaagcacggcggcatgctggtgcgcaacccgctcagccggaactccacccacgagatgtactgggtcagctgcgggacgggcaacatcgtgtccgccgtgaacatgaccagccgcatgctgctgaaccgcttcaccatggcccaccggaagcccacctacgagcgcgacgtcgacctcggggccggcacgcggcacgtggcggtggagcccgaggtcgccaacctggacatcatcggccagcgcatcgagaacatcaagcacgagcacaagtccacctggcactacgacgaggacaacccctacaagacctgggcctaccacgggagctacgaggtgaagccgtccggcagcgccagctccatggtcaacggggtggtgaagctgctcaccaagccctgggacgtcatccccatggtgacgcagatcgccatgaccgacaccacccccttcggccagcagcgggtgttcaaggagaaggtcgacacgcgcaccccgaaggcgaagcgggggaccgcccagatcatggaggtgaccgccaagtggctgtggggcttcctgagccgcaacaagaagccccggatctgcacgcgcgaggagttcacccggaaggtgcgctccaacgccgccatcggcgcggtcttcgtggacgagaaccagtggaacagcgccaaggaggccgtggaggacgagcggttctgggacctcgtccaccgcgagcgggagctgcacaagcaggggaagtgcgcgacctgcgtgtacaacatgatgggcaagcgcgagaagaagctgggggagttcggcaaggcgaaggggtcccgggccatctggtacatgtggctcggcgcccgcttcctggagttcgaggccctgggcttcatgaacgaggaccactggttcagccgggagaactccctcagcggggtggagggcgaggggctgcacaagctgggctacatcctccgcgacatctccaagatccccgggggcaacatgtacgccgacgacaccgcgggctgggacacgcggatcaccgaggacgacctgcagaacgaggcccgcatcaccgacatcatggagccggagcacgccctgctcgccaagagcatcttcaagctgacctaccagaacaaggtcgtgcgcgtgcagcggcccgccaagaacgggacggtcatggacgtgatctcccgccgggaccagcgcggcagcggccaggtggggacctacggcctgaacaccttcaccaacatggaggcgcagctcatccggcagatggagtccgaggggatcttcagcccctccgagctggagacgcccaacctggccgagcgcgtcctcgactggctggagaagtacggcatcgagcggctgaagcgcatggccatcagcggggacgactgcgtggtgaagccgatcgacgaccggttcgccaccgccctcaccgcgctgaacgacatgggcaaggtccgcaaggacatcccccagtgggagccctccaaggggtggaacgactggcagcaggtccccttctgcagccaccacttccaccagctgatcatgaaggacggccgggagatcgtggtcccgtgccgcaaccaggacgagctcgtgggccgggcccgcgtgagccagggggccggctggtccctgcgggagaccgcctgcctgggcaagagctacgcccagatgtggcagctcatgtacttccaccgccgggacctgcgcctggcggccaacgccatctgctccgccgtccccgtggactggatccccacgagccggaccacctggtccatccacgcgcaccaccagtggatgaccacggaggacatgctcagcgtgtggaaccgcgtctggatcgaggagaacccctggatggaggacaagacccacatctccagctggggcgacgtgccgtacctggggaagcgcgaggaccagtggtgcggctccctgatcggcctcaccgcccgggccacctgggccaccaacatccaggtggccatcaaccaggtccgccggctgatcgggaacgagaactacctggactacatgacgagcatgaagcgcttcaagaacgagtccgaccccgagggcgcgctctggtga

SEQ ID NO: 8310 - RNA, 9879 nt, synthetic construct
  misc_feature 1..9879: note = derived and/or modified CDS sequence (opt1) from DENV-1__EU726781__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagaccagcgcgggggtgaacatgtgcaccctcatcgccatggacctgggcgagttctgcgaggacacgatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagaccgtccagtacgagaacctgaagtacagcgtgatcgtgaccgtccacacgggcgaccagcaccaggtggggaacgagtccaccgagcacggcaccaccgcgaccatcacgccccaggcccccagcaccgagatccagctgaccgactacggggccctcaccctggactgcagcccccggacgggcctggacttcaacgagatggtcctcctgaccatgaaggagaagtcctggctggtgcacaagcagtggttcctcgacctgccgctgccctggaccagcggggcctccaccagccaggagacgtggaaccggaaggacctcctggtgaccttcaagaccgcccacgcgaagaagcaggaggtcgtggtgctgggctcccaggagggcgccatgcacaccgccctcacgggggccaccgagatccagaccagcggcaccacgaccatcttcgccgggcacctgaagtgccgcctgaagatggacaagctcaccctgaagggcatgtcctacgtcatgtgcaccgggagcttcaagctggagaaggaggtggcggagacgcagcacggcaccgtgctcgtccagatcaagtacgagggcaccgacgccccctgcaagatccccttctccacccaggacgagaagggggtgacgcagaacggccggctgatcaccgccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacacggcctgggacttcgggagcatcggcggcgtgttcacctccgtcgggaagctggtgcaccagatcttcggcaccgcctacggggtgctgttcagcggcgtctcctggaccatgaagatcgggatcggcgtgctcctgacgtggctgggcctcaacagccgctccaccagcctgtccatgacctgcatcgtggtcgggctggtgaccctctacctgggcgtgatggtccaggccgacagcgggtgcgtgatcaactggaagggccgggagctgaagtgcgggagcggcatcttcgtgacgaacgaggtccacacctggaccgagcagtacaagttccaggccgactccccgaagcgcctcagcgcggccatcggcaaggcctgggaggagggggtgtgcggcatccggtccgccacccgcctggagaacatcatgtggaagcagatcagcaacgagctgaaccacatcctcctggagaacgacatgaagttcaccgtggtcgtgggggacgtggccggcatcctggcgcaggggaagaagatgatccggccccagcccatggagtacaagtactcctggaagtcctggggcaaggccaagatcatcggcgccgacgtccagaacacgaccttcatcatcgacgggcccaacaccccggagtgccccgacgaccagcgcgcctggaacatctgggaggtggaggactacggcttcgggatcttcaccacgaacatctggctcaagctgcgggactcctacacccaggtgtgcgaccaccgcctgatgagcgcggccatcaaggactccaaggccgtccacgccgacatgggctactggatcgagagcgagaagaacgagacctggaagctcgcccgggcgtccttcatcgaggtgaagacctgcatctggcccaagagccacacgctgtggtccaacggcgtgctggagagcgagatgatcatccccaagaactacgggggcccgatctcccagcacaactaccgccccgggtacttcacccagaccgccggcccctggcacctcgggaagctggagctggacttcgacctctgcgagggcaccacggtcgtggtggacgagcactgcggcaaccgggggccgagcctgcgcaccaccaccgtcacgggcaagatcatccacgagtggtgctgccggtcctgcaccctgccgcccctgcgcttcaagggggaggacggctgctggtacgggatggagatccggcccgtgaaggagaaggaggagaacctggtcaagagcatggtcagcgccggctccggcgaggtggacagcttctccctggggctcctgtgcatcagcatcatgatcgaggaggtgatgcgctcccggtggagccgcaagatgctgatgaccggcaccctcgccgtcctgttcctgctcatcatggggcagctgacgtggaacgacctgatccggctctgcatcatggtgggcgccaacgcgtccgaccgcatggggatgggcaccacctacctggccctgatggccaccttcaagatgcgcccgatgttcgccgtgggcctcctgttccggcgcctgacgagccgggaggtcctcctgctgaccatcgggctctccctggtggccagcgtcgagctgcccaactccctcgaggagctgggcgacgggctggcgatgggcatcatgatcctcaagctgctgaccgacttccagagccaccagctctgggccaccctgctgtccctcacgttcatcaagaccaccttcagcctgcactacgcctggaagaccatggccatggtgctgtccatcgtgagcctcttccccctgtgcctgtccacgaccagccagaagaccacctggctccccgtcctgctgggctccctcgggtgcaagccgctgacgatgttcctgatcgcggagaacaagatctggggccgcaagagctggcccctcaacgaggggatcatggccgtgggcatcgtgagcatcctgctgtccagcctcctgaagaacgacgtccccctggccgggcccctcatcgccggcggcatgctgatcgcctgctacgtgatctccgggagctccgcggacctgagcctcgagaaggccgccgaggtgtcctgggaggaggaggccgagcacagcggcgcctcccacaacatcctggtcgaggtgcaggacgacgggaccatgaagatcaaggacgaggagcgggacgacaccctgaccatcctcctgaaggcgaccctgctcgccgtgagcggcgtctacccgctgtccatccccgccacgctgttcgtgtggtacttctggcagaagaagaagcagcgcagcggggtgctctgggacacccccagcccgcccgaggtcgagcgggccgtgctggacgacggcatctaccgcatcatgcagcggggcctgctggggcgcagccaggtgggcgtcggggtgttccaggagaacgtgttccacaccatgtggcacgtcacccggggcgccgtgctcatgtaccaggggaagcgcctggagccctcctgggcgagcgtgaagaaggacctgatctcctacggcggcgggtggcggctccagggcagctggaacacgggggaggaggtccaggtgatcgccgtggagcccggcaagaaccccaagaacgtccagaccgcccccgggaccttcaagacctccgagggcgaggtgggcgccatcgccctggacttcaagcccgggacgagcggcagccccatcgtgaaccgcgaggggaagatcgtcggcctgtacggcaacggggtggtgaccacctccggcacctacgtcagcgcgatcgcccaggccaaggcctcccaggaggggcccctcccggagatcgaggacgaggtgttccggaagcgcaacctgacgatcatggacctgcaccccggcagcgggaagacccggcgctacctccccgcgatcgtgcgggaggccatcaagcgcaagctgcggaccctgatcctcgccccgacccgcgtcgtggcctccgagatggccgaggcgctgaagggcatgcccatccgctaccagacgaccgccgtcaagagcgagcacaccggcaaggagatcgtcgacctgatgtgccacgccaccttcacgatgcggctcctgtcccccgtgcgcgtgcccaactacaacatgatcatcatggacgaggcccacttcaccgacccgagctccatcgccgcgcgggggtacatcagcacccgcgtcggcatgggggaggccgccgccatcttcatgaccgccacgccgcccggctccgtggaggcgttcccccagagcaacgccgtgatccaggacgaggagcgggacatcccggagcgctcctggaacagcgggtacgagtggatcaccgacttccccggcaagaccgtctggttcgtgccctccatcaagagcggcaacgacatcgccaactgcctgcggaagaacgggaagcgcgtgatccagctctcccggaagaccttcgacacggagtaccagaagaccaagaacaacgactgggactacgtcgtgaccaccgacatcagcgagatgggcgccaacttccgcgcggaccgggtgatcgacccccgccggtgcctgaagccggtcatcctgaaggacgggcccgagcgcgtgatcctcgccggccccatgcccgtcacggtggcctccgccgcccagcggcgcgggcggatcggccgcaaccacaacaaggagggcgaccagtacatctacatggggcagccgctgaacaacgacgaggaccacgcgcactggaccgaggccaagatgctgctcgacaacatcaacacccccgagggcatcatccccgccctgttcgagcccgagcgggagaagtccgccgccatcgacggggagtaccgcctgcgcggcgaggcgcggaagaccttcgtggagctcatgcgccgcggggacctgccggtctggctgagctacaaggtggcctccgagggcttccagtacagcgaccgccggtggtgcttcgacggcgagcgcaacaaccaggtgctcgaggagaacatggacgtcgagatctggacgaaggagggggagcggaagaagctgcgcccccggtggctggacgcccgcacctactccgaccccctcgccctgcgggagttcaaggagttcgccgcgggccgccggagcgtgtccggggacctgatcctcgagatcggcaagctgccccagcacctgacccagcgcgcccagaacgccctcgacaacctggtgatgctgcacaacagcgagcagggcgggcgggcctaccgccacgcgatggaggagctcccggacaccatcgagacgctgatgctgctcgccctgatcgccgtcctgaccggcggggtgaccctcttcttcctgtccggccgggggctgggcaagaccagcatcggcctcctgtgcgtgatggcctccagcgtcctgctctggatggcctccgtggagccccactggatcgcggccagcatcatcctggagttcttcctgatggtgctcctgatccccgagcccgaccgccagcggaccccgcaggacaaccagctggcctacgtcgtgatcgggctcctgttcatgatcctgacggtggccgccaacgagatgggcctcctggagaccaccaagaaggacctggggatcggccacgtcgcggtggagaaccaccaccacgccgccatgctcgacgtggacctgcaccccgcctccgcctggaccctgtacgcggtcgccacgaccatcatcacccccatgatgcgccacaccatcgagaacacgaccgccaacatcagcctcaccgccatcgccaaccaggcggccatcctgatggggctggacaagggctggccgatctccaagatggacatcggcgtgcccctcctggccctggggtgctacagccaggtgaaccccctcaccctgacggccgcggtcctgatgctcgtggcccactacgccatcatcggccccgggctgcaggccaaggccacccgggaggcgcagaagcgcaccgccgccggcatcatgaagaacccgaccgtggacgggatcgtcgccatcgacctggaccccgtggtgtacgacgccaagttcgagaagcagctcggccagatcatgctgctgatcctctgcacgtcccagatcctgctgatgcgcaccacctgggcgctctgcgagagcatcaccctggccacgggccccctgaccaccctctgggaggggtcccccggcaagttctggaacaccacgatcgccgtcagcatggccaacatcttccgggggagctacctggccggcgcgggcctggccttctccctcatgaagtccctcgggggcgggcgccgggggaccggggcccagggcgagaccctgggcgagaagtggaagcgccagctcaaccagctgtccaagagcgagttcaacacctacaagcggtccgggatcatggaggtggaccgcagcgaggccaaggagggcctgaagcgcggggagacgaccaagcacgcggtgtcccgcggcaccgccaagctccggtggttcgtcgagcgcaacctggtgaagccggaggggaaggtgatcgacctgggctgcggccgcggcgggtggagctactactgcgccgggctgaagaaggtcaccgaggtgaaggggtacacgaagggcgggcccggccacgaggagcccatccccatggccacctacgggtggaacctcgtgaagctgcactccggcaaggacgtcttcttcatcccgcccgagaagtgcgacaccctgctctgcgacatcggggagagctcccccaaccccaccatcgaggagggccgcacgctgcgggtgctgaagatggtggagccgtggctccgcgggaaccagttctgcatcaagatcctgaacccctacatgcccagcgtcgtggagaccctggagcagatgcagcggaagcacggcggcatgctcgtgcgcaaccccctgtcccggaacagcacccacgagatgtactgggtctcctgcgggaccggcaacatcgtgagcgccgtgaacatgacctcccgcatgctgctcaaccggttcacgatggcgcaccgcaagccgacctacgagcgcgacgtcgacctgggggccggcacccggcacgtggccgtggagcccgaggtcgccaacctggacatcatcggccagcgcatcgagaacatcaagcacgagcacaagagcacctggcactacgacgaggacaacccctacaagacgtgggcctaccacgggtcctacgaggtgaagcccagcggcagcgcgtccagcatggtcaacggggtggtgaagctcctgaccaagccgtgggacgtcatccccatggtgacccagatcgccatgaccgacacgacccccttcggccagcagcgggtgttcaaggagaaggtcgacacccgcacccccaaggccaagcgggggacggcccagatcatggaggtgaccgccaagtggctgtggggcttcctctcccgcaacaagaagccgcggatctgcacccgcgaggagttcacccggaaggtgcgcagcaacgcggccatcggcgccgtcttcgtggacgagaaccagtggaactccgccaaggaggcggtggaggacgagcggttctgggacctggtccaccgcgagcgggagctgcacaagcaggggaagtgcgccacgtgcgtgtacaacatgatgggcaagcgcgagaagaagctcggggagttcggcaaggccaaggggagccgggccatctggtacatgtggctgggcgcccgcttcctggagttcgaggcgctcggcttcatgaacgaggaccactggttctcccgggagaacagcctgtccggggtggagggcgaggggctgcacaagctcggctacatcctgcgcgacatcagcaagatccccgggggcaacatgtacgccgacgacaccgccggctgggacacccggatcaccgaggacgacctgcagaacgaggccaagatcacggacatcatggagcccgagcacgccctcctggcgaagtccatcttcaagctgacctaccagaacaaggtcgtgcgcgtgcagcggccggccaagaacgggaccgtcatggacgtgatcagccgccgcgaccagcggggctccggccaggtgggcacctacggcctcaacacgttcaccaacatggaggcccagctgatccgccagatggagagcgaggggatcttctcccccagcgagctggagacccccaacctcgccggccgggtcctggactggctggagaagcacggggtggagcgcctcaagcggatggccatctccggcgacgactgcgtggtcaagcccatcgacgaccgcttcgcgaccgccctgacggccctgaacgacatggggaaggtgcggaaggacatcccgcagtgggagcccagcaagggctggaacgactggcagcaggtccccttctgcagccaccacttccaccagctcatcatgaaggacggccgcgagatcgtcgtgccctgccggaaccaggacgagctggtggggcgcgcccgggtctcccagggcgccgggtggagcctgcgcgagaccgcgtgcctcggcaagtcctacgcccagatgtggcagctgatgtacttccaccggcgcgacctgcggctcgccgccaacgcgatctgcagcgccgtgccggtggactgggtccccacctcccgcaccacgtggagcatccacgcccaccaccagtggatgaccaccgaggacatgctgtccgtgtggaaccgggtgtggatcgaggagaacccctggatggaggacaagacccacatcagctcctggggcgacgtcccctacctgggcaagcgcgaggaccagtggtgcggcagcctcatcgggctgacggcccgggccacctgggcgaccaacatccaggtggccatcaaccaggtgcgccgcctgatcggcaacgagaactacctcgactacatgacctccatgaagcggttcaagaacgagagcgacccggagggggccctgtggtga

SEQ ID NO: 8311 - RNA, 9879 nt, synthetic construct
  misc_feature 1..9879: note = derived and/or modified CDS sequence (opt1) from DENV-1__EU726782__SS-prME
  source 1..9879: mol_type = other RNA
agcgtgaccatgctgctgatgctgatgcccaccgccctggccttccacctcaccacccggggcggggagccccacatgatcgtgagcaagcaggagcggggcaagagcctgctgttcaagacctccgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtcacctacgggacctgcagccagacgggcgagcaccggcgggacaagcggtccgtggccctcgcgccccacgtgggcctggggctggagacccgcaccgagacctggatgagctccgagggcgcgtggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcctgacgcaggacgagaagggggtgacccagaacggccggctgatcaccgccaacccgatcgtgaccgacaaggagaagcccgtcaacatcgaggccgagccgcccttcggggagagctacatcatcatcggcgccggcgagaaggcgctcaagctgtcctggttcaagaaggggagctccatcggcaagatgttcgaggccacggcccgcggggcccggcgcatggccatcctgggcgacaccgcgtgggacttcgggagcatcggcggcgtgttcacctccgtggggaagctcgtccaccagatcttcggcaccgcctacggggtgctgttcagcggcgtgtcctggacgatgaagatcgggatcggcgtcctgctcacctggctgggcctgaacagccgctccaccagcctctccatgacctgcatcgccgtggggctggtgacgctgtacctcggcgtcatggtgcaggccgacagcgggtgcgtgatcaactggaagggccgggagctgaagtgcgggtccggcatcttcgtcaccaacgaggtgcacacctggaccgagcagtacaagttccaggccgacagcccgaagcgcctgagcgcggccatcggcaaggcctgggaggagggggtgtgcggcatccggtccgccacccgcctcgagaacatcatgtggaagcagatcagcaacgagctgaaccacatcctgctcgagaacgacatgaagttcacggtcgtggtgggggacgtcgccggcatcctggcgcaggggaagaagatgatccggccccagcccatggagtacaagtactcctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctgaagctccgggactcctacacccaggtctgcgaccaccgcctgatgagcgcggccatcaaggactccaaggccgtgcacgccgacatgggctactggatcgagagcgagaagaacgagacctggaagctggcccgggcgtccttcatcgaggtgaagacgtgcatctggcccaagagccacaccctctggtccaacggcgtcctggagagcgagatgatcatccccaagatctacgggggcccgatctcccagcacaactaccgccccgggtacttcacccagaccgccggcccctggcacctggggaagctcgagctggacttcgacctgtgcgagggcacgaccgtggtggtcgacgagcactgcggcaaccgggggccgagcctccgcaccaccacggtgaccggcaagatcatccacgagtggtgctgccggtcctgcaccctgccgcccctgcgcttccgcggggaggacggctgctggtacgggatggagatccgccccgtgaaggagaaggaggagaacctcgtcaagagcatggtgtccgccggcagcggcgaggtggacagcttctccctggggctgctctgcatcagcatcatcatcgaggaggtcatgcggtcccgctggagccggaagatgctgatgaccggcacgctggccgtgttcttcctcctgatcatggggcagctgacctggaacgacctcatccgcctgtgcatcatggtgggcgccaacgcgtccgaccgcatggggatgggcaccacctacctggccctcatggccacgttcaagatgcggccgatgttcgccgtcggcctgctgttccgccggctcaccagccgcgaggtgctgctgctcaccatcgggctgtccctggtggccagcgtcgagctccccaactccctggaggagctgggcgacgggctcgcgatgggcatcatgatcctgaagctgctcaccgacttccagagccaccagctgtgggccacgctgctctccctgaccttcatcaagaccaccttcagcctgcactacgcctggaagacgatggccatggtgctctccatcgtcagcctgttccccctgtgcctctccaccaccagccagaagaccacgtggctgcccgtgctgctcggctccctggggtgcaagccgctgaccatgttcctcatcgcggagaacaagatctggggccggcgcagctggcccctgaacgaggggatcatggccgtgggcatcgtctccatcctgctcagcagcctgctgaagaacgacgtgcccctcgccgggcccctgatcgccggcggcatgctgatcgcctgctacgtgatctccgggagctccgcggacctcagcctggagaaggccgccgaggtctcctgggaggaggaggccgagcacagcggcgcctcccacaacatcctggtggaggtgcaggacgacgggaccatgaagatcaaggacgaggagcgggacgacaccctcaccatcctgctgaaggcgacgctcctggccgtcagcggcgtgtacccgctgtccatccccgccaccctcttcgtgtggtacttctggcagaagaagaagcagcgcagcggggtcctgtgggacacccccagcccgcccgaggtggagcgggccgtgctggacgacggcatctaccgcatcatgcagcggggcctgctcgggcgcagccaggtcggcgtgggggtgttccaggagaacgtcttccacaccatgtggcacgtgacgcggggcgccgtgctgatgtaccaggggaagcgcctggagccctcctgggcgagcgtcaagaaggacctcatctcctacggcggcgggtggcggctgcagggcagctggaacaccggggaggaggtccaggtgatcgccgtcgagcccggcaagaaccccaagaacgtgcagaccgcccccgggaccttcaagacgcccgagggcgaggtgggcgccatcgccctggacttcaagcccgggacctccggcagccccatcgtcaaccgcgaggggaagatcgtgggcctctacggcaacggggtggtcaccacctccggcacgtacgtgagcgcgatcgcccaggccaaggccagccaggaggggccgctgcccgagatcgaggacgaggtgttccggaagcgcaacctgaccatcatggacctccaccccggctccgggaagacccggcgctacctgccggcgatcgtccgggaggccatcaagcgcaagctgcgcaccctcatcctggcccccacgcgggtggtggccagcgagatggccgaggcgctgaagggcatgcccatccgctaccagaccaccgccgtcaagtccgagcacaccggcaaggagatcgtggacctcatgtgccacgccacgttcaccatgcggctgctgagccccgtgcgcgtcccgaactacaacatgatcatcatggacgaggcccacttcaccgacccctccagcatcgccgcgcgggggtacatctccacccgcgtgggcatgggggaggccgccgccatcttcatgacggccacgccgcccggcagcgtggaggcgttcccgcagtccaacgccgtcatccaggacgaggagcgggacatccccgagcgcagctggaactccgggtacgagtggatcaccgacttccccggcaagaccgtgtggttcgtgcccagcatcaagtccggcaacgacatcgccaactgcctccggaagaacgggaagcgcgtcatccagctgagccggaagacgttcgacaccgagtaccagaagaccaagaacaacgactgggactacgtggtgaccacggacatctccgagatgggcgccaacttccgcgcggaccgggtcatcgacccgcgccggtgcctgaagcccgtgatcctcaaggacgggcccgagcgcgtgatcctggccggccccatgccggtcaccgtggccagcgccgcccagcggcgcgggcggatcggccgcaaccacaacaaggagggcgaccagtacatctacatggggcagcccctgaacaacgacgaggaccacgcgcactggaccgaggccaagatgctcctggacaacatcaacacccccgagggcatcatccccgccctgttcgagccggagcgcgagaagtccgccgccatcgacggggagtaccggctccgcggcgaggcgcggaagacgttcgtcgagctgatgcgccgcggggacctgcccgtgtggctcagctacaaggtggcctccgagggcttccagtacagcgaccgccggtggtgcttcgacggcgagcgcaacaaccaggtcctggaggagaacatggacgtggagatctggaccaaggagggggagcggaagaagctgcgcccccggtggctcgacgcccgcacctacagcgaccccctggccctgcgggagttcaaggagttcgccgcgggccgccggtccgtgagcggggacctcatcctggagatcggcaagctgccgcagcacctcacccagcgcgcccagaacgccctggacaacctggtcatgctccacaactccgagcagggcgggcgggcctaccgccacgcgatggaggagctgcccgacacgatcgagaccctgatgctcctggccctgatcgccgtgctcaccggcggggtgaccctgttcttcctgagcggccgggggctcggcaagacctccatcggcctgctgtgcgtcatggccagctccgtgctcctgtggatggccagcgtggagccccactggatcgcggcctccatcatcctggagttcttcctcatggtcctgctgatccccgagccggaccgccagcggacgccccaggacaaccagctcgcctacgtggtgatcgggctgctgttcatgatcctcaccgtcgccgccaacgagatgggcctgctggagaccaccaagaaggacctcgggatcggccacgtggcggtggagaaccaccaccacgccgccatgctggacgtcgacctgcaccccgccagcgcctggacgctctacgcggtggccaccaccatcatcaccccgatgatgcgccacacgatcgagaacaccaccgccaacatctccctgaccgccatcgccaaccaggcggccatcctgatggggctcgacaagggctggcccatcagcaagatggacatcggcgtgcccctgctggccctcgggtgctactcccaggtcaaccccctgacgctgaccgccgcggtgctcatgctggtggcccactacgccatcatcggcccggggctgcaggccaaggccacccgcgaggcgcagaagcggaccgccgccggcatcatgaagaaccccacggtcgacgggatcgtggccatcgacctcgaccccgtggtctacgacgccaagttcgagaagcagctgggccagatcatgctgctcatcctgtgcaccagccagatcctgctcatgcgcaccacctgggcgctgtgcgagtccatcacgctggccaccggccccctcaccaccctgtgggaggggagcccgggcaagttctggaacacgaccatcgccgtgtccatggccaacatcttccgggggagctacctggccggcgcgggcctcgccttctccctgatgaagtccctcgggggcgggcgccgggggaccggggcccagggcgagaccctcggcgagaagtggaagcgccagctgaaccagctgagcaagtccgagttcaacacgtacaagcggagcgggatcatggaggtggaccgctccgaggccaaggagggcctcaagcgcggggagaccaccaagcacgcggtcagccgcggcaccgccaagctgcggtggttcgtggagcgcaacctggtgaagcccgaggggaaggtcatcgacctgggctgcggccgcggcgggtggtcctactactgcgccgggctcaagaaggtgacggaggtgaaggggtacaccaagggcggccccggccacgaggagcccatcccgatggccacctacgggtggaacctggtcaagctgcacagcggcaaggacgtgttcttcatcccgcccgagaagtgcgacaccctcctgtgcgacatcggggagtccagccccaacccgacgatcgaggagggccgcaccctgcgggtgctcaagatggtcgagccctggctgcgcgggaaccagttctgcatcaagatcctgaacccctacatgccctccgtggtggagaccctcgagcagatgcagcggaagcacggcggcatgctggtccgcaacccgctgagccggaactccacccacgagatgtactgggtgagctgcgggaccggcaacatcgtgtccgccgtcaacatgacgagccgcatgctcctgaaccgcttcaccatggcgcaccggaagcccacctacgagcgcgacgtggacctgggggccggcacccggcacgtggccgtcgagcccgaggtggccaacctcgacatcatcggccagcgcatcgagaacatcaagcacgagcacaagtccacgtggcactacgacgaggacaacccctacaagacctgggcctaccacgggagctacgaggtgaagccgtccggcagcgcgtccagcatggtcaacggggtggtcaagctgctgaccaagccctgggacgtgatccccatggtgacccagatcgccatgacggacaccacccccttcggccagcagcgggtcttcaaggagaaggtggacacccgcacgccgaaggccaagcgggggaccgcccagatcatggaggtgaccgccaagtggctctggggcttcctgagccgcaacaagaagccccggatctgcacccgcgaggagttcacgcggaaggtccgctccaacgcggccatcggcgccgtgttcgtggacgagaaccagtggaacagcgccaaggaggcggtcgaggacgagcggttctgggacctggtgcaccgcgagcgggagctccacaagcaggggaagtgcgcgacctgcgtgtacaacatgatgggcaagcgcgagaagaagctgggggagttcggcaaggccaaggggtcccgggccatctggtacatgtggctgggcgcccgcttcctcgagttcgaggcgctgggcttcatgaacgaggaccactggttcagccgggagaactccctgagcggggtcgagggcgaggggctccacaagctgggctacatcctgcgcgacatctccaagatccccgggggcaacatgtacgccgacgacaccgccggctgggacacccggatcacggaggacgacctccagaacgaggcccgcatcaccgacatcatggagccggagcacgccctgctggccaagagcatcttcaagctcacctaccagaacaaggtggtgcgcgtccagcggcccgccaagaacgggaccgtgatggacgtgatctcccgccgggaccagcgcggcagcgggcaggtcggcacgtacggcctgaacaccttcaccaacatggaggcccagctgatccggcagatggagtccgaggggatcttcagcccctccgagctcgagatccccaacctggccgagcgcgtgctggactggctcgagaagtacggcgtggagcggctgaagcgcatggccatcagcggggacgactgcgtcgtgaagccgatcgacgaccggttcgcgaccgccctgacggccctcaacgacatgggcaaggtgcgcaaggacatcccccagtgggagccctccaaggggtggaacgactggcagcaggtccccttctgcagccaccacttccaccagctgatcatgaaggacggccgggagatcgtggtgccgtgccgcaaccaggacgagctggtcggccgggcccgcgtgtcccagggggccggctggagcctccgggagaccgcgtgcctgggcaagagctacgcccagatgtggcagctgatgtacttccaccgccgggacctccgcctggccgccaacgcgatctgctccgccgtgcccgtcgactggatccccaccagccggaccacgtggtccatccacgcccaccaccagtggatgaccaccgaggacatgctgagcgtgtggaaccgcgtgtggatcgaggagaacccctggatggaggacaagacccacatctccagctggggcgacgtcccgtacctcgggaagcgcgaggaccagtggtgcggctccctgatcggcctgacggcccgggccacctgggcgaccaacatccaggtggccatcaaccaggtgcgccggctcatcgggaacgagaactacctggactacatgaccagcatgaagcgcttcaagaacgagggcgaccccgagggggccctgtggtga

SEQ ID NO: 8312 - RNA, 9879 nt, synthetic construct
  misc_feature 1..9879: note = derived and/or modified CDS sequence (opt1) from DENV-1__EU677178__SS-prME
  source 1..9879: mol_type = other RNA
agcgtgaccatgctgctgatgctgatgcccaccgccctggccttccacctcaccacccggggcggggagccccacatgatcgtgagcaagcaggagcggggcaagagcctgctgttcaagacctccgccggggtgaacatgtgcaccctcatcgccatggacctgggcgagctgtgcgaggacaccatgacctacaagtgcccccggatcaccgagaccgagcccgacgacgtggactgctggtgcaacgccaccgacacctgggtgacctacgggacctgcagccagacgggcgagcaccggcgggacaagcggtccgtggccctcgcgccccacgtgggcctggggctggagacccgcaccgagacctggatgagctccgagggcgcgtggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcctgacgcaggacgagaagggggtgacccagaacggccggctgatcaccgccaacccgatcgtgaccgacaaggagaagcccgtcaacatcgaggccgagccgcccttcggggagagctacatcatcatcggcgccggcgagaaggcgctcaagctgtcctggttcaagaaggggagctccatcggcaagatgttcgaggccacggcccgcggggcccggcgcatggccatcctgggcgacaccgcgtgggacttcgggagcatcggcggcgtgttcacctccgtggggaagctcgtccaccagatcttcggcaccgcctacggggtgctgttcagcggcgtgtcctggacgatgaagatcgggatcggcgtcctgctcacctggctgggcctgaacagccgctccaccagcctctccatgacctgcatcgccgtggggctggtgacgctgtacctcggcgtcatggtgcaggccgacagcgggtgcgtgatcaactggaagggccgggagctgaagtgcgggtccggcatcttcgtcaccaacgaggtgcacacctggaccgagcagtacaagttccaggccgacagcccgaagcgcctgagcgcggccatcggcaaggcctgggaggagggggtgtgcggcatccggtccgccacccgcctcgagaacatcatgtggaagcagatcagcaacgagctgaaccacatcctgctcgagaacgacatgaagttcacggtcgtggtgggggacgtcgccggcatcctggcgcaggggaagaagatgatccggccccagcccatggagtacaagtactcctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctgaagctccgggactcccacacccaggtctgcgaccaccgcctgatgagcgcggccatcaaggactccaaggccgtgcacgccgacatgggctactggatcgagagcgagaagaacgagacctggaagctggcccgggcgtccttcatcgaggtgaagacgtgcatctggcccaagagccacaccctctggtccaacggcgtcctggagagcgagatgatcatccccaagatctacgggggcccgatctcccagcacaactaccgccccgggtacttcacccagaccgccggcccctggcacctggggaagctcgagctggacttcgacctgtgcgagggcacgaccgtggtggtcgacgagcactgcggcaaccgggggccgagcctccgcaccaccacggtgaccggcaagatcatccacgagtggtgctgccggtcctgcaccctgccgcccctgcgcttccgcggggaggacggctgctggtacgggatggagatccgccccgtgaaggagaaggaggagaacctcgtcaagagcatggtgtccgccggcagcggcgaggtggacagcttctccctggggctgctctgcatcagcatcatgatcgaggaggtcatgcggtcccgctggagccggaagatgctgatgaccggcacgctggccgtgttcttcctcctgatcatggggcagctgacctggaacgacctcatccgcctgtgcatcatggtgggcgccaacacctccgaccgcatggggatgggcaccacgtacctggcgctcatggccaccttcaagatgcggccgatgttcgccgtcggcctgctgttccgccggctcaccagccgcgaggtgctgctgctcaccatcgggctgtccctggtggccagcgtcgagctccccaactccctggaggagctgggcgacgggctcgccatgggcatcatgatcctgaagctgctcacggacttccagagccaccagctgtgggcgaccctgctctccctgaccttcatcaagaccacgttcagcctgcactacgcctggaagaccatggccatggtgctctccatcgtcagcctgttccccctgtgcctctccaccaccagccagaagacgacctggctgcccgtgctgctcggctccctggggtgcaagccgctgaccatgttcctcatcgccgagaacaagatctggggccggcgcagctggcccctgaacgaggggatcatggcggtgggcatcgtctccatcctgctcagcagcctgctgaagaacgacgtgcccctcgccgggcccctgatcgccggcggcatgctgatcgcctgctacgtgatctccgggagctccgccgacctcagcctggagaaggcggccgaggtctcctgggaggaggaggccgagcacagcggcgcctcccacaacatcctggtggaggtgcaggacgacgggaccatgaagatcaaggacgaggagcgggacgacaccctcacgatcctgctgaaggccaccctcctggcggtcagcggcgtgtacccgctgtccatccccgccaccctcttcgtgtggtacttctggcagaagaagaagcagcgcagcggggtcctgtgggacacccccagcccgcccgaggtggagcgggccgtgctggacgacggcatctaccgcatcatgcagcggggcctgctcgggcgcagccaggtcggcgtgggggtgttccaggagaacgtcttccacacgatgtggcacgtgacccggggcgccgtgctgatgtaccaggggaagcgcctggagccctcctgggccagcgtcaagaaggacctcatctcctacggcggcgggtggcggctgcagggcagctggaacaccggggaggaggtccaggtgatcgcggtcgagcccggcaagaaccccaagaacgtgcagaccgcccccgggacgttcaagacccccgagggcgaggtgggcgccatcgccctggacttcaagcccgggacctccggcagccccatcgtcaaccgcgaggggaagatcgtgggcctctacggcaacggggtggtcaccacgtccggcacctacgtgagcgccatcgcgcaggccaaggccagccaggaggggccgctgcccgagatcgaggacgaggtgttccggaagcgcaacctgaccatcatggacctccaccccggctccgggaagacccggcgctacctgccggccatcgtccgggaggcgatcaagcgcaagctgcgcacgctcatcctggcccccacccgggtggtggccagcgagatggccgaggccctgaagggcatgcccatccgctaccagaccaccgcggtcaagtccgagcacacgggcaaggagatcgtggacctcatgtgccacgccaccttcaccatgcggctgctgagccccgtgcgcgtcccgaactacaacatgatcatcatggacgaggcccacttcaccgacccctccagcatcgccgcccgggggtacatctccacgcgcgtgggcatgggggaggcggccgccatcttcatgaccgccacgccgcccggcagcgtggaggccttcccgcagtccaacgcggtcatccaggacgaggagcgggacatccccgagcgcagctggaactccgggtacgagtggatcaccgacttccccggcaagacggtgtggttcgtgcccagcatcaagtccggcaacgacatcgccaactgcctccggaagaacgggaagcgcgtcatccagctgagccggaagaccttcgacaccgagtaccagaagaccaagaacaacgactgggactacgtggtgacgaccgacatctccgagatgggcgccaacttccgcgccgaccgggtcatcgacccgcgccggtgcctgaagcccgtgatcctcaaggacgggcccgagcgcgtgatcctggcgggccccatgccggtcaccgtggccagcgccgcccagcggcgcgggcggatcggccgcaaccacaacaaggagggcgaccagtacatctacatggggcagcccctgaacaacgacgaggaccacgcccactggaccgaggcgaagatgctcctggacaacatcaacacgcccgagggcatcatccccgccctgttcgagccggagcgcgagaagtccgccgccatcgacggggagtaccggctccgcggcgaggcccggaagaccttcgtcgagctgatgcgccgcggggacctgcccgtgtggctcagctacaaggtggcgtccgagggcttccagtacagcgaccgccggtggtgcttcgacggcgagcgcaacaaccaggtcctggaggagaacatggacgtggagatctggaccaaggagggggagcggaagaagctgcgcccccggtggctcgacgcccgcacctacagcgaccccctggccctgcgggagttcaaggagttcgccgccggccgccggtccgtgagcggggacctcatcctggagatcggcaagctgccgcagcacctcacgcagcgcgcgcagaacgccctggacaacctggtcatgctccacaactccgagcagggcgggcgggcctaccgccacgccatggaggagctgcccgacaccatcgagaccctgatgctcctggcgctgatcgccgtgctcaccggcggggtgaccctgttcttcctgagcggccgggggctcggcaagacgtccatcggcctgctgtgcgtcatggccagctccgtgctcctgtggatggccagcgtggagccccactggatcgccgcgtccatcatcctggagttcttcctcatggtcctgctgatccccgagccggaccgccagcggacgccccaggacaaccagctcgcctacgtggtgatcgggctgctgttcatgatcctcaccgtcgccgccaacgagatgggcctgctggagaccacgaagaaggacctcgggatcggccacgtggccgtggagaaccaccaccacgcggccatgctggacgtcgacctgcaccccgccagcgcctggaccctctacgccgtggcgaccaccatcatcacgccgatgatgcgccacaccatcgagaacaccaccgccaacatctccctgacggccatcgccaaccaggccgcgatcctgatggggctcgacaagggctggcccatcagcaagatggacatcggcgtgcccctgctggccctcgggtgctactcccaggtcaaccccctgaccctgaccgccgccgtgctcatgctggtggcgcactacgccatcatcggcccggggctgcaggccaaggccacccgcgaggcccagaagcggacggcggccggcatcatgaagaaccccaccgtcgacgggatcgtggccatcgacctcgaccccgtggtctacgacgccaagttcgagaagcagctgggccagatcatgctgctcatcctgtgcaccagccagatcctgctcatgcgcaccacgtgggccctgtgcgagtccatcaccctggcgaccggccccctcaccacgctgtgggaggggagcccgggcaagttctggaacaccaccatcgccgtgtccatggccaacatcttccgggggagctacctggccggcgccggcctcgcgttctccctgatgaagtccctcgggggcgggcgccgggggaccggggcccagggcgagacgctcggcgagaagtggaagcgccagctgaaccagctgagcaagtccgagttcaacacctacaagcggagcgggatcatggaggtggaccgctccgaggccaaggagggcctcaagcgcggggagaccaccaagcacgccgtcagccgcggcacggcgaagctgcggtggttcgtggagcgcaacctggtgaagcccgaggggaaggtcatcgacctgggctgcggccgcggcgggtggtcctactactgcgccgggctcaagaaggtgaccgaggtgaaggggtacaccaagggcggccccggccacgaggagcccatcccgatggccacctacgggtggaacctggtcaagctgcacagcggcaaggacgtgttcttcatcccgcccgagaagtgcgacacgctcctgtgcgacatcggggagtccagccccaacccgaccatcgaggagggccgcaccctgcgggtgctcaagatggtcgagccctggctgcgcgggaaccagttctgcatcaagatcctgaacccctacatgccctccgtggtggagaccctcgagcagatgcagcggaagcacggcggcatgctggtccgcaacccgctgagccggaactccacccacgagatgtactgggtgagctgcgggacgggcaacatcgtgtccgccgtcaacatgaccagccgcatgctcctgaaccgcttcaccatggcccaccggaagcccacctacgagcgcgacgtggacctgggggcgggcacgcggcacgtggccgtcgagcccgagatcgccaacctcgacatcatcggccagcgcatcgagaacatcaagcacgagcacaagtccacctggcactacgacgaggacaacccctacaagacctgggcctaccacgggagctacgaggtgaagccgtccggcagcgcctccagcatggtgaacggggtcgtgaagctgctgaccaagccctgggacgtcatccccatggtgacgcagatcgcgatgaccgacaccacccccttcggccagcagcgggtgttcaaggagaaggtcgacacgcgcaccccgaaggccaagcgggggaccgcccagatcatggaggtgaccgccaagtggctctggggcttcctgagccgcaacaagaagccccggatctgcacgcgcgaggagttcacccggaaggtgcgctccaacgccgcgatcggcgccgtcttcgtggacgagaaccagtggaacagcgccaaggaggccgtggaggacgagcggttctgggacctggtccaccgcgagcgggagctccacaagcaggggaagtgcgcgacctgcgtgtacaacatgatgggcaagcgcgagaagaagctgggggagttcggcaaggccaaggggtcccgggccatctggtacatgtggctgggcgcccgcttcctcgagttcgaggccctgggcttcatgaacgaggaccactggttcagccgggagaactccctgagcggggtggagggcgaggggctccacaagctgggctacatcctgcgcgacatctccaagatccccgggggcaacatgtacgcggacgacaccgccggctgggacacgcggatcaccgaggacgacctccagaacgaggcccgcatcaccgacatcatggagccggagcacgccctgctggccaagagcatcttcaagctcacctaccagaacaaggtcgtgcgcgtgcagcggcccgcgaagaacgggacggtcatggacgtgatctcccgccgggaccagcgcggcagcggccaggtggggacctacggcctgaacaccttcaccaacatggaggcccagctgatccggcagatggagtccgaggggatcttcagcccctccgagctcgagacgcccaacctggccgagcgcgtcctggactggctcgagaagtacggcgtggagcggctgaagcgcatggccatcagcggggacgactgcgtggtcaagccgatcgacgaccggttcgccaccgcgctgaccgccctcaacgacatgggcaaggtgcgcaaggacatcccccagtgggagccctccaaggggtggaacgactggcagcaggtccccttctgcagccaccacttccaccagctgatcatgaaggacggccgggagatcgtcgtgccgtgccgcaaccaggacgagctggtgggccgggcccgcgtctcccagggggccggctggagcctccgggagaccgcctgcctgggcaagagctacgcgcagatgtggcagctgatgtacttccaccgccgggacctccgcctggccgccaacgccatctgctccgcggtgcccgtggactggatccccacgagccggaccacctggtccatccacgcccaccaccagtggatgaccacggaggacatgctgagcgtctggaaccgcgtgtggatcgaggagaacccctggatggaggacaagacccacatctccagctggggcgacgtgccgtacctcgggaagcgcgaggaccagtggtgcggctccctgatcggcctgaccgcccgggccacctgggccaccaacatccaggtcgcgatcaaccaggtgcgccggctcatcgggaacgagaactacctggactacatgacgagcatgaagcgcttcaagaacgagggcgaccccgagggggccctgtggtga

SEQ ID NO: 8313 - RNA, 9879 nt, synthetic construct
  misc_feature 1..9879: note = derived and/or modified CDS sequence (opt1) from DENV-1__EU687251__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtcacctacgggacctgcagccagacgggcgagcaccggcgggacaagcggtccgtggccctcgcgccccacgtgggcctggggctggagacccgcaccgagacctggatgagctccgagggcgcctggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcatcatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtggggaagctggtccaccagatcttcggcaccgcctacggggtgctgttctccggcgtgagctggacgatgaagatcgggatcggcgtcctgctgacctggctcggcctgaactcccgcagcacctccctgagcatgacctgcatcgccgtggggctcgtgacgctgtacctgggcgtcatggtgcaggccgactccgggtgcgtgatcaactggaagggccgggagctcaagtgcgggagcggcatcttcgtcaccaacgaggtgcacacctggaccgagcagtacaagttccaggccgacagcccgaagcgcctgtccgcggccatcggcaaggcctgggaggagggggtgtgcggcatccggagcgccacccgcctggagaacatcatgtggaagcagatctccaacgagctcaaccacatcctgctggagaacgacatgaagttcacggtcgtggtgggggacgtcgccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctgaagctgcgggacagccacacccaggtctgcgaccaccgcctcatgtccgcggccatcaaggacagcaaggccgtgcacgccgacatgggctactggatcgagtccgagaagaacgagacctggaagctggcccgggcgagcttcatcgaggtgaagacgtgcatctggcccaagtcccacaccctgtggagcaacggcgtcctcgagtccgagatgatcatccccaagatctacgggggcccgatcagccagcacaactaccgccccgggtacttcacccagaccgccggcccctggcacctggggaagctggagctcgacttcgacctgtgcgagggcacgaccgtggtggtcgacgagcactgcggcaaccgggggccgtccctgcgcaccaccacggtgaccggcaagatcatccacgagtggtgctgccggagctgcaccctgccgcccctccgcttccgcggggaggacggctgctggtacgggatggagatccgccccgtgaaggagaaggaggagaacctggtcaagtccatggtgagcgccggcagcggcgaggtggactccttcagcctcgggctgctgtgcatctccatcatgatcgaggaggtcatgcggagccgctggtcccggaagatgctcatgaccggcacgctggccgtgttcttcctgctcatcatggggcagctgacctggaacgacctgatccgcctctgcatcatggtgggcgccaacgcgagcgaccgcatggggatgggcaccacctacctggccctgatggccacgttcaagatgcggccgatgttcgccgtcggcctcctgttccgccggctgacctcccgcgaggtgctcctgctgaccatcgggctcagcctggtggcctccgtcgagctgcccaacagcctcgaggagctgggcgacgggctggcgatgggcatcatgatcctcaagctgctgaccgacttccagtcccaccagctctgggccacgctgctgagcctcaccttcatcaagaccaccttctccctgcactacgcctggaagacgatggccatggtgctgagcatcgtctccctcttccccctgtgcctgagcaccacctcccagaagaccacgtggctccccgtgctgctgggcagcctcgggtgcaagccgctgaccatgttcctgatcgcggagaacaagatctggggccggcgctcctggcccctcaacgaggggatcatggccgtgggcatcgtcagcatcctgctgagctccctcctgaagaacgacgtgcccctggccgggcccctcatcgccggcggcatgctgatcgcctgctacgtgatcagcgggtccagcgcggacctgtccctcgagaaggccgccgaggtcagctgggaggaggaggccgagcactccggcgccagccacaacatcctggtggaggtgcaggacgacgggaccatgaagatcaaggacgaggagcgggacgacaccctgaccatcctcctgaaggcgacgctgctcgccgtctccggcgtgtacccgctgagcatccccgccaccctgttcgtgtggtacttctggcagaagaagaagcagcgctccggggtcctctgggacacccccagcccgcccgaggtggagcgggccgtgctggacgacggcatctaccgcatcatgcagcggggcctgctggggcgctcccaggtcggcgtgggggtgttccaggagaacgtcttccacaccatgtggcacgtgacgcggggcgccgtgctcatgtaccaggggaagcgcctggagcccagctgggcgtccgtcaagaaggacctgatcagctacggcggcgggtggcggctccagggctcctggaacaccggggaggaggtccaggtgatcgccgtcgagcccggcaagaaccccaagaacgtgcagaccgcccccgggaccttcaagacgcccgagggcgaggtgggcgccatcgccctggacttcaagcccgggaccagcggctcccccatcgtcaaccgcgaggggaagatcgtgggcctgtacggcaacggggtggtcaccaccagcggcacgtacgtgagcgcgatcgcccaggccaaggcctcccaggaggggccgctccccgagatcgaggacgaggtgttccggaagcgcaacctgaccatcatggacctgcaccccggcagcgggaagacccggcgctacctcccggcgatcgtccgggaggccatcaagcgcaagctgcgcaccctgatcctcgcccccacgcgggtggtggcctccgagatggccgaggcgctgaagggcatgcccatccgctaccagaccaccgccgtcaagagcgagcacaccggcaaggagatcgtggacctgatgtgccacgccacgttcaccatgcggctcctgtcccccgtgcgcgtcccgaactacaacatgatcatcatggacgaggcccacttcaccgaccccagctccatcgccgcgcgggggtacatcagcacccgcgtgggcatgggggaggccgccgccatcttcatgacggccacgccgcccggctccgtggaggcgttcccgcagagcaacgccgtcatccaggacgaggagcgggacatccccgagcgctcctggaacagcgggtacgagtggatcaccgacttccccggcaagaccgtgtggttcgtgccctccatcaagagcggcaacgacatcgccaactgcctgcggaagaacgggaagcgcgtcatccagctctcccggaagacgttcgacaccgagtaccagaagaccaagaacaacgactgggactacgtggtgaccacggacatcagcgagatgggcgccaacttccgcgcggaccgggtcatcgacccgcgccggtgcctgaagcccgtgatcctgaaggacgggcccgagcgcgtgatcctcgccggccccatgccggtcaccgtggcctccgccgcccagcggcgcgggcggatcggccgcaaccacaacaaggagggcgaccagtacatctacatggggcagcccctgaacaacgacgaggaccacgcgcactggaccgaggccaagatgctgctcgacaacatcaacacccccgagggcatcatccccgccctgttcgagccggagcgcgagaagtccgccgccatcgacggggagtaccggctgcgcggcgaggcgcggaagacgttcgtcgagctcatgcgccgcggggacctgcccgtgtggctgtcctacaaggtggccagcgagggcttccagtacagcgaccgccggtggtgcttcgacggcgagcgcaacaaccaggtcctcgaggagaacatggacgtggagatctggaccaaggagggggagcggaagaagctgcgcccccggtggctggacgcccgcacctactccgaccccctcgccctgcgggagttcaaggagttcgccgcgggccgccggagcgtgtccggggacctgatcctcgagatcggcaagctgccgcagcacctgacccagcgcgcccagaacgccctcgacaacctggtcatgctgcacaacagcgagcagggcgggcgggcctaccgccacgcgatggaggagctccccgacacgatcgagaccctgatgctgctcgccctgatcgccgtgctgaccggcggggtgaccctcttcttcctgtccggccgggggctgggcaagaccagcatcggcctcctgtgcgtcatggcctccagcgtgctgctctggatggcctccgtggagccccactggatcgcggccagcatcatcctggagttcttcctgatggtcctcctgatccccgagccggaccgccagcggacgccccaggacaaccagctggcctacgtggtgatcgggctcctgttcatgatcctgaccgtcgccgccaacgagatgggcctcctggagaccaccaagaaggacctggggatcggccacgtggcggtggagaaccaccaccacgccgccatgctcgacgtcgacctgcaccccgcctccgcctggacgctgtacgcggtggccaccaccatcatcaccccgatgatgcgccacacgatcgagaacaccaccgccaacatcagcctcaccgccatcgccaaccaggcggccatcctgatggggctggacaagggctggcccatctccaagatggacatcggcgtgcccctcctggccctggggtgctacagccaggtcaaccccctcacgctgaccgccgcggtgctgatgctcgtggcccactacgccatcatcggcccggggctgcaggccaaggccacccgcgaggcgcagaagcggaccgccgccggcatcatgaagaaccccacggtcgacgggatcgtggccatcgacctggaccccgtggtctacgacgccaagttcgagaagcagctcggccagatcatgctgctgatcctctgcacctcccagatcctgctgatgcgcaccacctgggcgctctgcgagagcatcacgctggccaccggccccctgaccaccctctgggaggggtccccgggcaagttctggaacacgaccatcgccgtgagcatggccaacatcttccgggggtcctacctggccggcgcgggcctggccttcagcctcatgaagtccctcgggggcgggcgccgggggaccggggcccagggcgagaccctgggcgagaagtggaagcgccagctcaaccagctgtccaagagcgagttcaacacgtacaagcggtccgggatcatggaggtggaccgcagcgaggccaaggagggcctgaagcgcggggagaccaccaagcacgcggtctcccgcggcaccgccaagctccggtggttcgtggagcgcaacctggtgaagcccgaggggaaggtcatcgacctgggctgcggccgcgggggctggagctactactgcgccgggctgaagaaggtgacggaggtgaagggctacaccaagggcggccccggccacgaggagcccatcccgatggccacctacgggtggaacctcgtcaagctgcactccggcaaggacgtgttcttcatcccgcccgagaagtgcgacaccctgctctgcgacatcggggagagctcccccaacccgacgatcgaggagggccgcaccctgcgggtgctgaagatggtcgagccctggctccgcgggaaccagttctgcatcaagatcctgaacccctacatgcccagcgtggtggagaccctggagcagatgcagcggaagcacggcggcatgctcgtccgcaacccgctgtcccggaacagcacccacgagatgtactgggtgtcctgcgggaccggcaacatcgtgagcgccgtcaacatgacgtcccgcatgctgctcaaccgcttcaccatggcgcaccggaagcccacctacgagcgcgacgtggacctgggggccggcacccggcacgtggccgtcgagcccgaggtggccaacctggacatcatcggccagcgcatcgagaacatcaagcacgagcacaagagcacgtggcactacgacgaggacaacccctacaagacctgggcctaccacgggtcctacgaggtgaagccgagcggctccgcgagcagcatggtcaacggggtggtcaagctcctgaccaagccctgggacgtgatccccatggtgacccagatcgccatgacggacaccacccccttcggccagcagcgggtcttcaaggagaaggtggacacccgcacgccgaaggccaagcgggggaccgcccagatcatggaggtgaccgccaagtggctgtggggcttcctctcccgcaacaagaagccccggatctgcacccgcgaggagttcacgcggaaggtccgcagcaacgcggccatcggcgccgtgttcgtggacgagaaccagtggaactccgccaaggaggcggtcgaggacgagcggttctgggacctggtgcaccgcgagcgggagctgcacaagcaggggaagtgcgcgacctgcgtgtacaacatgatgggcaagcgcgagaagaagctcggggagttcggcaaggccaaggggagccgggccatctggtacatgtggctgggcgcccgcttcctggagttcgaggcgctcggcttcatgaacgaggaccactggttctcccgggagaacagcctgtccggggtcgagggcgaggggctgcacaagctcggctacatcctgcgcgacatcagcaagatccccgggggcaacatgtacgccgacgacaccgccggctgggacacccggatcacggaggacgacctgcagaacgaggcccgcatcaccgacatcatggagccggagcacgccctcctggcgaagtccatcttcaagctgacctaccagaacaaggtggtgcgcgtccagcggcccgccaagaacgggaccgtgatggacgtgatcagccgccgggaccagcgcggctccgggcaggtcggcacgtacggcctcaacaccttcaccaacatggaggcccagctgatccggcagatggagagcgaggggatcttctcccccagcgagctggagacccccaacctcgccgagcgcgtgctggactggctgaagaagtacggcgtggagcggctcaagcgcatggccatctccggggacgactgcgtcgtgaagccgatcgacgaccggttcgcgacggccctgaccgccctgaacgacatgggcaaggtgcgcaaggacatcccccagtgggagcccagcaaggggtggaacgactggcagcaggtccccttctgctcccaccacttccaccagctcatcatgaaggacggccgggagatcgtggtgccgtgccgcaaccaggacgagctggtcggccgggcccgcgtgagccagggggccggctggagcctgcgggagaccgcgtgcctcgggaagtcctacgcccagatgtggcagctgatgtacttccaccgccgggacctgcgcctcgccgccaacgcgatctgcagcgccgtgcccgtcgactggatccccacctcccggacgacctggagcatccacgcccaccaccagtggatgaccaccgaggacatgctgtccgtgtggaaccgcgtgtggatcgaggagaacccctggatggaggacaagacgcacatcagctcctggggcgacgtcccgtacctggggaagcgcgaggaccagtggtgcggcagcctcatcggcctgaccgcccgggccacctgggcgaccaacatccaggtggccatcaaccaggtgcgccggctgatcgggaacgagaactacctcgactacatgacctccatgaagcgcttcaagaacgagagcgaccccgagggcgccctgtggtga

SEQ ID NO: 8314 - RNA, 9879 nt, synthetic construct
  misc_feature 1..9879: note = derived and/or modified CDS sequence (opt1) from DENV-1__FJ024427__SS-prME
  source 1..9879: mol_type = other RNA
agcgtgaccatgctgctcatgctgatgcccaccgccctggccttccacctcaccacccgcggcggggagccccacatgatcgtgagcaagcaggagcggggcaagagcctgctgttcaagaccagcgcgggggtgaacatgtgcaccctcatcgccatggacctgggcgagctgtgcgaggacaccatgacctacaagtgcccccgcatcaccgagaccgagcccgacgacgtggactgctggtgcaacgccacggacacctgggtgacctacgggacctgcagccagacgggcgagcaccggcgcgacaagcggtccgtggccctcgcgccccacgtgggcctggggctggagacccgcaccgagacctggatgagctccgagggcgcgtggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgggtacggcgccctgacgctggactgcagcccccgcaccgggctcgacttcaacgagatggtcctgctgaccatgaaggagaagtcctggctcgtgcacaagcagtggttcctggacctgcccctcccctggaccagcggcgccagcacgtcccaggagacctggaaccggcaggacctgctggtgaccttcaagaccgcccacgccaagaagcaggaggtcgtggtgctcggcagccaggagggggcgatgcacacggccctgaccggcgccaccgagatccagacctccgggacgaccaccatcttcgccggccacctgaagtgccgcctcaagatggacaagctgaccctgaaggggatgagctacgtcatgtgcacgggctccttcaagctcgagaaggaggtggccgagacccagcacggcaccgtgctggtccagatcaagtacgagggggcggacgccccctgcaagatccccttcagcacccaggacgagaagggcatcacgcagaacgggcggctgatcaccgccaacccgatcgtgaccgacaaggagaagcccgtgaacatcgaggccgagccgcccttcggcgagtcctacatcgtcatcggcgcgggggagaaggccctgaagctcagctggttcaagaagggctccagcatcgggaagatgttcgaggccaccgcccgcggcgcccggcgcatggcgatcctgggggacacggcctgggacttcggctccatcggcggggtgttcaccagcgtgggcaagctggtccaccagatcttcgggaccgcctacggcgtcctcttctccggggtgagctggaccatgaagatcggcatcggcgtcctgctgacgtggctcgggctgaactcccgcagcacctccctgagcatgacctgcatcgccgtgggcctcgtgaccctgtacctgggggtcatggtgcaggccgactccggctgcgtgatcaactggaaggggcgggagctcaagtgcggcagcggcatcttcgtcacgaacgaggtgcacacctggaccgagcagtacaagttccaggcggacagcccgaagcgcctgtccgccgccatcgggaaggcctgggaggagggcgtgtgcgggatccggagcgccacccgcctggagaacatcatgtggaagcagatctccaacgagctcaaccacatcctgctggagaacgacatgaagttcaccgtcgtggtgggcgacgtcgcggggatcctcgcccagggcaagaagatgatccggccccagcccatggagtacaagtacagctggaagtcctggggcaaggccaagatcatcggggccgacgtgcagaacacgaccttcatcatcgacggccccaacaccccggagtgccccgacgaccagcgcgcgtggaacatctgggaggtggaggactacgggttcggcatcttcaccacgaacatctggctgaagctgcgggacagctacacccaggtctgcgaccaccgcctcatgtccgccgccatcaaggacagcaaggccgtgcacgccgacatgggctactggatcgagtccgagaagaacgagacctggaagctggcgcgggccagcttcatcgaggtgaagacctgcatctggcccaagtcccacacgctgtggagcaacggggtcctcgagtccgagatgatcatccccaagatctacggcgggccgatcagccagcacaactaccgccccggctacttcacccagaccgccgggccctggcacctgggcaagctggagctcgacttcgacctgtgcgagggcaccacggtggtggtcgacgagcactgcgggaaccggggcccgtccctgcgcaccaccaccgtgacggggaagatcatccacgagtggtgctgccggagctgcaccctgccgcccctccgcttccggggcgaggacgggtgctggtacggcatggagatccgccccgtgaaggagaaggaggagaacctggtcaagtccatggtgagcgccggcagcggggaggtggactccttcagcctcggcctgctgtgcatctccatcatgatcgaggaggtcatgcggagccgctggtcccggaagatgctcatgaccgggaccctggccgtgttcttcctgctcatcatgggccagctgacgtggaacgacctgatccgcctctgcatcatggtgggggcgaacgccagcgaccgcatgggcatgggcaccacctacctggccctgatggccaccttcaagatgcggccgatgttcgccgtcgggctcctgttccgccggctgacgtcccgcgaggtgctcctgctgaccatcgggctcagcctggtggcgtccgtcgagctgcccaacagcctcgaggagctgggggacggcctggccatgggcatcatgatcctcaagctgctgaccgacttccagtcccaccagctctgggccaccctgctgagcctcacgttcatcaagaccaccttctccctgcactacgcctggaagaccatggcgatggtgctgagcatcgtctccctcttccccctgtgcctgagcacgacctcccagaagaccacctggctccccgtgctgctggggagcctcggctgcaagccgctgacgatgttcctgatcgccgagaacaagatctgggggcggcgctcctggcccctcaacgagggcatcatggccgtggggatcgtcagcatcctgctgagctccctcctgaagaacgacgtgcccctggccggccccctcatcgccggcgggatgctgatcgcgtgctacgtgatcagcggctccagcgccgacctgtccctcgagaaggccgccgaggtcagctgggaggaggaggccgagcactccggggcgagccacaacatcctggtggaggtgcaggacgacggcaccatgaagatcaaggacgaggagcgggacgacaccctgaccatcctcctgaaggccaccctgctcgccgtctccggggtgtacccgctgagcatccccgccacgctgttcgtgtggtacttctggcagaagaagaagcagcgctccggcgtcctctgggacacccccagcccgcccgaggtggagcgggccgtgctggacgacggcatctaccgcatcatgcagcgggggctgctgggccgctcccaggtcggggtgggcgtgttccaggagaacgtcttccacaccatgtggcacgtgacccgcggggccgtgctcatgtaccagggcaagcggctggagcccagctgggcctccgtcaagaaggacctgatcagctacggcgggggctggcggctccaggggtcctggaacacgggcgaggaggtccaggtgatcgccgtcgagcccgggaagaaccccaagaacgtgcagaccgcccccggcaccttcaagacccccgagggcgaggtgggggccatcgcgctggacttcaagcccggcacgagcgggtcccccatcgtcaaccgcgagggcaagatcgtgggcctgtacgggaacggcgtggtcaccaccagcgggacctacgtgagcgccatcgcccaggccaaggcgtcccaggagggcccgctccccgagatcgaggacgaggtgttccggaagcgcaacctgacgatcatggacctgcaccccgggagcggcaagacccggcgctacctcccggccatcgtccgggaggccatcaagcgcaagctgcgcaccctgatcctcgcccccacccgggtggtggcctccgagatggcggaggccctgaagggcatgcccatccgctaccagacgaccgccgtcaagagcgagcacaccgggaaggagatcgtggacctgatgtgccacgccaccttcacgatgcggctcctgtcccccgtgcgcgtcccgaactacaacatgatcatcatggacgaggcccacttcaccgaccccagctccatcgcggcccggggctacatcagcacccgcgtggggatgggcgaggccgccgccatcttcatgaccgcgacgccgcccgggtccgtggaggccttcccgcagagcaacgccgtcatccaggacgaggagcgggacatccccgagcgctcctggaacagcggctacgagtggatcaccgacttccccggcaagaccgtgtggttcgtgccctccatcaagagcgggaacgacatcgccaactgcctgcggaagaacggcaagcgcgtcatccagctctcccggaagaccttcgacacggagtaccagaagaccaagaacaacgactgggactacgtggtgaccaccgacatcagcgagatgggggcgaacttccgcgccgaccgggtcatcgacccgcgccggtgcctgaagcccgtgatcctgaaggacggccccgagcgcgtgatcctcgccgggcccatgccggtcacggtggcctccgccgcgcagcggcgcggccggatcggccgcaaccacaacaaggagggggaccagtacatctacatgggccagcccctgaacaacgacgaggaccacgcccactggaccgaggccaagatgctgctcgacaacatcaacacccccgaggggatcatccccgccctgttcgagccggagcgcgagaagtccgccgcgatcgacggcgagtaccggctgcgcggggaggcccggaagaccttcgtcgagctcatgcgccggggcgacctgcccgtgtggctgtcctacaaggtggccagcgagggcttccagtacagcgaccgccggtggtgcttcgacggggagcgcaacaaccaggtcctcgaggagaacatggacgtggagatctggacgaaggagggcgagcggaagaagctgcgcccccggtggctggacgcccgcacctactccgaccccctcgccctgcgggagttcaaggagttcgcggccgggcgccggagcgtgtccggcgacctgatcctcgagatcggcaagctgccgcagcacctgacccagcgcgcccagaacgccctcgacaacctggtcatgctgcacaacagcgagcagggcgggcgggcgtaccgccacgccatggaggagctccccgacaccatcgagacgctgatgctgctcgccctgatcgccgtgctgaccgggggcgtgaccctcttcttcctgtccgggcggggcctgggcaagaccagcatcgggctcctgtgcgtcatggcctccagcgtgctgctctggatggcgtccgtggagccccactggatcgccgccagcatcatcctggagttcttcctgatggtcctcctgatccccgagccggaccgccagcggacgccccaggacaaccagctggcctacgtggtgatcggcctcctgttcatgatcctgacggtcgccgcgaacgagatggggctcctggagaccaccaagaaggacctgggcatcgggcacgtggccgtggagaaccaccaccacgccgccatgctcgacgtcgacctgcaccccgcctccgcgtggaccctgtacgccgtggccacgaccatcatcaccccgatgatgcgccacaccatcgagaacacgaccgccaacatcagcctcaccgccatcgcgaaccaggccgccatcctgatgggcctggacaagggctggcccatctccaagatggacatcggggtgcccctcctggccctgggctgctacagccaggtcaaccccctcaccctgacggcggccgtgctgatgctcgtggcccactacgccatcatcgggccgggcctgcaggccaaggcgacccgcgaggcccagaagcggaccgccgccgggatcatgaagaaccccaccgtcgacggcatcgtggccatcgacctggaccccgtggtctacgacgcgaagttcgagaagcagctcggccagatcatgctgctgatcctctgcacgtcccagatcctgctgatgcgcaccacctgggccctctgcgagagcatcaccctggccacggggcccctgaccaccctctgggagggctccccggggaagttctggaacaccacgatcgccgtgagcatggccaacatcttccggggctcctacctggcgggcgccgggctggccttcagcctcatgaagtccctgggcgggggccgccgggggaccggcgcccagggcgagaccctgggggagaagtggaagcgccagctcaaccagctgtccaagagcgagttcaacacctacaagcggtccggcatcatggaggtggaccgcagcgaggcgaaggaggggctgaagcggggcgagacgaccaagcacgccgtctcccgcgggaccgccaagctccggtggttcgtggagcgcaacctggtgaagcccgagggcaaggtcatcgacctgggctgcgggcggggcgggtggagctactactgcgccggcctgaagaaggtgaccgaggtgaaggggtacacgaagggcggccccgggcacgaggagcccatcccgatggccacctacggctggaacctcgtcaagctgcactccgggaaggacgtgttcttcatcccgcccgagaagtgcgacaccctgctctgcgacatcggcgagagctcccccaacccgaccatcgaggaggggcgcacgctgcgggtgctgaagatggtcgagccctggctccgcggcaaccagttctgcatcaagatcctgaacccctacatgcccagcgtggtggagaccctggagcagatgcagcggaagcacggcgggatgctcgtccgcaacccgctgtcccggaacagcacccacgagatgtactgggtgtcctgcggcaccgggaacatcgtgagcgcggtcaacatgacctcccgcatgctgctcaaccgcttcacgatggcccaccggaagcccacctacgagcgcgacgtggacctgggcgccggcacccggcacgtggccgtcgagcccgaggtggccaacctggacatcatcgggcagcgcatcgagaacatcaagcacgagcacaagagcacctggcactacgacgaggacaacccctacaagacgtgggcgtaccacggctcctacgaggtgaagccgagcgggtccgccagcagcatggtcaacggcgtggtcaagctcctgaccaagccctgggacgtgatccccatggtgacccagatcgccatgaccgacacgacccccttcgggcagcagcgggtcttcaaggagaaggtggacacccgcaccccgaaggccaagcggggcacggcccagatcatggaggtgaccgcgaagtggctgtggggcttcctctcccgcaacaagaagccccggatctgcacccgcgaggagttcacccggaaggtccgcagcaacgccgccatcggggccgtgttcgtggacgagaaccagtggaactccgcgaaggaggccgtcgaggacgagcggttctgggacctggtgcaccgcgagcgggagctgcacaagcagggcaagtgcgccacgtgcgtgtacaacatgatggggaagcgcgagaagaagctcggcgagttcgggaaggccaagggcagccgggccatctggtacatgtggctgggcgcgcgcttcctggagttcgaggccctcgggttcatgaacgaggaccactggttcaaccgggagaactccctgagcggcgtcgagggggagggcctgcacaagctcgggtacatcctgcgcgacatctccaagatccccggcggcaacatgtacgccgacgacaccgccgggtgggacacccggatcaccgaggacgacctgcagaacgaggcccgcatcacggacatcatggagccggagcacgcgctcctggcccgcagcatcttcaagctgacctaccagaacaaggtggtgcgggtccagcgccccgccaagaacggcaccgtgatggacgtgatctcccggcgcgaccagcgggggagcggccaggtcggcacctacgggctcaacacgttcaccaacatggaggcccagctgatccgccagatggagtccgagggcatcttcagcccctccgagctggagacccccaacctcgccgagcgggtgctggactggctggagaagtacggggtggagcgcctcaagcggatggcgatcagcggcgacgactgcgtcgtgaagccgatcgacgaccgcttcgccaccgccctgacggccctgaacgacatggggaaggtgcggaaggacatcccccagtgggagccctccaagggctggaacgactggcagcaggtccccttctgcagccaccacttccaccagctcatcatgaaggacggccgcgagatcgtggtgccgtgccggaaccaggacgagctggtcgggcgcgcccgggtgtcccagggcgcggggtggagcctgcgcgagaccgcctgcctcggcaagagctacgcccagatgtggcagctgatgtacttccaccggcgcgacctgcggctcgccgcgaacgccatctgctccgccgtgcccgtcgactggatccccaccagccgcaccacgtggtccatccacgcccaccaccagtggatgaccaccgaggacatgctgagcgtgtggaaccgcgtgtggatcgaggagaacccctggatggaggacaagacccacatctccagctggggcgacgtcccgtacctgggcaagcgggaggaccagtggtgcggctccctcatcgggctgacggcccgcgcgacctgggccaccaacatccaggtggccatcaaccaggtgcggcgcctgatcggcaacgagaactacctcgactacatgaccagcatgaagcggttcaagaacgagtccgaccccgagggggccctgtggtga

SEQ ID NO: 8315 - RNA, 9879 nt, synthetic construct
  misc_feature 1..9879: note = derived and/or modified CDS sequence (opt1) from DENV-1__FJ024428__SS-prME
  source 1..9879: mol_type = other RNA
agcgtgaccatgctgctgatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccaccgacacctgggtgacctacgggacctgcagccagaccggcgagcaccggcgggacaagcggtccgtggccctcgcgccccacgtgggcctggggctggagacccgcaccgagacctggatgagctccgagggcgcctggaagcagatccagcgggtcgagacgtgggccctccggcaccccgggttcaccgtgaccgccctgttcctggcccacgcgatcggcaccagcatcacgcagaaggggatcatcttcatcctcctgatgctggtgaccccctccatggccatgcggtgcgtcggcatcggcagccgcgacttcgtggaggggctctccggcgccacctgggtggacgtcgtgctggagcacgggagctgcgtgaccacgatggccaaggacaagcccaccctggacatcgagctcctgaagaccgaggtcaccaaccccgccgtgctgcggaagctctgcatcgaggcgaagatctccaacacgaccaccgacagccgctgcccgacccagggcgaggccacgctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgacggtccacaccggcgaccagcaccaggtggggaacgagtccaccgagcacggcaccaccgccacgatcacgccccaggcgcccaccaccgagatccagctcacggactacggggccctgaccctggactgcagcccccgcaccggcctcgacttcaacgagatggtcctgctgaccatgaaggagaagtcctggctcgtgcacaagcagtggttcctggacctgcccctcccctggacgagcggggccagcacctcccaggagacctggaaccggcaggacctgctggtgaccttcaagacggcccacgccaagaagcaggaggtcgtggtgctcggcagccaggagggcgcgatgcacaccgccctgaccggggccaccgagatccagacgtccggcaccaccaccatcttcgccgggcacctgaagtgccgcctcaagatggacaagctgacgctgaagggcatgagctacgtcatgtgcaccgggtccttcaagctcgagaaggagctggccgagacccagcacggcaccgtgctggtgcagatcaagtacgagggcacggacgcgccctgcaagatccccttcagcacccaggacgagaagggggtcacccagaacggccggctgatcaccgccaacccgatcgtgacggacaaggagaagcccgtgaacatcgaggccgagccgcccttcggggagtcctacatcgtcatcggcgccggcgagaaggcgctcaagctgagctggttcaagaaggggtccagcatcggcaagatgttcgaggccaccgcccgcggggcccggcgcatggccatcctgggcgacaccgcgtgggacttcgggtccatcggcggcgtgttcaccagcgtggggaagctcgtccaccagatcttcggcacggcctacggggtgctgttctccggcgtgagctggaccatgaagatcgggatcggcgtcctgctcacctggctgggcctgaactcccgcagcacctccctcagcatgacgtgcatcgccgtggggctggtgaccctgtacctcggcgtcatggtgcaggccgactccgggtgcgtgatcaactggaagggccgggagctgaagtgcgggagcggcatcttcgtcaccaacgaggtgcacacctggaccgagcagtacaagttccaggccgacagcccgaagcgcctgtccgcggccatcggcaaggcctgggaggagggggtgtgcggcatccggagcgccacgcgcctcgagaacatcatgtggaagcagatctccaacgagctgaaccacatcctgctcgagaacgacatgaagttcaccgtcgtggtgggggacgtcgccggcatcctggcgcaggggaagaagatgatccggccccagcccatggagcacaagtacagctggaagtcctggggcaaggccaagatcatcggcgccgacgtgcagaacaccaccttcatcatcgacgggcccaacacgccggagtgccccgacgaccagcgcgcctggaacatctgggaggtggaggactacggcttcgggatcttcaccaccaacatctggctgaagctccgggacagctacacccaggtctgcgaccaccgcctgatgtccgcggccatcaaggacagcaaggccgtgcacgccgacatgggctactggatcgagtccgagaagaacgagacgtggaagctggcccgggcgagcttcatcgaggtgaagacctgcatctggcccaagtcccacaccctctggagcaacggcgtcctggagtccgagatgatcatccccaagatctacgggggcccgatcagccagcacaactaccgccccgggtacttcacccagacggccggcccctggcacctggggaagctcgagctggacttcgacctgtgcgagggcaccaccgtggtggtcgacgagcactgcggcaaccgggggccgtccctccgcaccacgaccgtgaccggcaagatcatccacgagtggtgctgccggagctgcaccctgccgcccctgcgcttccgcggggaggacggctgctggtacgggatggagatccgccccgtgaaggagaaggaggagaacctcgtcaagtccatggtgagcgccggcagcggcgaggtggactccttcagcctggggctgctctgcatctccatcatgatcgaggaggtcatgcggagccgctggtcccggaagatgctgatgacgggcaccctggccgtgttcttcctcctgatcgtggggcagctgacctggaacgacctcatccgcctgtgcatcatggtcggcgccaacgcgagcgaccgcatggggatgggcaccacgtacctggccctcatggccaccttcaagatgcggccgatgttcgccgtgggcctgctgttccgccggctcacctcccgcgaggtgctgctgctcaccatcgggctgagcctggtcgcctccgtggagctccccaacagcctggaggagctgggcgacgggctcgcgatgggcatcatgatcctgaagctgctcacggacttccagtcccaccagctgtgggccaccctgctcagcctgaccttcatcaagaccacgttctccctgcactacgcctggaagaccatggccatggtcctcagcgtggtgtccctgttccccctgtgcctcagcaccacctcccagaagacgacctggctgcccgtcctgctcggcagcctggggtgcaagccgctgaccatgttcctcatcgcggagaacaagatctggggccggcgctcctggcccctgaacgaggggatcatggccgtgggcatcgtgagcatcctgctcagctccctgctgaagaacgacgtccccctcgccgggcccctgatcgccggcggcatgctgatcgcctgctacgtgatcagcgggtccagcgcggacctctccctggagaaggccgccgaggtgagctgggaggaggaggccgagcactccggcgccagccacaacatcctggtcgaggtgcaggacgacgggaccatgaagatcaaggacgaggagcgggacgacaccctcacgatcctgctgaaggcgaccctcctggccgtgtccggcgtctacccgctgagcatccccgccaccctcttcgtgtggtacttctggcagaagaagaagcagcgctccggggtgctgtgggacacccccagcccgcccgaggtcgagcgggccgtgctggacgacggcatctaccgcatcatgcagcggggcctgctcgggcgctcccaggtgggcgtcggggtgttccaggagaacgtgttccacacgatgtggcacgtcacccggggcgccgtgctgatgtaccaggggaagcgcctggagcccagctgggcgtccgtgaagaaggacctcatcagctacggcggcgggtggcggctgcagggctcctggaacaccggggaggaggtccaggtgatcgccgtggagcccggcaagaaccccaagaacgtccagaccgcccccgggacgttcaagacccccgagggcgaggtgggcgccatcgccctggacttcaagcccgggaccagcggctcccccatcgtgaaccgcgaggggaagatcgtcggcctctacggcaacggggtggtgaccacgagcggcacctacgtcagcgcgatcgcccaggccaaggcctcccaggaggggccgctgcccgagatcgaggacgaggtgttccggaagcgcaacctgaccatcatggacctccaccccggcagcgggaagacccggcgctacctgccggcgatcgtgcgggaggccatcaagcgcaagctgcgcacgctcatcctggcccccacccgggtcgtggcctccgagatggccgaggcgctgaagggcatgcccatccgctaccagaccaccgccgtcaagagcgagcacacgggcaaggagatcgtcgacctcatgtgccacgccaccttcaccatgcggctgctgtcccccgtgcgcgtgccgaactacaacatgatcatcatggacgaggcccacttcaccgaccccagctccatcgccgcgcgggggtacatcagcacgcgcgtcggcatgggggaggccgccgccatcttcatgaccgccacgccgcccggctccgtggaggcgttcccgcagagcaacgccgtgatccaggacgaggagcgggacatccccgagcgctcctggaacagcgggtacgagtggatcaccgacttccccggcaagacggtctggttcgtgccctccatcaagagcggcaacgacatcgccaactgcctccggaagaacgggaagcgcgtgatccagctgtcccggaagaccttcgacaccgagtaccagaagaccaagaacaacgactgggactacgtcgtgacgaccgacatcagcgagatgggcgccaacttccgcgcggaccgggtgatcgacccgcgccggtgcctgaagcccgtcatcctcaaggacgggcccgagcgcgtgatcctggccggccccatgccggtcaccgtggcctccgccgcccagcggcgcgggcggatcggccgcaaccacaacaaggagggcgaccagtacatctacatggggcagcccctgaacaacgacgaggaccacgcgcactggaccgaggccaagatgctcctggacaacatcaacacgcccgagggcatcatccccgccctgttcgagccggagcgcgagaagtccgccgccatcgacggggagtaccggctccgcggcgaggcgcggaagaccttcgtggagctgatgcgccgcggggacctgcccgtctggctctcctacaaggtggccagcgagggcttccagtacagcgaccgccggtggtgcttcgacggcgagcgcaacaaccaggtgctggaggagaacatggacgtcgagatctggaccaaggagggggagcggaagaagctgcgcccccggtggctcgacgcccgcacctactccgaccccctggccctgcgggagttcaaggagttcgccgcgggccgccggagcgtgtccggggacctcatcctggagatcggcaagctgccgcagcacctcacgcagcgcgcccagaacgccctggacaacctggtgatgctccacaacagcgagcagggcgggcgggcctaccgccacgcgatggaggagctgcccgacaccatcgagaccctgatgctcctggccctgatcgccgtcctcaccggcggggtgaccctgttcttcctgtccggccgggggctcggcaagacgagcatcggcctgctgtgcgtgatggcctccagcgtcctcctgtggatggcctccgtggagccccactggatcgcggccagcatcatcctggagttcttcctcatggtgctgctgatccccgagccggaccgccagcggacgccccaggacaaccagctcgcctacgtcgtgatcgggctgctgttcatgatcctcaccgtggccgccaacgagatgggcctgctggagaccacgaagaaggacctcgggatcggccacgtcgcggtggagaaccaccaccacgccgccatgctggacgtggacctgcaccccgcctccgcctggaccctctacgcggtcgccaccaccatcatcacgccgatgatgcgccacaccatcgagaacaccaccgccaacatcagcctgacggccatcgccaaccaggcggccatcctgatggggctcgacaagggctggcccatctccaagatggacatcggcgtgcccctgctggccctcgggtgctacagccaggtgaaccccctgaccctgaccgccgcggtcctcatgctggtggcccactacgccatcatcggcccggggctgcaggccaaggccacccgcgaggcgcagaagcggacggccgccggcatcatgaagaaccccaccgtggacgggatcgtcgccatcgacctcgaccccgtggtgtacgacgccaagttcgagaagcagctgggccagatcatgctgctcatcctgtgcacctcccagatcctgctcatgcgcaccacgtgggcgctgtgcgagagcatcaccctggccaccggccccctcaccacgctgtgggaggggtccccgggcaagttctggaacaccaccatcgccgtcagcatggccaacatcttccgggggtcctacctggccggcgcgggcctcgccttcagcctgatgaagtccctcgggggcgggcgccgggggaccggggcccagggcgagacgctcggcgagaagtggaagcgccagctgaaccagctgtccaagagcgagttcaacacctacaagcggtccgggatcatggaggtggaccgcagcgaggccaaggagggcctcaagcgcggggagaccaccaagcacgcggtgtcccgcggcacggccaagctgcggtggttcgtcgagcgcaacctggtgaagcccgaggggaaggtgatcgacctgggctgcggccgcgggggctggagctactactgcgccgggctcaagaaggtcaccgaggtgaagggctacaccaagggcggccccggccacgaggagcccatcccgatggccacctacgggtggaacctggtgaagctgcactccggcaaggacgtcttcttcatcccgcccgagaagtgcgacacgctcctgtgcgacatcggggagagctcccccaacccgaccatcgaggagggccgcaccctgcgggtgctcaagatggtggagccctggctgcgcgggaaccagttctgcatcaagatcctgaacccctacatgcccagcgtcgtggagaccctcgagcagatgcagcggaagcacggcggcatgctggtgcgcaacccgctgtcccggaacagcacccacgagatgtactgggtctcctgcgggacgggcaacatcgtgagcgccgtgaacatgacctcccgcatgctcctgaaccgcttcaccatggcgcaccggaagcccacctacgagcgcgacgtcgacctgggggccggcacgcggcacgtggccgtggagcccgaggtcgccaacctcgacatcatcggccagcgcatcgagaacatcaagcacgagcacaagagcacctggcactacgacgaggacaacccctacaagacctgggcctaccacgggtcctacgaggtgaagccgagcggctccgcgagcagcatggtcaacggggtggtgaagctgctgaccaagccctgggacgtcatccccatggtgacgcagatcgccatgaccgacaccacccccttcggccagcagcgggtgttcaaggagaaggtcgacacgcgcaccccgaaggccaagcgggggaccgcccagatcatggaggtgaccgccaagtggctctggggcttcctgtcccgcaacaagaagccccggatctgcacgcgcgaggagttcacccggaaggtgcgcagcaacgcggccatcggcgccgtcttcgtggacgagaaccagtggaactccgccaaggaggcggtggaggacgagcggttctgggacctggtccaccgcgagcgggagctccacaagcaggggaagtgcgcgacctgcgtgtacaacatgatgggcaagcgcgagaagaagctgggggagttcggcaaggccaaggggagccgggccatctggtacatgtggctgggcgcccgcttcctcgagttcgaggcgctgggcttcatgaacgaggaccactggttctcccgggagaacagcctgtccggggtggagggcgaggggctccacaagctgggctacatcctgcgcgacatcagcaagatccccgggggcaacatgtacgccgacgacaccgccggctgggacacgcggatcaccgaggacgacctccagaacgaggcccgcatcaccgacatcatggagccggagcacgccctgctggcgaagtccatcttcaagctcacctaccagaacaaggtcgtgcgcgtgcagcggcccgccaagaacgggacggtcatggacgtgatcagccgccgggaccagcgcggctccggccaggtggggacctacggcctgaacaccttcaccaacatggaggcccagctgatccggcagatggagagcgaggggatcttctcccccagcgagctcgagacgcccaacctggccgagcgcgtcctggactggctcgagaagtacggcgtggagcggctgaagcgcatggccatctccggggacgactgcgtggtcaagccgatcgacgaccggttcgcgaccgccctgaccgccctcaacgacatgggcaaggtgcgcaaggacatcccccagtgggagcccagcaaggggtggaacgactggcagcaggtccccttctgctcccaccacttccaccagctgatcatgaaggacggccgggagatcgtcgtgccgtgccgcaaccaggacgagctggtgggccgggcccgcgtcagccagggggccggctggagcctccgggagaccgcgtgcctggggaagtcctacgcccagatgtggcagctgatgtacttccaccgccgggacctccgcctggccgccaacgcgatctgcagcgccgtgcccgtggactggatccccacgtcccggaccacctggagcatccacgcccaccaccagtggatgaccacggaggacatgctgtccgtctggaaccgcgtgtggatcgaggagaacccctggatggaggacaagacccacatcagctcctggggcgacgtgccgtacctcgggaagcgcgaggaccagtggtgcggcagcctgatcggcctgaccgcccgggccacctgggcgaccaacatccaggtcgccatcaaccaggtgcgccggctcatcgggaacgagaactacctggactacatgacgtccatgaagcgcttcaagaacgagagcgaccccgagggcgccctgtggtga

SEQ ID NO: 8316 - RNA, 9879 nt, synthetic construct
  misc_feature 1..9879: note = derived and/or modified CDS sequence (opt1) from DENV-1__FJ024429__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgcgacaagcggtccgtggccctcgcgccccacgtgggcctggggctggagacccgcaccgagacctggatgagctccgagggcgcgtggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggagctggccgagacccagcacggcaccgtgctggtgcagatcaagtacgagggcaccgacgcgccctgcaagatccccttcagcacgcaggacgagaagggggtcacccagaacggccggctgatcaccgccaacccgatcgtgaccgacaaggagaagcccgtgaacatcgaggccgagccgcccttcggggagtcctacatcgtcatcggcgccggcgagaaggcgctcaagctgagctggttcaagaaggggtccagcatcggcaagatgttcgaggccacggcccgcggggcccggcgcatggccatcctgggcgacaccgcgtgggacttcgggtccatcggcggcgtgttcaccagcgtggggaagctcgtccaccagatcttcggcaccgcctacggggtgctgttctccggcgtgagctggacgatgaagatcgggatcggcgtcctgatgacctggctcggcctgaactcccgcagcacctccctgagcatgacctgcatcgccgtggggctcgtgacgctgtacctgggcgtcatggtgcaggccgactccgggtgcgtgatcaactggaagggccgggagctcaagtgcgggagcggcatcttcgtcaccaacgaggtgcacacctggaccgagcagtacaagttccaggccgacagcccgaagcgcctgtccgcggccatcggcaaggcctgggaggagggggtgtgcggcatccggagcgccacccgcctggagaacatcatgtggaagcagatctccaacgagctcaaccacatcctgctggagaacgacatgaagttcacggtcgtggtgggggacgtcgccggcatcctcgcgcaggggaagaagatgatccggccccagcccatggagcacaagtacagctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctgaagctgcgggacagctacacccaggtctgcgaccaccgcctcatgtccgcggccatcaaggacagcaaggccgtgcacgccgacatgggctactggatcgagtccgagaagaacgagacctggaagctggcccgggcgagcttcatcgaggtgaagacgtgcatctggcccaagtcccacaccctgtggagcaacggcgtcctcgagtccgagatgatcatccccaagatctacgggggcccgatcagccagcacaactaccgccccgggtacttcacccagatcgccggcccctggcacctggggaagctggagctcgacttcgacctgtgcgagggcaccacggtggtggtcgacgagcactgcggcaaccgggggccgtccctgcgcaccaccaccgtgacgggcaagatcatccacgagtggtgctgccggagctgcaccctgccgcccctccgcttccgcggggaggacggctgctggtacgggatggagatccgccccgtgaaggagaaggaggagaacctggtcaagtccatggtgagcgccggcagcggcgaggtggactccttcagcctcgggctgctgtgcatctccatcatgatcgaggaggtcatgcggagccgctggtcccggaagatgctcatgaccggcaccctggccgtgttcttcctgctcatcgtggggcagctgacgtggaacgacctgatccgcctctgcatcatggtcggcgccaacgcgagcgaccgcatggggatgggcaccacctacctggccctgatggccaccttcaagatgcggccgatgttcgccgtggggctcctgttccgccggctgacgtcccgcgaggtgctcctgctgaccatcgggctcagcctggtcgcctccgtggagctgcccaacagcctcgaggagctgggcgacgggctggcgatgggcatcatgatcctcaagctgctgaccgacttccagtcccaccagctctgggccaccctgctgagcctcacgttcatcaagaccaccttctccctgcactacgcctggaagaccatggccatggtcctgagcgtggtgtccctcttccccctgtgcctgagcacgacctcccagaagaccacctggctccccgtcctgctgggcagcctcgggtgcaagccgctgacgatgttcctgatcgcggagaacaagatctggggccggcgctcctggcccctcaacgaggggatcatggccgtgggcatcgtgagcatcctgctgagctccctcctgaagaacgacgtccccctggccgggcccctcatcgccggcggcatgctgatcgcctgctacgtgatcagcgggtccagcgcggacctgtccctcgagaaggccgccgaggtgagctgggaggaggaggccgagcactccggcgccagccacaacatcctggtcgaggtgcaggacgacgggaccatgaagatcaaggacgaggagcgggacgacaccctgaccatcctcctgaaggcgaccctgctcgccgtgtccggcgtctacccgctgagcatccccgccacgctgttcgtgtggtacttctggcagaagaagaagcagcgctccggggtgctctgggacacccccagcccgcccgaggtcgagcgggccgtgctggacgacggcatctaccgcatcatgcagcggggcctgctggggcgctcccaggtgggcgtcggggtgttccaggagaacgtgttccacaccatgtggcacgtcacccggggcgccgtgctcatgtaccaggggaagcgcctggagcccagctgggcgtccgtgaagaaggacctgatcagctacggcggcgggtggcggctccagggctcctggaacacgggggaggaggtccaggtgatcgccgtggagcccggcaagaaccccaagaacgtccagaccgcccccgggaccttcaagacccccgagggcgaggtgggcgccatcgccctggacttcaagcccgggacgagcggctcccccatcgtgaaccgcgagcggaagatcgtcgggctgtacggcaacggcgtggtgaccaccagcgggacctacgtcagcgcgatcgcccaggccaaggcctcccaggagggcccgctccccgagatcgaggacgaggtgttccgcaagcggaacctgacgatcatggacctgcaccccgggagcggcaagacccgccggtacctcccggcgatcgtgcgcgaggccatcaagcgcaagctgcggaccctgatcctcgcccccacccgcgtcgtggcctccgagatggccgaggcgctgaaggggatgcccatccggtaccagacgaccgccgtcaagagcgagcacaccggcaaggagatcgtcgacctgatgtgccacgccaccttcacgatgcgcctcctgtcccccgtgcgggtgccgaactacaacatgatcatcatggacgaggcccacttcaccgaccccagctccatcgccgcgcgcggctacatcagcacccgggtcgggatgggcgaggccgccgccatcttcatgaccgccacgccgcccgggtccgtggaggcgttcccgcagagcaacgccgtgatccaggacgaggagcgcgacatccccgagcggtcctggaacagcggctacgagtggatcaccgacttccccgggaagaccgtctggttcgtgccctccatcaagagcggcaacgacatcgccaactgcctgcgcaagaacggcaagcgggtgatccagctctcccgcaagaccttcgacacggagtaccagaagaccaagaacaacgactgggactacgtcgtgaccaccgacatcagcgagatgggggccaacttccgggcggaccgcgtgatcgacccgcggcgctgcctgaagcccgtcatcctgaaggacggccccgagcgggtgatcctcgccgggcccatgccggtcacggtggcctccgccgcccagcgccggggccgcatcgggcgcaaccacaacaaggagggcgaccagtacatctacatgggccagcccctgaacaacgacgaggaccacgcgcactggaccgaggccaagatgctgctcgacaacatcaacacccccgaggggatcatccccgccctgttcgagccggagcgggagaagtccgccgccatcgacggcgagtaccgcctgcgcggggaggcgcgcaagaccttcgtggagctcatgcggcgcggcgacctgcccgtctggctgtcctacaaggtggccagcgaggggttccagtacagcgaccggcgctggtgcttcgacggcgagcggaacaaccaggtgctcgaggagaacatggacgtcgagatctggacgaaggagggcgagcgcaagaagctgcggccccgctggctggacgcccggacctactccgaccccctcgccctgcgcgagttcaaggagttcgccgcggggcggcgcagcgtgtccggcgacctgatcctcgagatcgggaagctgccgcagcacctgacccagcgggcccagaacgccctcgacaacctggtgatgctgcacaacagcgagcagggcggccgcgcctaccggcacgcgatggaggagctccccgacaccatcgagacgctgatgctgctcgccctgatcgccgtcctgaccgggggcgtgaccctcttcttcctgtccgggcgcggcctggggaagaccagcatcggcctcctgtgcgtgatggcctccagcgtcctgctctggatggcctccgtggagccccactggatcgcggccagcatcatcctggagttcttcctgatggtgctcctgatccccgagccggaccggcagcgcacgccccaggacaaccagctggcctacgtcgtgatcggcctcctgttcatgatcctgacggtggccgccaacgagatggggctcctggagaccaccaagaaggacctgggcatcgggcacgtcgcggtggagaaccaccaccacgccgccatgctcgacgtggacctgcaccccgcctccgcctggaccctgtacgcggtcgccacgaccatcatcaccccgatgatgcgccacaccatcgagaacacgaccgccaacatcagcctcaccgccatcgccaaccaggcggccatcctgatgggcctggacaaggggtggcccatctccaagatggacatcggcgtgcccctcctggccctgggctgctacagccaggtgaaccccctcaccctgacggccgcggtcctgatgctcgtggcccactacgccatcatcgggccgggcctgcaggccaaggccacccgggaggcgcagaagcgcaccgccgccgggatcatgaagaaccccaccgtggacggcatcgtcgccatcgacctggaccccgtggtgtacgacgccaagttcgagaagcagctcgggcagatcatgctgctgatcctctgcacgtcccagatcctgctgatgcggaccacctgggcgctctgcgagagcatcaccctggccacgggccccctgaccaccctctgggagggctccccggggaagttctggaacaccacgatcgccgtcagcatggccaacatcttccgcggctcctacctggccggggcgggcctggccttcagcctcatgaagtccctgggcgggggccggcgcgggaccggcgcccagggggagaccctgggcgagaagtggaagcggcagctcaaccagctgtccaagagcgagttcaacacctacaagcgctccggcatcatggaggtggaccggagcgaggccaaggaggggctgaagcgcggcgagacgaccaagcacgcggtgtcccgggggaccgccaagctccgctggttcgtcgagcggaacctggtgaagcccgagggcaaggtgatcgacctggggtgcggccgcggcgggtggagctactactgcgccggcctgaagaaggtcaccgaggtgaaggggtacacgaagggcgggcccggccacgaggagcccatcccgatggccacctacggctggaacctcgtgaagctgcactccgggaaggacgtcttcttcatcccgcccgagaagtgcgacaccctgctctgcgacatcggcgagagctcccccaacccgaccatcgaggaggggcggacgctgcgcgtgctgaagatggtggagccctggctccggggcaaccagttctgcatcaagatcctgaacccctacatgcccagcgtcgtggagaccctggagcagatgcagcgcaagcacgggggcatgctcgtgcggaacccgctgtcccgcaacagcacccacgagatgtactgggtctcctgcggcaccgggaacatcgtgagcgccgtgaacatgacctcccgcatgctgctcaaccggttcacgatggcgcaccgcaagcccacctacgagcgggacgtcgacctgggcgccgggacccgccacgtggccgtggagcccgaggtcgccaacctggacatcatcggccagcggatcgagaacatcaagcacgagcacaagagcacctggcactacgacgaggacaacccctacaagacgtgggcctaccacggctcctacgaggtgaagccgagcgggtccgcgagcagcatggtcaacggcgtggtgaagctcctgaccaagccctgggacgtcatccccatggtgacccagatcgccatgaccgacacgacccccttcgggcagcagcgcgtgttcaaggagaaggtcgacacccggaccccgaaggccaagcgcggcacggcccagatcatggaggtgaccgccaagtggctgtgggggttcctctcccggaacaagaagccccgcatctgcacccgggaggagttcacccgcaaggtgcggagcaacgcggccatcggcgccgtcttcgtggacgagaaccagtggaactccgccaaggaggcggtggaggacgagcgcttctgggacctggtccaccgggagcgcgagctgcacaagcagggcaagtgcgccacgtgcgtgtacaacatgatggggaagcgggagaagaagctcggcgagttcgggaaggccaagggcagccgcgccatctggtacatgtggctgggggcccggttcctggagttcgaggcgctcggcttcatgaacgaggaccactggttctcccgcgagaacagcctgtccggcgtggagggggagggcctgcacaagctcgggtacatcctgcgggacatcagcaagatccccggcgggaacatgtacgccgacgacaccgccggctgggacacccgcatcaccgaggacgacctgcagaacgaggcccgcatcacggacatcatggagccggagcacgccctcctggcgaagtccatcttcaagctgacctaccagaacaaggtcgtgcgggtgcagcgccccgccaagaacggcaccgtcatggacgtgatcagccggcgcgaccagcgggggtccggccaggtggggacctacggcctcaacacgttcaccaacatggaggcccagctgatccgccagatggagagcgagggcatcttctcccccagcgagctggagacccccaacctcgccgagcgggtcctggactggctggagaagtacggggtggagcgcctcaagcggatggccatctccggcgacgactgcgtggtcaagccgatcgacgaccgcttcgcgaccgccctgacggccctgaacgacatggggaaggtgcggaaggacatcccccagtgggagcccagcaagggctggaacgactggcagcaggtccccttctgctcccaccacttccaccagctcatcatgaaggacgggcgcgagatcgtcgtgccgtgccggaaccaggacgagctggtgggccgcgcccgggtcagccagggcgccgggtggagcctgcgcgagaccgcgtgcctcggcaagtcctacgcccagatgtggcagctgatgtacttccaccggcgcgacctgcggctcgccgccaacgcgatctgcagcgccgtgcccgtggactggatccccacctcccgcaccacgtggagcatccacgcccaccaccagtggatgaccaccgaggacatgctgtccgtctggaaccgcgtgtggatcgaggagaacccctggatggaggacaagacccacatcagctcctggggcgacgtgccgtacctgggcaagcgggaggaccagtggtgcgggagcctcatcggcctgacggcccgcgccacctgggcgaccaacatccaggtcgccatcaaccaggtgcggcgcctgatcggcaacgagaactacctcgactacatgacctccatgaagcggttcaagaacgagagcgaccccgagggggccctgtggtga

SEQ ID NO: 8317 - RNA, 9879 nt, synthetic construct
  misc_feature 1..9879: note = derived and/or modified CDS sequence (opt1) from DENV-1__FJ024430__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgagaccgagcccgacgacgtggactgctggtgcaacgccacggacacctgggtgacctacgggacctgcagccagacgggcgagcaccggcgcgacaagcggtccgtggccctcgcgccccacgtgggcctggggctggagacccgcaccgagacctggatgagctccgagggcgcgtggaagcagatccagcgggtggagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtcgggaagctggtgcaccagatcttcggcaccgcctacggggtcctcttctccggcgtcagctggacgatgaagatcgggatcggcgtgctgctgacctggctcggcctgaactcccgcagcacctccctgagcatgacctgcatcgccgtggggctcgtcacgctgtacctgggcgtgatggtgcaggccgactccgggtgcgtcatcaactggaagggccgggagctcaagtgcgggagcggcatcttcgtgaccaacgaggtgcacacctggaccgagcagtacaagttccaggccgacagcccgaagcgcctgtccgcggccatcggcaaggcctgggaggagggggtctgcggcatccggagcgccacccgcctggagaacatcatgtggaagcagatctccaacgagctcaaccacatcctgctggagaacgacatgaagttcacggtggtggtcggggacgtggccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtcgaggactacggcttcgggatcttcacgaccaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacgtgcatctggcccaagtcccacaccctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcacgaccgtggtcgtggacgagcactgcggcaaccgggggccgtccctgcgcaccaccacggtgaccggcaagatcatccacgagtggtgctgccggagctgcaccctgccgcccctccgcttccgcggggaggacggctgctggtacgggatggagatccgccccgtcaaggagaaggaggagaacctggtgaagtccatggtgagcgccggcagcggcgaggtcgactccttcagcctcgggctgctgtgcatctccatcatgatcgaggaggtgatgcggagccgctggtcccggaagatgctcatgaccggcacgctggccgtgttcttcctgctcatcatggggcagctgacctggaacgacctgatccgcctctgcatcatggtcggcgccaacgcgagcgaccgcatggggatgggcaccacctacctggccctgatggccacgttcaagatgcggccgatgttcgccgtggggctcctgttccgccggctgacctcccgcgaggtgctcctgctgaccatcgggctcagcctggtcgcctccgtggagctgcccaacagcctcgaggagctgggcgacgggctggcgatgggcatcatgatcctcaagctgctgaccgacttccagtcccaccagctctgggccacgctgctgagcctcaccttcatcaagaccaccttctccctgcactacgcctggaagacgatggccatggtcctgagcatcgtgtccctcttccccctgtgcctgagcaccacctcccagaagaccacgtggctccccgtgctgctgggcagcctcgggtgcaagccgctgaccatgctgctcatcgcggagaacaagatctggggccggcgctcctggcccctgaacgaggggatcatggccgtcggcatcgtgagcatcctgctcagctccctgctgaagaacgacgtgcccctcgccgggcccctgatcgccggcggcatgctgatcgcctgctacgtcatcagcgggtccagcgcggccctctccctggagaaggccgccgaggtgagctgggaggaggaggccgagcactccggcgcgagccacaacatcctggtggaggtccaggacgacgggaccatgaagatcaaggacgaggagcgggacgacaccctcaccatcctgctgaaggccacgctcctggccgtgtccggcgtgtacccgctgagcatccccgccaccctcttcgtctggtacttctggcagaagaagaagcagcgctccggggtgctgtgggacacccccagcccgcccgaggtgggccgggccgtcctggacgacggcatctaccgcatcatgcagcgggggctgctcggccgctcccaggtgggggtgggcgtcttccaggagaacgtgttccacaccatgtggcacgtgacgcgcggggccgtcctgatgtaccagggcaagcggctggagcccagctgggcctccgtgaagaaggacctcatcagctacggcgggggctggcggctgcaggggtcctggaacaccggcgaggaggtgcaggtcatcgccgtggagcccgggaagaaccccaagaacgtgcagaccgcccccggcaccttcaagacgcccgagggcgaggtcggggccatcgcgctggacttcaagcccggcaccagcgggtcccccatcgtgaaccgcgagggcaagatcgtgggcctctacgggaacggcgtcgtgaccaccagcgggacgtacgtgagcgccatcgcccaggccaaggcgtcccaggagggcccgctgcccgagatcgaggacgaggtcttccggaagcgcaacctgaccatcatggacctccaccccgggagcggcaagacccggcgctacctgccggccatcgtgcgggaggccatcaagcgcaagctgcgcaccctcatcctggcccccacgcgggtggtcgcctccgagatggcggaggccctgaagggcatgcccatccgctaccagaccaccgccgtcaagagcgagcacaccgggaaggagatcgtggacctcatgtgccacgccacgttcaccatgcggctgctgtcccccgtccgcgtgccgaactacaacatgatcatcatggacgaggcccacttcaccgaccccagctccatcgcggcccggggctacatcagcacccgcgtggggatgggcgaggccgccgccatcttcatgacggcgacgccgcccgggtccgtcgaggccttcccgcagagcaacgccgtgatccaggacgaggagcgggacatccccgagcgctcctggaacagcggctacgagtggatcaccgacttccccggcaagaccgtgtggttcgtcccctccatcaagagcgggaacgacatcgccaactgcctccggaagaacggcaagcgcgtgatccagctgtcccggaagacgttcgacaccgagtaccagaagaccaagaacaacgactgggactacgtggtcaccacggacatcagcgagatgggggcgaacttccgcgccgaccgggtgatcgacccgcgccggtgcctgaagcccgtgatcctcaaggacggccccgagcgcgtcatcctggccgggcccatgccggtgaccgtcgcctccgccgcgcagcggcgcggccggatcggccgcaaccacaacaaggagggggaccagtacatctacatgggccagcccctgaacaacgacgaggaccacgcccactggaccgaggccaagatgctcctggacaacatcaacacccccgaggggatcatccccgccctgttcgagccggagcgcgagaagtccgccgcgatcgacggcgagtaccggctccgcggggaggcccggaagacgttcgtggagctgatgcgccggggcgacctgcccgtgtggctctcctacaaggtcgccagcgagggcttccagtacagcgaccgccggtggtgcttcgacggggagcgcaacaaccaggtgctggaggagaacatggacgtggagatctggaccaaggagggcgagcggaagaagctgcgcccccggtggctcgacgcccgcacctactccgaccccctggccctgcgggagttcaaggagttcgcggccgggcgccggagcgtctccggcgacctcatcctggagatcggcaagctgccgcagcacctcacccagcgcgcccagaacgccctggacaacctggtgatgctccacaacagcgagcagggcgggcgggcgtaccgccacgccatggaggagctgcccgacacgatcgagaccctgatgctcctggccctgatcgccgtgctcaccgggggcgtcaccctgttcttcctgtccgggcggggcctcggcaagaccagcatcgggctgctgtgcgtgatggcctccagcgtgctcctgtggatggcgtccgtcgagccccactggatcgccgccagcatcatcctggagttcttcctcatggtgctgctgatccccgagccggaccgccagcggacgccccaggacaaccagctcgcctacgtggtcatcggcctgctgttcatgatcctcaccgtggccgcgaacgagatggggctgctggagaccaccaagaaggacctcggcatcgggcacgtggccgtcgagaaccaccaccacgccgccatgctggacgtggacctgcaccccgcctccgcgtggacgctctacgccgtggccaccaccatcatcaccccgatgatgcgccacacgatcgagaacaccaccgccaacatcagcctgaccgccatcgcgaaccaggccgccatcctgatgggcctcgacaagggctggcccatctccaagatggacatcggggtccccctgctggccctcggctgctacagccaggtgaaccccctgacgctgaccgcggccgtgctcatgctggtcgcccactacgccatcatcgggccgggcctgcaggccaaggcgacccgcgaggcccagaagcggaccgccgccgggatcatgaagaaccccacggtggacggcatcgtggccatcgacctcgaccccgtcgtgtacgacgcgaagttcgagaagcagctgggccagatcatgctgctcatcctgtgcacctcccagatcctgctcatgcgcaccacctgggccctgtgcgagagcatcacgctggccaccgggcccctcaccaccctgtgggagggctccccggggaagttctggaacacgaccatcgccgtgagcatggccaacatcttccggggctcctacctggcgggcgccgggctcgccttcagcctgatgaagtccctgggcgggggccgccgggggaccggcgcccagggcgagaccctcggggagaagtggaagcgccagctgaaccagctgtccaagagcgagttcaacacgtacaagcggtccggcatcatggaggtcgaccgcagcgaggcgaaggaggggctcaagcggggcgagaccaccaagcacgccgtgtcccgcgggaccgccaagctgcggtggttcgtggagcgcaacctggtcaagcccgagggcaaggtgatcgacctgggctgcgggcggggcgggtggagctactactgcgccggcctcaagaaggtgacggaggtcaaggggtacaccaagggcggccccgggcacgaggagcccatcccgatggccacctacggctggaacctggtgaagctgcactccgggaaggacgtgttcttcatcccgcccgagaagtgcgacaccctcctgtgcgacatcggcgagagctcccccaacccgacgatcgaggaggggcgcaccctgcgggtcctcaagatggtggagccctggctgcgcggcaaccagttctgcatcaagatcctgaacccctacatgcccagcgtggtcgagaccctcgagcagatgcagcggaagcacggcgggatgctggtgcgcaacccgctgtcccggaacagcacccacgagatgtactgggtgtcctgcggcaccgggaacatcgtcagcgcggtgaacatgacgtcccgcatgctcctgaaccgcttcaccatggcccaccggaagcccacctacgagcgcgacgtggacctgggcgccggcacccggcacgtcgccgtggagcccgaggtggccaacctcgacatcatcgggcagcgcatcgagaacatcaagcacgagcacaagagcacgtggcactacgacgaggacaacccctacaagacctgggcgtaccacggctcctacgaggtcaagccgagcgggtccgccagcagcatggtgaacggcgtcgtgaagctgctgaccaagccctgggacgtgatccccatggtcacccagatcgccatgacggacaccacccccttcgggcagcagcgggtgttcaaggagaaggtggacacccgcacgccgaaggccaagcggggcaccgcccagatcatggaggtcaccgcgaagtggctctggggcttcctgtcccgcaacaagaagccccggatctgcacccgcgaggagttcacgcggaaggtgcgcagcaacgccgccatcggggccgtgttcgtcgacgagaaccagtggaactccgcgaaggaggccgtggaggacgagcggttctgggacctggtgcaccgcgagcgggagctccacaagcagggcaagtgcgcgacctgcgtctacaacatgatggggaagcgcgagaagaagctgggcgagttcgggaaggccaagggcagccgggccatctggtacatgtggctgggcgcgcgcttcctcgagttcgaggccctggggttcatgaacgaggaccactggttctcccgggagaacagcctgtccggcgtggagggggagggcctccacaagctggggtacatcctgcgcgacatcagcaacatccccggcggcaacatgtacgccgacgacaccgccgggtgggacacccggatcacggaggacgacctccagaacgaggcccgcatcaccgacatcatggagccggagcacgcgctgctggccaagtccatcttcaagctcacctaccagaacaaggtggtccgcgtgcagcggcccaccaagaacggcacggtgatggacgtcatcagccgccgggaccagcgcgggtccggccaggtgggcacctacgggctgaacaccttcaccaacatggaggcccagctgatccggcagatggagagcgagggcatcttctcccccagcgagctcgagacgcccaacctggccgagcgcgtgctggactggctcgagaagtacggggtcgagcggctgaagcgcatggccatctccggcgacgactgcgtggtgaagccggtcgacgaccggttcgcgaccgccctgaccgccctcaacgacatggggaaggtgcgcaaggacatcccccagtgggagcccagcaagggctggaacgactggcagcaggtccccttctgctcccaccacttccaccagctgatcatgaaggacggccgggagatcgtcgtgccgtgccgcaaccaggacgagctggtggggcgggcccgcgtcagccagggcgccgggtggagcctccgggagaccgcgtgcctgggcaagtcctacgcccagatgtggcagctgatgtacttccaccgccgggacctccgcctggccgccaacgcgatctgcagcgccgtgcccgtggactggatccccacgtcccggaccacctggagcatccacgcccaccaccagtggatgaccacggaggacatgctgtccgtctggaaccgcgtgtggatcgaggagaacccctggatggaggacaagacccacatcagctcctggggcgacgtgccgtacctcggcaagcgcgaggaccagtggtgcggcagcctgatcgggctgaccgcccgggccacctgggcgaccaacatccaggtcgccatcaaccaggtgcgccggctcatcggcaacgagaactacctggactacatgacgtccatgaagcgcttcaagaacgagagcgaccccgagggggccctgtggtga

SEQ ID NO: 8318 - RNA, 9879 nt, synthetic construct
  misc_feature 1..9879: note = derived and/or modified CDS sequence (opt1) from DENV-1__FJ024433__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgagaccgagcccgacgacgtggactgctggtgcaacgccacggacacctgggtgacctacgggacctgcagccagacgggcgagcaccggcgcgacaagcggtccgtggccctcgcgccccacgtgggcctggggctggagacccgcaccgagacctggatgagctccgagggcgcgtggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcatctcccaggagacgtggaaccggcaggacctgctggtgaccttcaagaccgcccacgccaagaagcaggaggtcgtggtgctcggcagccaggagggcgcgatgcacaccgccctgacgggggccaccgagatccagacctccggcaccacgaccatcttcgccgggcacctgaagtgccgcctcaagatggacaagctgaccctgcggggcatgagctacgtcatgtgcaccgggtccttcaagctcgagaaggaggtggccgagacgcagcacggcaccgtgctggtccagatcaagtacgagggcaccgacgcgccctgcaagatccccttcagcacccaggacgagaagggggtgacgcagaacggccgcctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccaccgcccgcggggcccgccgcatggccatcctgggcgacacggcgtgggacttcgggtccatcggcggcgtgttcaccagcgtcgggaagctggtgcaccagatcttcggcaccgcctacggggtgctgttctccggcgtcagctggaccatgaagatcgggatcggcgtgctgctgacgtggctcggcctgaactcccggagcacctccctgagcatgacctgcatcgccgtggggctcgtcaccctgtacctgggcgtgatggtgcaggccgactccgggtgcgtcatcaactggaagggccgcgagctcaagtgcgggagcggcatcttcgtgacgaacgaggtgcacacctggaccgagcagtacaagttccaggccgacagcccgaagcggctgtccgcggccatcggcaaggcctgggaggagggggtctgcggcatccgcagcgccacccggctggagaacatcatgtggaagcagatctccaacgagctcaaccacatcctgctggagaacgacatgaagttcaccgtggtggtcggggacgtggccggcatcctcgcgcaggggaagaagatgatccgcccccagcccatggagcacaagtacagctggaagtcctggggcaaggccaagatcatcggcgccgacgtgcagaacacgaccttcatcatcgacgggcccaacaccccggagtgccccgacgaccagcgggcctggaacatctgggaggtcgaggactacggcttcgggatcttcaccacgaacatctggctgaagctgcgcgacagctacacccaggtgtgcgaccaccggctcatgtccgcggccatcaaggacagcaaggccgtgcacgccgacatgggctactggatcgagtccgagaagaacgagacctggaagctggcccgcgcgagcttcatcgaggtcaagacctgcatctggcccaagtcccacacgctgtggagcaacggcgtgctcgagtccgagatgatcatccccaagatctacgggggcccgatcagccagcacaactaccggcccgggtacttcacccagaccgccggcccctggcacctggggaagctggagctcgacttcgacctgtgcgagggcaccacggtggtcgtggacgagcactgcggcaaccgcgggccgtccctgcggaccaccaccgtgacgggcaagatcatccacgagtggtgctgccgcagctgcaccctgccgcccctccggttccgcggggaggacggctgctggtacgggatggagatccggcccgtcaaggagaaggaggagaacctggtgaagtccatggtgagcgccggcagcggcgaggtcgactccttcagcctcgggctgctgtgcatctccatcatgatcgaggaggtgatgcgcagccggtggtcccgcaagatgctcatgaccggcaccctggccgtgttcttcctgctcatcatggggcagctgacgtggaacgacctgatccgcctctgcatcatggtcggcgccaacgcgagcgaccggatggggatgggcaccacctacctggccctgatggccaccttcaagatgcgcccgatgttcgccgtggggctcctgttccggcgcctgacgtcccgggaggtgctcctgctgaccatcgggctcagcctggtcgcctccgtggagctgcccaacagcctcgaggagctgggcgacgggctggcgatgggcatcatgatcctcaagctgctgaccgacttccagtcccaccagctctgggccaccctgctgagcctcacgttcatcaagaccaccttctccctgcactacgcctggaagaccatggccatggtcctgagcatcgtgtccctcttccccctgtgcctgagcacgacctcccagaagaccacctggctccccgtgctgctgggcagcctcgggtgcaagccgctgacgatgttcctgatcgcggagaacaagatctggggccgccggtcctggcccctcaacgaggggatcatggccgtcggcatcgtgagcatcctgctgagctccctcctgaagaacgacgtgcccctggccgggcccctcatcgccggcggcatgctgatcgcctgctacgtcatcagcgggtccagcgcggacctgtccctcgagaaggccgccgaggtgagctgggaggaggaggccgagcactccggcgccagccacaacatcctggtggaggtccaggacgacgggaccatgaagatcaaggacgaggagcgcgacgacaccctgaccatcctcctgaaggcgaccctgctcgccgtgtccggcgtgtacccgctgagcatccccgccacgctgttcgtctggtacttctggcagaagaagaagcagcggtccggggtgctctgggacacccccagcccgcccgaggtggagcgcgccgtcctggacgacggcatctaccggatcatgcagcgcggcctgctggggcggtcccaggtgggcgtgggggtcttccaggagaacgtgttccacaccatgtggcacgtgacccgcggcgccgtcctcatgtaccaggggaagcggctggagcccagctgggcgtccgtgaagaaggacctgatcagctacggcggcgggtggcgcctccagggctcctggaacacgggggaggaggtgcaggtcatcgccgtggagcccggcaagaaccccaagaacgtgcagaccgcccccgggaccttcaagacccccgagggcgaggtcggcgccatcgccctggacttcaagcccgggacgagcggctcccccatcgtgaaccgggaggggaagatcgtgggcctgtacggcaacggggtcgtgaccaccagcggcacctacgtgagcgcgatcgcccaggccaaggcctcccaggaggggccgctccccgagatcgaggacgaggtcttccgcaagcggaacctgacgatcatggacctgcaccccggcagcgggaagacccgccggtacctcccggcgatcgtgcgcgaggccatcaagcgcaagctgcggaccctgatcctcgcccccacccgcgtggtcgcctccgagatggccgaggcgctgaagggcatgcccatccggtaccagacgaccgccgtcaagagcgagcacaccggcaaggagatcgtggacctgatgtgccacgccaccttcacgatgcgcctcctgtcccccgtccgggtgccgaactacaacatgatcatcatggacgaggcccacttcaccgaccccagctccatcgccgcgcgcgggtacatcagcacccgggtgggcatgggggaggccgccgccatcttcatgaccgccacgccgcccggctccgtcgaggcgttcccgcagagcaacgccgtgatccaggacgaggagcgcgacatccccgagcggtcctggaacagcgggtacgagtggatcaccgacttccccggcaagaccgtgtggttcgtcccctccatcaagagcggcaacgacatcgccaactgcctgcgcaagaacgggaagcgggtgatccagctctcccgcaagaccttcgacacggagtaccagaagaccaagaacaacgactgggactacgtggtcaccaccgacatcagcgagatgggcgccaacttccgggcggaccgcgtgatcgacccgcggcgctgcctgaagcccgtgatcctgaaggacgggcccgagcgggtcatcctcgccggccccatgccggtgacggtcgcctccgccgcccagcgccgggggcgcatcggccgcaaccacaacaaggagggcgaccagtacatctacatggggcagcccctgaacaacgacgaggaccacgcgcactggaccgaggccaagatgctgctcgacaacatcaacacccccgagggcatcatccccgccctgttcgagccggagcgggagaagtccgccgccatcgacggggagtaccgcctgcggggcgaggcgcgcaagaccttcgtggagctcatgcggcgcggggacctgcccgtgtggctgtcctacaaggtcgccagcgagggcttccagtacagcgaccggcgctggtgcttcgacggcgagcggaacaaccaggtgctcgaggagaacatggacgtggagatctggacgaaggagggggagcgcaagaagctgcggccccgctggctggacgcccggacctactccgaccccctcgccctgcgcgagttcaaggagttcgccgcgggccggcgcagcgtctccggggacctgatcctcgagatcggcaagctgccgcagcacctgacccagcgggcccagaacgccctcgacaacctggtgatgctgcacaacagcgagcagggcgggcgcgcctaccggcacgcgatggaggagctccccgacaccatcgagacgctgatgctgctcgccctgatcgccgtgctgaccggcggggtcaccctcttcttcctgtccggccgcgggctgggcaagaccagcatcggcctcctgtgcgtgatggcctccagcgtgctgctctggatggcctccgtcgagccccactggatcgcggccagcatcatcctggagttcttcctgatggtgctcctgatccccgagccggaccggcagcgcacgccccaggacaaccagctggcctacgtggtcatcgggctcctgttcatgatcctgacggtggccgccaacgagatgggcctcctggagaccaccaagaaggacctggggatcggccacgtggcggtcgagaaccaccaccacgccgccatgctcgacgtggacctgcaccccgcctccgcctggaccctgtacgcggtggccacgaccatcatcaccccgatgatgcgccacaccatcgagaacacgaccgccaacatcagcctcaccgccatcgccaaccaggcggccatcctgatggggctggacaagggctggcccatctccaagatggacatcggcgtccccctcctggccctggggtgctacagccaggtgaaccccctcaccctgacggccgcggtgctgatgctcgtcgcccactacgccatcatcggcccggggctgcaggccaaggccacccgggaggcgcagaagcgcaccgccgccggcatcatgaagaaccccaccgtggacgggatcgtggccatcgacctggaccccgtcgtgtacgacgccaagttcgagaagcagctcggccagatcatgctgctgatcctctgcacgtcccagatcctgctgatgcggaccacctgggcgctctgcgagagcatcaccctggccacgggccccctgaccaccctctgggaggggtccccgggcaagttctggaacaccacgatcgccgtgagcatggccaacatcttccgcgggtcctacctggccggcgcgggcctggccttcagcctcatgaagtccctcgggggcgggcggcgcgggaccggggcccagggcgagaccctgggcgagaagtggaagcggcagctcaaccagctgtccaagagcgagttcaacacctacaagcgctccgggatcatggaggtcgaccggagcgaggccaaggagggcctgaagcgcggggagacgaccaagcacgcggtgtcccggggcaccgccaagctccgctggttcgtggagcggaacctggtcaagcccgaggggaaggtgatcgacctgggctgcggccgcgggggctggagctactactgcgccgggctgaagaaggtgaccgaggtcaagggctacacgaagggcgggcccggccacgaggagcccatcccgatggccacctacgggtggaacctcgtgaagctgcactccggcaaggacgtgttcttcatcccgcccgagaagtgcgacaccctgctctgcgacatcggggagagctcccccaacccgaccatcgaggagggccggacgctgcgcgtcctgaagatggtggagccctggctccgggggaaccagttctgcatcaagatcctgaacccctacatgcccagcgtggtcgagaccctggagcagatgcagcgcaagcacggcggcatgctcgtgcggaacccgctgtcccgcaacagcacccacgagatgtactgggtgtcctgcgggaccggcaacatcgtcagcgccgtgaacatgacctcccgcatgctgctcaaccggttcacgatggcgcaccgcaagcccacctacgagcgggacgtggacctgggggccggcacccgccacgtcgccgtggagcccgaggtggccaacctggacatcatcggccagcggatcgagaacatcaagcacgagcacaagagcacctggcactacgacgaggacaacccctacaagacgtgggcctaccacgggtcctacgaggtcaagccgagcggctccgcgagcagcatggtgaacggggtcgtgaagctcctgaccaagccctgggacgtgatccccatggtcacccagatcgccatgaccgacacgacccccttcggccagcagcgcgtgttcaaggagaaggtggacacccggaccccgaaggccaagcgcgggacggcccagatcatggaggtcaccgccaagtggctgtggggcttcctctcccggaacaagaagccccgcatctgcacccgggaggagttcacccgcaaggtgcggagcaacgcggccatcggcgccgtgttcgtcgacgagaaccagtggaactccgccaaggaggcggtggaggacgagcgcttctgggacctggtgcaccgggagcgcgagctgcacaagcaggggaagtgcgccacgtgcgtctacaacatgatgggcaagcgggagaagaagctcggggagttcggcaaggccaaggggagccgcgccatctggtacatgtggctgggcgcccggttcctggagttcgaggcgctcggcttcatgaacgaggaccactggttctcccgcgagaacagcctgtccggggtggagggcgaggggctgcacaagctcggctacatcctgcgggacatcagcaagatccccgggggcaacatgtacgccgacgacaccgccggctgggacacccgcatcaccgaggacgacctgcagaacgaggcccgcatcacggacatcatggagccggagcacgccctcctggcgaagtccatcttcaagctgacctaccagaacaaggtggtccgggtgcagcgccccgccaagaacgggaccgtgatggacgtcatcagccggcgcgaccagcggggctccggccaggtgggcacctacggcctcaacacgttcaccaacatggaggcccagctgatccgccagatggagagcgaggggatcttctcccccagcgagctggagacccccaacctcgccgagcgggtgctggactggctggagaagtacggcgtcgagcgcctcaagcggatggccatctccggggacgactgcgtggtgaagccgatcgacgaccgcttcgcgaccgccctgacggccctgaacgacatgggcaaggtccggaaggacatcccccagtgggagcccagcaaggggtggaacgactggcagcaggtccccttctgctcccaccacttccaccagctcatcatgaaggacggccgcgagatcgtggtcccgtgccggaaccaggacgagctggtgggccgcgcccgggtgagccagggggccggctggaacctgcgcgagaccgcgtgcctcggcaagagctacgcccagatgtggcagctgatgtacttccaccggcgcgacctgcggctcgccgccaacgcgatctgctccgccgtccccgtggactggatccccaccagccgcaccacgtggtccatccacgcccaccaccagtggatgaccaccgaggacatgctgagcgtgtggaaccgcgtctggatcgaggagaacccctggatggaggacaagacccacatctccagctgggaggacgtgccgtacctgggcaagcgggaggaccagtggtgcgggtccctcatcggcctgacggcccgcgccacctgggcgaccaacatccaggtggccatcaaccaggtccggcgcctgatcggcaacgagaactacctcgactacatgaccagcatgaagcggttcaagaacgagtccgaccccgagggggccctgtggtga

SEQ ID NO: 8319 - RNA, 9879 nt, synthetic construct
  misc_feature 1..9879: note = derived and/or modified CDS sequence (opt1) from DENV-1__FJ024434__SS-prME
  source 1..9879: mol_type = other RNA
agcgtgaccatgctgctcatgctgatgcccaccgccctggccttccacctcaccacccgcggcggggagccccacatgatcgtgagcaagcaggagcggggcaagagcctgctgttcaagaccagcgccggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtcctcttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggccgactccgggtgcgtcatcaactggaagggccgggagctcaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctggagaacatcatgtggaagcagatctccaacgagctcaaccacatcctgctggagaacgacatgaagctcaccgtggtggtcggggacgtggcgggcatcctggggcagggcaagaagatgatccggccccagcccatggagtacaagtacagctggaagtcctggggcaaggccaagatcatcggggccgacgcccagaacacgaccttcatcatcgacggccccaacaccccggagtgccccgacgaccagcgcgcgtggaacatctgggaggtggaggactacgggttcggcatcttcaccacgaacatctggctgaagctccgggacagctacacccaggtctgcgaccaccgcctgatgtccgccgccatcaaggacagcaaggccgtgcacgccgacatgggctactggatcgagtccgagaagaacgagacctggaagctggcgcgggccagcttcatcgaggtgaagacctgcatctggcccaagtcccacacgctctggagcaacggggtcctggagtccgagatgatcatccccaagatctacggcgggccgatcagccagcacaactaccgccccggctacttcacccagaccgccgggccctggcacctgggcaagctcgagctggacttcgacctgtgcgagggcaccacggtggtggtcgacgagcactgcgggaaccggggcccgtccctccgcaccaccaccgtgacggggaagatcatccacgagtggtgctgccggagctgcaccctgccgcccctgcgcttccggggcgaggacgggtgctggtacggcatggagatccgccccgtgaaggagaaggaggagaacctcgtcaagtccatggtgagcgccggcagcggggaggtggactccttcagcctgggcctgctctgcatctccatcatgatcgaggaggtcatgcggagccgctggtcccggaagatgctgatgaccgggaccctggccgtgttcttcctcctgatcatgggccagctgacgtggaacgacctcatccgcctgtgcatcatggtgggggcgaacgccagcgaccgcatgggcatgggcaccacctacctggccctcatggccaccttcaagatgcggccgatgttcgccgtcgggctgctgttccgccggctcacgtcccgcgaggtgctgctgctcaccatcggcctgagcctggtggcgtccgtcgagctccccaacagcctggaggagctgggggacggcctcgccatgggcatcatgatcctgaagctgctcaccgacttccagtcccaccagctgtgggccaccctgctcagcctgacgttcatcaagaccaccttctccctgcactacgcctggaagaccatggcgatggtgctcagcatcgtctccctgttccccctgtgcctcagcacgacctcccagaagaccacctggctgcccgtgctgctcgggagcctgggctgcaagccgctgacgatgttcctcatcgccgagaacaagatctgggggcggaagtcctggcccctgaacgagggcatcatggccgtggggatcgtcagcatcctgctcagctccctgctgaagaacgacgtgcccctcgccggccccctgatcgccggcgggatgctgatcgcgtgctacgtgatcagcggctccagcgccgacctctccctggagaaggccgccgaggtcagctgggaggaggaggccgagcactccggggcgagccacaacatcctggtggaggtgcaggacgacggcaccatgaagatcaaggacgaggagcgcgacgacaccctcaccatcctgctgaaggccaccctcctggccgtctccggggtgtacccgctgagcatccccgccaccctcttcgtgtggtacttctggcagaagaagaagcagcggtccggcgtcctgtgggacacccccagcccgcccgaggtggagcgcgccgtgctggacgacggcatctaccggatcatgcagcgcgggctgctcggccggtcccaggtcggggtgggcgtgttccaggagaacgtcttccacaccatgtggcacgtgacccgcggggcggtgctgatgtaccagggcaagcggctggagcccagctgggcctccgtcaagaaggacctcatcagctacggcgggggctggcgcctgcgggggtcctggaacacgggcgaggaggtccaggtgatcgccgtcgagcccgggaagaaccccaagaacgtgcagaccgcccccggcaccttcaagacccccgagggcgaggtgggggccatcgcgctggacttcaagcccggcacgagcgggtcccccatcgtcaaccgcgagggcaagatcgtgggcctctacgggaacggcgtggtcaccaccagcgggacctacgtgagcgccatcgcccaggccaaggcgtcccaggagggcccgctgcccgagatcgaggacgaggtgttccggaagcgcaacctgacgatcatggacctccaccccgggagcggcaagacccggcgctacctgccggccatcgtccgggaggccatcaagcgcaagctgcgcaccctcatcctggcccccacccgggtggtggcctccgagatggcggaggccctgaagggcatgcccatccgctaccagacgaccgccgtcaagagcgagcacaccgggaaggagatcgtggacctcatgtgccacgccaccttcacgatgcggctgctgtcccccgtgcgcgtcccgaactacaacatgatcatcatggacgaggcccacttcaccgaccccagctccatcgcggcccggggctacatcagcacccgcgtggggatgggcgaggccgccgccatcttcatgaccgcgacgccgcccgggtccgtggaggccttcccgcagagcaacgccgtcatccaggacgaggagcgggacatccccgagcgctcctggaacagcggctacgagtggatcaccgacttccccggcaagaccgtgtggttcgtgccctccatcaagagcgggaacgacatcgccaactgcctccggaagaacggcaagcgcgtcatccagctgtcccggaagaccttcgacacggagtaccagaagaccaagaacaacgactgggactacgtggtgaccaccgacatcagcgagatgggggcgaacttccgcgccgaccgggtcatcgacccgcgccggtgcctgaagcccgtgatcctcaaggacggccccgagcgcgtgatcctggccgggcccatgccggtcacggtggcctccgccgcgcagcggcgcggccggatcggccgcaaccacaacaaggagggggaccagtacatctacatgggccagcccctgaacaacgacgaggaccacgcccactggaccgaggccaagatgctcctggacaacatcaacacccccgaggggatcatccccgccctgttcgagccggagcgcgagaagtccgccgcggtcgacggcgagtaccggctccgcggggaggcccggaagaccttcgtggagctgatgcgccggggcgacctgcccgtgtggctctcctacaaggtcgccagcgagggcttccagtacagcgaccgccggtggtgcttcgacggggagcgcaacaaccaggtgctggaggagaacatggacgtggagatctggacgaaggagggcgagcggaagaagctgcgcccccggtggctcgacgcccgcacctactccgaccccctggccctgcgggagtacaaggagttcgcggccgggcgccggagcgtctccggcgacctcatcctggagatcggcaagctgccgcagcacctcacccagcgcgcccagaacgccctggacaacctggtgatgctccacaacagcgagcagggcgggcgggcgtaccgccacgccatggaggagctgcccgacaccatcgagacgctgatgctcctggccctgatcgccgtgctcaccgggggcgtcaccctgttcttcctgtccgggcggggcctcggcaagaccagcatcgggctgctgtgcgtgatggcctccagcgtgctcctgtggatggcgtccgtcgagccccactggatcgccgccagcatcatcctggagttcttcctcatggtgctgctgatccccgagccggaccgccagcggacgccccaggacaaccagctcgcctacgtggtcatcggcctgctgttcatgatcctcacggtggccgcgaacgagatggggctgctggagaccaccaagaaggacctcggcatcgggcacgtggccgtcgagaaccaccaccacgccgccatgctggacgtggacctgcaccccgcctccgcgtggaccctctacgccgtggccacgaccatcatcaccccgatgatgcgccacaccatcgagaacacgaccgccaacatcagcctgaccgccatcgcgaaccaggccgccatcctgatgggcctcgacaagggctggcccatctccaagatggacatcggggtccccctgctggccctcggctgctacagccaggtgaaccccctgaccctgacggcggccgtgctcatgctggtcgcccactacgccatcatcgggccgggcctgcaggccaaggcgacccgcgaggcccagaagcggaccgccgccgggatcatgaagaaccccaccgtggacggcatcgtggccatcgacctcgaccccgtcgtgtacgacgcgaagttcgagaagcagctgggccagatcatgctgctcatcctgtgcacgtcccagatcctgctcatgcgcaccacctgggccctgtgcgagagcatcaccctggccgccgggcccctcacgaccctgtgggagggctccccggggaagttctggaacaccaccatcgccgtgagcatggcgaacatcttccggggctcctacctggccggcgccgggctcgccttcagcctgatgaagtccctgggcgggggccgccgggggacgggcgcgcagggcgagaccctcggggagaagtggaagcgccagctgaaccagctgtccaagagcgagttcaacacctacaagcggtccggcatcatggaggtcgaccgcagcgaggccaaggaggggctcaagcggggcgagaccacgaagcacgccgtgtcccgcgggaccgccaagctgcggtggttcgtggagcgcaacctggtcaagcccgagggcaaggtgatcgacctgggctgcgggcggggcgggtggagctactactgcgccggcctcaagaaggtgaccgaggtcaaggggtacaccaagggcggccccgggcacgaggagcccatcccgatggcgacgtacggctggaacctggtgaagctgcactccgggaaggacgtgttcttcatcccgcccgagaagtgcgacaccctcctgtgcgacatcggcgagagctcccccaacccgaccatcgaggaggggcgcaccctgcgggtcctcaagatggtggagccctggctgcgcggcaaccagttctgcatcaagatcctgaacccctacatgcccagcgtggtcgaggccctcgagcagatgcagcggaagcacggcgggatgctggtgcgcaacccgctgtcccggaacagcacgcacgagatgtactgggtgtcctgcggcaccgggaacatcgtcagcgccgtgaacatgacctcccgcatgctcctgaaccgcttcaccatggcccaccggaagcccacctacgagcgcgacgtggacctgggcacgggcacccggcacgtcgccgtggagcccgaggtggcgaacctcgacatcatcgggcagcgcatcgagaacatcaagcacgagcacaagagcacctggcactacgacgaggacaacccctacaagacctgggcctaccacggctcctacgaggtcaagccgagcgggtccgccagcagcatggtgaacggcgtcgtgaagctgctgacgaagccctgggacgtgatccccatggtcacccagatcgccatgaccgacaccacgcccttcgggcagcagcgggtgttcaaggagaaggtggacacccgcaccccgaaggccaagcggggcaccgcgcagatcatggaggtcacggcccgctggctctggggcttcctgtcccggaacaagaagccccgcatctgcacccgggaggagttcacccgcaaggtgcggagcaacgccgccatcggggcggtgttcgtcgacgagaaccagtggaactccgccaaggaggccgtggaggacgagcgcttctgggacctggtgcaccgggagcgcgagctccacaagcagggcaagtgcgcgacctgcgtctacaacatgatggggaagcgggagaagaagctgggcgagttcgggaaggccaagggcagccgcgcgatctggtacatgtggctgggcgcccggttcctcgagttcgaggccctggggttcatgaacgaggaccactggttctcccgcgagaacagcctgtccggcgtggagggggagggcctccacaagctggggtacatcctgcgggacatcagcaagatccccggcggcaacatgtacgccgacgacacggccgggtgggacacccgcatcaccgaggacgacctccagaacgaggcgaagatcaccgacatcatggagccggagcacgccctgctggccaaggccatcttcaagctcacgtaccagaacaaggtggtccgcgtgcagcggcccgccaagaacggcaccgtgatggacgtcatctcccgccgggaccagcgcgggagcggccaggtgggcacctacgggctgaacaccttcacgaacatggaggcgcagctgatccggcagatggagtccgagggcatcttcagcccctccgagctcgagacccccaacctggccgagcgcgccctggactggctcgagaagtacggggtggagcggctgaagcgcatggccatcagcggcgacgactgcgtcgtgaagccgatcgacgaccggttcgccaccgcgctgaccgccctcaacgacatggggaaggtgcgcaaggacatcccccagtgggagccctccaagggctggaacgactggcagcaggtccccttctgcagccaccacttccaccagctgatcatgaaggacggccgggagatcgtggtgccgtgccgcaaccaggacgagctggtcgggcgggcccgcgtgtcccagggcgccgggtggagcctccgggagacggcgtgcctgggcaagagctacgcccagatgtggcagctgatgtacttccaccgccgggacctccgcctggccgccaacgccatctgctccgcggtgcccgtcgactgggtgcccaccagccggaccacctggtccatccacgcccaccaccagtggatgacgaccgaggacatgctgagcgtgtggaaccgcgtctggatcgaggagaacccctggatggaggacaagacccacatctccagctgggaggacgtgccgtacctcgggaagcgcgaggaccagtggtgcggctccctgatcggcctgaccgcccgggccacgtgggccaccaacatccaggtggcgatcaaccaggtccgccggctcatcgggaacgagaactacctggactacatgatcagcatgaagcgcttcaagaacgagtccgaccccgagggcgccctgtggtga

SEQ ID NO: 8320 - RNA, 9879 nt, synthetic construct
  misc_feature 1..9879: note = derived and/or modified CDS sequence (opt1) from DENV-1__FJ024435__SS-prME
  source 1..9879: mol_type = other RNA
agcgtgaccatgctgctgatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccaccgacacctgggtgacctacgggacctgcagccagaccggcgagcaccggcgggacaagcggtccgtggccctcgcgccccacgtgggcctggggctggagacccgcaccgagacctggatgagctccgagggcgcctggaagcagatccagcgggtcgagacgtgggccctccggcaccccgggttcaccgtgaccgccctgttcctggcccacgcgatcggcaccagcatcacgcagaaggggatcatcttcatcctcctgatgctggtgaccccctccatggccatgcggtgcgtcggcatcggcagccgcgacttcgtggaggggctctccggcgccacctgggtggacgtcgtgctggagcacgggagctgcgtgaccacgatggccaaggacaagcccaccctggacatcgagctcctgaagaccgaggtcaccaaccccgccgtgctgcggaagctctgcatcgaggcgaagatctccaacacgaccaccgacagccgctgcccgacccagggcgaggccacgctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgacggtccacaccggcgaccagcaccaggtggggaacgagtccaccgagcacggcaccaccgccacgatcacgccccaggcgcccaccaccgagatccagctcacggactacggggccctgaccctggactgcagcccccgcaccggcctcgacttcaacgagatggtcctgctgaccatgaaggagaagtcctggctcgtgcacaagcagtggttcctggacctgcccctcccctggacgagcggggccagcacctcccaggagacctggaaccggcaggacctgctggtgaccttcaagacggcccacgccaagaagcaggaggtcgtggtgctcggcagccaggagggcgcgatgcacaccgccctgaccggggccaccgagatccagacgtccggcaccaccaccatcttcgccgggcacctgaagtgccgcctcaagatggacaagctgacgctgaagggcatgagctacgtcatgtgcaccgggtccttcaagctcgagaaggagctggccgagacccagcacggcaccgtgctggtgcagatcaagtacgagggcacggacgcgccctgcaagatccccttcagcacccaggacgagaagggggtcacccagaacggccggctgatcaccgccaacccgatcgtgacggacaaggagaagcccgtgaacatcgaggccgagccgcccttcggggagtcctacatcgtcatcggcgccggcgagaaggcgctcaagctgagctggttcaagaaggggtccagcatcggcaagatgttcgaggccaccgcccgcggggcccggcgcatggccatcctgggcgacaccgcgtgggacttcgggtccatcggcggcgtgttcaccagcgtggggaagctcgtccaccagatcttcggcacggcctacggggtgctgttctccggcgtgagctggaccatgaagatcgggatcggcgtcctgctcacctggctgggcctgaactcccgcagcacctccctcagcatgacgtgcatcgccgtggggctggtgaccctgtacctcggcgtcatggtgcaggccgactccgggtgcgtgatcaactggaagggccgggagctgaagtgcgggagcggcatcttcgtcaccaacgaggtgcacacctggaccgagcagtacaagttccaggccgacagcccgaagcgcctgtccgcggccatcggcaaggcctgggaggagggggtgtgcggcatccggagcgccacgcgcctcgagaacatcatgtggaagcagatctccaacgagctgaaccacatcctgctcgagaacgacatgaagttcaccgtcgtggtgggggacgtcgccggcatcctggcgcaggggaagaagatgatccggccccagcccatggagcacaagtacagctggaagtcctggggcaaggccaagatcatcggcgccgacgtgcagaacaccaccttcatcatcgacgggcccaacacgccggagtgccccgacgaccagcgcgcctggaacatctgggaggtggaggactacggcttcgggatcttcaccaccaacatctggctgaagctccgggacagctacacccaggtctgcgaccaccgcctgatgtccgcggccatcaaggacagcaaggccgtgcacgccgacatgggctactggatcgagtccgagaagaacgagacgtggaagctggcccgggcgagcttcatcgaggtgaagacctgcatctggcccaagtcccacaccctctggagcaacggcgtcctggagtccgagatgatcatccccaagatctacgggggcccgatcagccagcacaactaccgccccgggtacttcacccagacggccggcccctggcacctggggaagctcgagctggacttcgacctgtgcgagggcaccaccgtggtggtcgacgagcactgcggcaaccgggggccgtccctccgcaccacgaccgtgaccggcaagatcatctacgagtggtgctgccggagctgcaccctgccgcccctgcgcttccgcggggaggacggctgctggtacgggatggagatccgccccgtgaaggagaaggaggagaacctcgtcaagtccatggtgagcgccggcagcggcgaggtggactccttcagcctggggctgctctgcatctccatcatgatcgaggaggtcatgcggagccgctggtcccggaagatgctgatgacgggcaccctggccgtgttcttcctcctgatcgtggggcagctgacctggaacgacctcatccgcctgtgcatcatggtcggcgccaacgcgagcgaccgcatggggatgggcaccacgtacctggccctcatggccaccttcaagatgcggccgatgttcgccgtgggcctgctgttccgccggctcacctcccgcgaggtgctgctgctcaccatcgggctgagcctggtcgcctccgtggagctccccaacagcctggaggagctgggcgacgggctcgcgatgggcatcatgatcctgaagctgctcacggacttccagtcccaccagctgtgggccaccctgctcagcctgaccttcatcaagaccacgttctccctgcactacgcctggaagaccatggccatggtcctcagcgtggtgtccctgttccccctgtgcctcagcaccacctcccagaagacgacctggctgcccgtcctgctcggcagcctggggtgcaagccgctgaccatgttcctcatcgcggagaacaagatctggggccggcgctcctggcccctgaacgaggggatcatggccgtgggcatcgtgagcatcctgctcagctccctgctgaagaacgacgtccccctcgccgggcccctgatcgccggcggcatgctgatcgcctgctacgtgatcagcgggtccagcgcggacctctccctggagaaggccgccgaggtgagctgggaggaggaggccgagcactccggcgccagccacaacatcctggtcgaggtgcaggacgacgggaccatgaagatcaaggacgaggagcgggacgacaccctcacgatcctgctgaaggcgaccctcctggccgtgtccggcgtctacccgctgagcatccccgccaccctcttcgtgtggtacttctggcagaagaagaagcagcgctccggggtgctgtgggacacccccagcccgcccgaggtcgagcgggccgtgctggacgacggcatctaccgcatcatgcagcggggcctgctcgggcgctcccaggtgggcgtcggggtgttccaggagaacgtgttccacacgatgtggcacgtcacccggggcgccgtgctgatgtaccaggggaagcgcctggagcccagctgggcgtccgtgaagaaggacctcatcagctacggcggcgggtggcggctgcagggctcctggaacaccggggaggaggtccaggtgatcgccgtggagcccggcaagaaccccaagaacgtccagaccgcccccgggacgttcaagacccccgagggcgaggtgggcgccatcgccctggacttcaagcccgggaccagcggctcccccatcgtgaaccgcgaggggaagatcgtcggcctctacggcaacggggtggtgaccacgagcggcacctacgtcagcgcgatcgcccaggccaaggcctcccaggaggggccgctgcccgagatcgaggacgaggtgttccggaagcgcaacctgaccatcatggacctccaccccggcagcgggaagacccggcgctacctgccggcgatcgtgcgggaggccatcaagcgcaagctgcgcacgctcatcctggcccccacccgggtcgtggcctccgagatggccgaggcgctgaagggcatgcccatccgctaccagaccaccgccgtcaagagcgagcacacgggcaaggagatcgtcgacctcatgtgccacgccaccttcaccatgcggctgctgtcccccgtgcgcgtgccgaactacaacatgatcatcatggacgaggcccacttcaccgaccccagctccatcgccgcgcgggggtacatcagcacgcgcgtcggcatgggggaggccgccgccatcttcatgaccgccacgccgcccggctccgtggaggcgttcccgcagagcaacgccgtgatccaggacgaggagcgggacatccccgagcgctcctggaacagcgggtacgagtggatcaccgacttccccggcaagacggtctggttcgtgccctccatcaagagcggcaacgacatcgccaactgcctccggaagaacgggaagcgcgtgatccagctgtcccggaagaccttcgacaccgagtaccagaagaccaagaacaacgactgggactacgtcgtgacgaccgacatcagcgagatgggcgccaacttccgcgcggaccgggtgatcgacccgcgccggtgcctgaagcccgtcatcctcaaggacgggcccgagcgcgtgatcctggccggccccatgccggtcaccgtggcctccgccgcccagcggcgcgggcggatcggccgcaaccacaacaaggagggcgaccagtacatctacatggggcagcccctgaacaacgacgaggaccacgcgcactggaccgaggccaagatgctcctggacaacatcaacacgcccgagggcatcatccccgccctgttcgagccggagcgcgagaagtccgccgccatcgacggggagtaccggctccgcggcgaggcgcggaagaccttcgtggagctgatgcgccgcggggacctgcccgtctggctctcctacaaggtggccagcgagggcttccagtacagcgaccgccggtggtgcttcgacggcgagcgcaacaaccaggtgctggaggagaacatggacgtcgagatctggaccaaggagggggagcggaagaagctgcgcccccggtggctcgacgcccgcacctactccgaccccctggccctgcgggagttcaaggagttcgccgcgggccgccggagcgtgtccggggacctcatcctggagatcggcaagctgccgcagcacctcacgcagcgcgcccagaacgccctggacaacctggtgatgctccacaacagcgagcagggcgggcgggcctaccgccacgcgatggaggagctgcccgacaccatcgagaccctgatgctcctggccctgatcgccgtcctcaccggcggggtgaccctgttcttcctgtccggccgggggctcggcaagacgagcatcggcctgctgtgcgtgatggcctccagcgtcctcctgtggatggcctccgtggagccccactggatcgcggccagcatcatcctggagttcttcctcatggtgctgctgatccccgagccggaccgccagcggacgccccaggacaaccagctcgcctacgtcgtgatcgggctgctgttcatgatcctcaccgtggccgccaacgagatgggcctgctggagaccacgaagaaggacctcgggatcggccacgtcgcggtggagaaccaccaccacgccgccatgctggacgtggacctgcaccccgcctccgcctggaccctctacgcggtcgccaccaccatcatcacgccgatgatgcgccacaccatcgagaacaccaccgccaacatcagcctgacggccatcgccaaccaggcggccatcctgatggggctcgacaagggctggcccatctccaagatggacatcggcgtgcccctgctggccctcgggtgctacagccaggtgaaccccctgaccctgaccgccgcggtcctcatgctggtggcccactacgccatcatcggcccggggctgcaggccaaggccacccgcgaggcgcagaagcggacggccgccggcatcatgaagaaccccaccgtggacgggatcgtcgccatcgacctcgaccccgtggtgtacgacgccaagttcgagaagcagctgggccagatcatgctgctcatcctgtgcacctcccagatcctgctcatgcgcaccacgtgggcgctgtgcgagagcatcaccctggccaccggccccctcaccacgctgtgggaggggtccccgggcaagttctggaacaccaccatcgccgtcagcatggccaacatcttccgggggtcctacctggccggcgcgggcctcgccttcagcctgatgaagtccctcgggggcgggcgccgggggaccggggcccagggcgagacgctcggcgagaagtggaagcgccagctgaaccagctgtccaagagcgagttcaacacctacaagcggtccgggatcatggaggtggaccgcagcgaggccaaggagggcctcaagcgcggggagaccaccaagcacgcggtgtcccgcggcacggccaagctgcggtggttcgtcgagcgcaacctggtgaagcccgaggggaaggtgatcgacctgggctgcggccgcgggggctggagctactactgcgccgggctcaagaaggtcaccgaggtgaagggctacaccaagggcggccccggccacgaggagcccatcccgatggccacctacgggtggaacctggtgaagctgcactccggcaaggacgtcttcttcatcccgcccgagaagtgcgacacgctcctgtgcgacatcggggagagctcccccaacccgaccatcgaggagggccgcaccctgcgggtgctcaagatggtggagccctggctgcgcgggaaccagttctgcatcaagatcctgaacccctacatgcccagcgtcgtggagaccctcgagcagatgcagcggaagcacggcggcatgctggtgcgcaacccgctgtcccggaacagcacccacgagatgtactgggtctcctgcgggacgggcaacatcgtgagcgccgtgaacatgacctcccgcatgctcctgaaccgcttcaccatggcgcaccggaagcccacctacgagcgcgacgtcgacctgggggccggcacgcggcacgtggccgtggagcccgaggtcgccaacctcgacatcatcggccagcgcatcgagaacatcaagcacgagcacaagagcacctggcactacgacgaggacaacccctacaagacctgggcctaccacgggtcctacgaggtgaagccgagcggctccgcgagcagcatggtcaacggggtggtgaagctgctgaccaagccctgggacgtcatccccatggtgacgcagatcgccatgaccgacaccacccccttcggccagcagcgggtgttcaaggagaaggtcgacacgcgcaccccgaaggccaagcgggggaccgcccagatcatggaggtgaccgccaagtggctctggggcttcctgtcccgcaacaagaagccccggatctgcacgcgcgaggagttcacccggaaggtgcgcagcaacgcggccatcggcgccgtcttcgtggacgagaaccagtggaactccgccaaggaggcggtggaggacgagcggttctgggacctggtccaccgcgagcgggagctccacaagcaggggaagtgcgcgacctgcgtgtacaacatgatgggcaagcgcgagaagaagctgggggagttcggcaaggccaaggggagccgggccatctggtacatgtggctgggcgcccgcttcctcgagttcgaggcgctgggcttcatgaacgaggaccactggttctcccgggagaacagcctgtccggggtggagggcgaggggctccacaagctgggctacatcctgcgcgacatcagcaagatccccgggggcaacatgtacgccgacgacaccgccggctgggacacgcggatcaccgaggacgacctccagaacgaggcccgcatcaccgacatcatggagccggagcacgccctgctggcgaagtccatcttcaagctcacctaccagaacaaggtcgtgcgcgtgcagcggcccgccaagaacgggacggtcatggacgtgatcagccgccgggaccagcgcggctccggccaggtggggacctacggcctgaacaccttcaccaacatggaggcccagctgatccggcagatggagagcgaggggatcttctcccccagcgagctcgagacgcccaacctggccgagcgcgtcctggactggctcgagaagtacggcgtggagcggctgaagcgcatggccatctccggggacgactgcgtggtcaagccgatcgacgaccggttcgcgaccgccctgaccgccctcaacgacatgggcaaggtgcgcaaggacatcccccagtgggagcccagcaaggggtggaacgactggcagcaggtccccttctgctcccaccacttccaccagctgatcatgaaggacggccgggagatcgtcgtgccgtgccgcaaccaggacgagctggtgggccgggcccgcgtcagccagggggccggctggagcctccgggagaccgcgtgcctggggaagtcctacgcccagatgtggcagctgatgtacttccaccgccgggacctccgcctggccgccaacgcgatctgcagcgccgtgcccgtggactggatccccacgtcccggaccacctggagcatccacgcccaccaccagtggatgaccacggaggacatgctgtccgtctggaaccgcgtgtggatcgaggagaacccctggatggaggacaagacccacatcagctcctggggcgacgtgccgtacctcgggaagcgcgaggaccagtggtgcggcagcctgatcggcctgaccgcccgggccacctgggcgaccaacatccaggtcgccatcaaccaggtgcgccggctcatcgggaacgagaactacctggactacatgacgtccatgaagcgcttcaagaacgagagcgaccccgagggcgccctgtggtga

SEQ ID NO: 8321 - RNA, 9879 nt, synthetic construct
  misc_feature 1..9879: note = derived and/or modified CDS sequence (opt1) from DENV-1__FJ024436__SS-prME
  source 1..9879: mol_type = other RNA
agcgtgaccatgctgctcatgctgatgcccaccgccctggccttccacctcacgacccgcggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtggagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagtacggcaccaccgcgaccatcacgccccaggcccccagcacggagatccagctcaccgactacggggccctgaccctggactgcagcccccggaccggcctcgacttcaacgagatggtcctgctgacgatgaaggagaagtcctggctcgtgcacaagcagtggttcctggacctgccgctcccctggaccagcggggcctccaccagccaggagacctggaaccggcaggacctgctggtgacgttcaagaccgcccacgcgaagaagcaggaggtcgtggtgctcggctcccaggagggcgccatgcacaccgccctgaccggggccacggagatccagaccagcggcaccaccacgatcttcgccgggcacctgaagtgccgcctcaagatggacaagctgaccctgaagggcatgtcctacgtcatgtgcaccgggagcttcaagctcgagaaggaggtggcggagacccagcacggcacggtgctggtccagatcaagtacgagggcaccgacgccccctgcaagatccccttctccacccaggacgagaagggggtgacccagaacggccggctgatcacggccaacccgatcgtgaccgacaaggagaagcccgtcaacatcgaggccgagccgcccttcggggagagctacatcgtgatcggcgcgggcgagaaggccctgaagctctcctggttcaagaaggggagctccatcggcaagatgttcgaggccaccgcccgcggggcccggcgcatggcgatcctgggcgacaccgcctgggacttcgggagcatcggcggcgtgttcacgtccgtcgggaagctggtgcaccagatcttcggcaccgcctacggggtgctgttcagcggcgtctcctggaccatgaagatcgggatcggcgtgctgctgacctggctcggcctgaacagccgctccacgagcctgtccatgacctgcatcgccgtggggctcgtcaccctgtacctgggcgtgatggtgcaggccgacagcgggtgcgtcatcaactggaagggccgggagctcaagtgcgggagcggcatcttcgtgaccaacgaggtgcacacgtggaccgagcagtacaagttccaggcggactccccgaagcgcctgagcgccgccatcggcaaggcctgggacgagggggtctgcggcatccggtccgccacccgcctggagaacatcatgtggaagcagatcagcaacgagctcaaccacatcctgctggagaacgacatgaagttcaccgtggtggtcggggacgtggcgggcatcctcgcccaggggaagaagatgatccggccccagcccatggagtacaagtactcctggaagtcctggggcaaggccaagatcatcggcgccgacgtgcagaacaccacgttcatcatcgacgggcccaacaccccggagtgccccgacgaccagcgcgcgtggaacatctgggaggtcgaggactacggcttcgggatcttcaccaccaacatctggctgaagctgcgggactcctacacccaggtgtgcgaccaccgcctcatgagcgccgccatcaaggactccaaggccgtgcacgccgacatgggctactggatcgagagcgagaagaacgagacctggaagctggcgcgggcctccttcatcgaggtcaagacctgcatctggcccaagagccacaccctgtggtccaacggcgtgctcgagagcgagatgatcatccccaagatctacgggggcccgatctcccagcacaactaccgccccgggtacttcacgcagaccgccggcccctggcacctggggaagctggagctcgacttcaacctgtgcgagggcaccaccgtggtcgtggacgagcactgcggcaaccgggggccgagcctgcgcacgaccaccgtgaccggcaagatcatccacgagtggtgctgccggtcctgcacgctgccgcccctccgcttcaagggggaggacggctgctggtacgggatggagatccggcccgtcaaggagaaggaggagaacctggtcaagagcatggtgagcgccggctccggcgaggtcgacagcttctccctcgggctgctgtgcatcagcatcatgatcgaggaggtgatgcgctcccggtggagccgcaagatgctcatgaccggcaccctggccgtgttcttcctgctcatcatggggcagctgacctggaacgacctgatccggctctgcatcatggtcggcgcgaacgcctccgaccgcatggggatgggcacgacctacctggccctgatggccaccttcaagatgcgcccgatgctcgccgtggggctgctgttccggcgcctcaccagccgggaggtgctgctgctcacgatcgggctgtccctggtcgcgagcgtggagctccccaactccctggaggagctgggcgacgggctcgccatgggcatcatgatcctgaagctgctcaccgacttccagagccaccagctgtgggccaccctgctctccctgaccttcatcaagacgacctacagcctgcactacgcctggaagaccatggcgatggtcctctccatcgtgagcctgttccccctgtgcctctccaccacgagccagaagaccacctggctgcccgtgctgctcggctccctggggtgcaagccgctgaccatgttcctcatcgccgagaacaagatctggggccgcaagagctggcccctgaacgaggggatcatggccgtcggcatcgtgagcatcctgctctccagcctgctgaagaacgacgtgcccctcgccgggcccctgatcgccggcggcatgctgatcgcgtgctacgtcatctccgggagctccgccgacctcagcctggagaaggccgccgaggtgtcctgggaggaggaggccgagcacagcggcgcgtcccacaacatcctggtggaggtccaggacgacgggacgatgaagatcaaggacgaggagcgggacgacaccctcaccatcctgctgaaggccaccctcctggccgtgagcggcgtgtacccgctgtccatccccgccaccctcttcgtctggtacttctggcagaagaagaagcagcgcagcggggtgctgtgggacacgcccagcccgcccgaggtggagcgggccgtcctggacgacggcatctaccgcatcatgcagcggggcctgctcgggcgcagccaggtgggcgtgggggtcttccaggagaacgtgttccacaccatgtggcacgtgacccggggcgcggtcctgatgtaccaggggaagcgcctggagccctcctgggccagcgtgaagaaggacctcatctcctacggcggcgggtggcggctgcagggcagctggaacaccggggaggaggtgcaggtcatcgccgtggagcccggcaagaaccccaagaacgtgcagacggcccccgggaccttcaagacctccgagggcgaggtcggcgccatcgcgctggacttcaagcccgggaccagcggcagccccatcgtgaaccgcgaggggaagatcgtgggcctctacggcaacggggtcgtgacgacctccggcacctacgtgagcgccatcgcccaggccaaggcgtcccaggaggggcccctgccggagatcgagaacgaggtcttccggaagcgcaacctgaccatcatggacctccaccccggcagcgggaagacgcggcgctacctgcccgccatcgtgcgggaggccatcaagcgcaagctgcggaccctcatcctggccccgacccgcgtggtcgcctccgagatggcggaggccctgaagggcatgcccatccgctaccagaccacggccgtcaagagcgagcacaccggcaaggagatcgtggacctcatgtgccacgccaccttcaccatgcggctgctgtcccccgtccgcgtgcccaactacaacatgatcatcatggacgaggcccacttcacggacccgagctccatcgcggcccgggggtacatcagcacccgcgtgggcatgggggaggccgccgccatcttcatgaccgcgacgccgcccggctccgtcgaggccttcccccagagcaacgccgtgatccaggacgaggagcgggacatcccggagcgctcctggaacagcgggtacgagtggatcacggacttccccggcaagaccgtgtggttcgtcccctccatcaagagcggcaacgacatcgccaactgcctccggaagaacgggaagcgcgtgatccagctgtcccggaagaccttcgacaccgagtaccagaagacgaagaacaacgactgggactacgtggtcaccaccgacatcagcgagatgggcgcgaacttccgcgccgaccgggtgatcgacccccgccggtgcctgaagccggtgatcctcaaggacgggcccgagcgcgtcatcctggccggccccatgcccgtgaccgtcgcctccgccgcgcagcggcgcgggcggatcggccgcaaccacaacaaggagggcgaccagtacatctacatggggcagccgctgaacaacgacgaggaccacgcccactggacggaggccaagatgctcctggacaacatcaacacccccgagggcatcatccccgccctgttcgagcccgagcgggagaagtccgccgcgatcgacggggagtaccgcctccgcggcgaggcccggaagaccttcgtggagctgatgcgccgcggggacctgccggtgtggctcagctacaaggtcgcctccgagggcttccagtacagcgaccgccggtggtgcttcgacggcgagcgcaacaaccaggtgctggaggagaacatggacgtggagatctggaccaaggagggggagcggaagaagctgcgcccccggtggctcgacgcccgcacgtactccgaccccctggccctgcgggagttcaaggagttcgcggccggccgcaagagcgtctccggggacctcatcctggagatcggcaagctgccccagcacctcacccagcgggcccagaacgccctggacaacctggtgatgctccacaacagcgagcagggcgggcgcgcgtaccggcacgccatggaggagctgccggacaccatcgagaccctgatgctcctggccctgatcgccgtgctcacgggcggggtcaccctgttcttcctgtccggccgcgggctcggcaagaccagcatcggcctgctgtgcgtgatggcctccagcgtgctcctgtggatggcgtccgtcgagccccactggatcgccgccagcatcatcctggagttcttcctcatggtgctgctgatccccgagcccgaccggcagcgcaccccgcaggacaaccagctcgcctacgtggtcatcgggctgctgttcatgatcctcaccgtggccgcgaacgagatgggcctgctggagacgaccaagaaggacctcgggatcggccacgtggccgtcgagaaccaccaccacgccgccatgctggacgtggacctgcaccccgcctccgcgtggaccctctacgccgtggccaccacgatcatcacccccatgatgcggcacaccatcgagaacaccacggccaacatcagcctgaccgccatcgcgaaccaggccgccatcctgatggggctcgacaagggctggccgatctccaagatggacatcggcgtccccctgctggccctcgggtgctacagccaggtgaaccccctgaccctgaccgcggccgtgctcatgctggtcgcccactacgccatcatcggccccgggctgcaggccaaggcgacgcgcgaggcccagaagcggaccgccgccggcatcatgaagaacccgaccgtggacgggatcgtggccatcgacctcgaccccgtcgtgtacgacgcgaagttcgagaagcagctgggccagatcatgctgctcatcctgtgcacctcccagatcctgctcatgcgcacgacctgggccctgtgcgagagcatcaccctggccaccggccccctcacgaccctgtgggaggggtcccccggcaagttctggaacaccaccatcgccgtgagcatggccaacatcttccgcgggagctacctggcgggcgccggcctcgccttctccctgatgaagtccctcgggggcgggcggcgcgggacgggggcccagggcgagaccctcggcgagaagtggaagcggcagctgaaccagctgtccaagagcgagttcaacacctacaagcgctccgggatcatggaggtcgaccggagcgaggcgaaggagggcctcaagcgcggggagaccacgaagcacgccgtgtcccggggcaccgccaagctgcgctggttcgtggagcggaacctggtcaagccggaggggaaggtgatcgacctgggctgcggccgcgggggctggagctactactgcgccgggctcaagaaggtgaccgaggtcaagggctacaccaagggcgggcccggccacgaggagcccatccccatggccacgtacgggtggaacctggtgaagctgcactccggcaaggacgtgttcttcatcccgcccgagaagtgcgacaccctcctgtgcgacatcggggagagctcccccaaccccaccatcgaggagggccggaccctgcgcgtcctcaagatggtggagccgtggctgcgggggaaccagttctgcatcaagatcctgaacccctacatgcccagcgtggtcgagacgctcgagcagatgcagcgcaagcacggcggcatgctggtgcggaaccccctgtcccgcaacagcacccacgagatgtactgggtgtcctgcgggaccggcaacatcgtcagcgcggtgaacatgacctcccggatgctcctgaaccgcttcaccatggcccaccggaagccgacgtacgagcgcgacgtggacctgggggccggcacccgccacgtcgccgtggagcccgaggtggccaacctcgacatcatcggccagcggatcgagaacatcaagcacgagcacaagagcacctggcactacgacgaggacaacccctacaagacctgggcgtaccacgggtcctacgaggtcaagcccagcggcagcgcctccagcatggtgaacggggtcgtgaagctgctgacgaagccgtgggacgtgatccccatggtcacccagatcgccatgaccgacaccacgcccttcggccagcagcgcgtgttcaaggagaaggtggacacccggacccccaaggccaagcgcgggaccgcccagatcatggaggtcacggcgaagtggctctggggcttcctgtcccggaacaagaagccgcgcatctgcacccgggaggagttcacccgcaaggtgcggagcaacgccgccatcggcgccgtgttcgtcgacgagaaccagtggaactccgcgaaggaggccgtggaggacgagcgcttctgggacctggtgcaccgggagcgcgagctccacaagcaggggaagtgcgcgacctgcgtctacaacatgatgggcaagcgggagaagaagctgggggagttcggcaaggccaaggggagccgcgccatctggtacatgtggctgggcgcgcggttcctcgagttcgaggccctgggcttcatgaacgaggaccactggttctcccgcgagaacagcctgtccggggtggagggcgaggggctccacaagctgggctacatcctgcgggacatcagcaagatccccgggggcaacatgtacgccgacgacacggccggctgggacacccgcatcaccgaggacgacctccagaacgaggccaagatcaccgacatcatggagcccgagcacgcgctgctggccaagtccatcttcaagctcacgtaccagaacaaggtggtccgggtgcagcgcccggccaagaacgggaccgtgatggacgtcatcagccggcgcgaccagcgcggctccggccaggtgggcacctacggcctgaacaccttcacgaacatggaggcccagctgatccggcagatggagagcgaggggatcttctcccccagcgagctcgagacccccaacctggccggccgcgtgctggactggctcgagaagcacggggtcgagcggctgaagcgcatggcgatctccggcgacgactgcgtggtgaagcccatcgacgaccggttcgccaccgccctgaccgccctcaacgacatggggaaggtccgcaaggacatcccgcagtgggagcccagcaagggctggaacgactggcagcaggtccccttctgcagccaccacttccaccagctgatcatgaaggacggccgggagatcgtggtcccctgccgcaaccaggacgagctggtggggcgggcccgcgtgtcccagggcgcggggtggagcctccgggagacggcctgcctgggcaagtcctacgcccagatgtggcagctgatgtacttccaccgccgggacctccgcctggccgcgaacgccatctgcagcgccgtcccggtggactgggtgcccacctcccggaccacctggagcatccacgcccaccaccagtggatgacgaccgaggacatgctgtccgtctggaaccgcgtgtggatcgaggagaacccctggatggaggacaagacccacatcagctcctggggcgacgtgccctacctcggcaagcgggaggaccagtggtgcggcagcctgatcgggctgaccgcccgcgcgacgtgggccaccaacatccaggtcgccatcaaccaggtgcggcgcctcatcggcaacgagaactacctggactacatgacctccatgaagcgcttcaagaacgagagcgacccggagggggccctgtggtga

SEQ ID NO: 8322 - RNA, 9879 nt, synthetic construct
  misc_feature 1..9879: note = derived and/or modified CDS sequence (opt1) from DENV-1__FJ024472__SS-prME
  source 1..9879: mol_type = other RNA
agcgtgaccatgctgctgatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgggacaagcggtccgtggccctcgcgccccacgtgggcctggggctggagacccgcaccgagacctggatgagctccgagggcgcctggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggagctggccgagacccagcacggcaccgtgctggtgcagatcaagtacgagggcaccgacgcgccctgcaagatccccttcagcacgcaggacgagaagggggtcacccagaacggccggctgatcaccgccaacccgatcgtgaccgacaaggagaagcccgtgaacatcgaggccgagccgcccttcggggagtcctacatcgtcatcggcgccggcgagaaggcgctcaagctgagctggttcaagaaggggtccagcatcggcaagatgttcgaggccacggcccgcggggcccggcgcatggccatcctgggcgacaccgcgtgggacttcgggtccatcggcggcgtgttcaccagcgtggggaagctcgtccaccagatcttcggcaccgcctacggggtgctgttctccggcgtgagctggacgatgaagatcgggatcggcgtcctgctcacctggctgggcctgaactcccgcagcacctccctcagcatgacctgcatcgccgtggggctggtgacgctgtacctcggcgtcatggtgcaggccgactccgggtgcgtgatcaactggaagggccgggagctgaagtgcgggagcggcatcttcgtcaccaacgaggtgcacacctggaccgagcagtacaagttccaggccgacagcccgaagcgcctgtccgcggccgtgggcaaggcctgggaggagggggtctgcggcatccggagcgccacccgcctcgagaacatcatgtggaagcagatctccaacgagctgaaccacatcctgctcgagaacgacatgaagttcacggtggtggtcggggacgtggccggcatcctggcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtcgaggactacggcttcgggatcttcacgaccaacatctggctgaagctccgggacagctacacccaggtgtgcgaccaccgcctgatgtccgcggccatcaaggacagcaaggccgtgcacgccgacatgggctactggatcgagtccgagaagaacgagacctggaagctggcccgggcgagcttcatcgaggtcaagacgtgcatctggcccaagtcccacaccctctggagcaacggcgtgctggagtccgagatgatcatccccaagatctacgggggcccgatcagccagcacaactaccgccccgggtacttcacccagaccgccggcccctggcacctggggaagctcgagctggacttcgacctgtgcgagggcacgaccgtggtcgtggacgagcactgcggcaaccgggggccgtccctccgcaccaccacggtgaccggcaagatcatccacgagtggtgctgccggagctgcaccctgccgcccctgcgcttccgcggggaggacggctgctggtacgggatggagatccgccccgtcaaggagaaggaggagaacctcgtgaagtccatggtgagcgccggcagcggcgaggtcgactccttcagcctggggctgctctgcatctccatcatgatcgaggaggtgatgcggagccgctggtcccggaagatgctgatgaccggcacgctggccgtgatcttcctcctgatcatggggcagctgacctggaacgacctcatccgcctgtgcatcatggtcggcgccaacgcgagcgaccgcatggggatgggcaccacctacctggccctcatggccacgttcaagatgcggccgatgttcgccgtgggcctgctgttccgccggctcacctcccgcgaggtgctgctgctcaccatcgggctgagcctggtcgcctccgtggagctccccaacagcctggaggagctgggcgacgggctcgcgatgggcatcatgatcctgaagctgctcaccgacttccagtcccaccagctgtgggccacgctgctcagcctgaccttcatcaagaccaccttctccctgcactacgcctggaagacgatggccatggtcctcagcatcgtgtccctgttccccctgtgcctcagcaccacctcccagaagaccacgtggctgcccgtgctgctcggcagcctggggtgcaagccgctgaccatgttcctcatcgcggagaacaagatctggggccggcgctcctggcccctgaacgaggggatcatggccgtcggcatcgtgagcatcctgctcagctccctgctgaagaacgacgtgcccctcgccgggcccctgatcgccggcggcatgctgatcgcctgctacgtcatcagcgggtccagcgcggacctctccctggagaaggccgccgaggtgagctgggaggaggaggccgagcactccggcgccagccacaacatcctggtggaggtccaggacgacgggaccatgaagatcaaggacgaggagcgggacgacaccctcaccatcctgctgaaggcgacgctcctggccgtgtccggcgtgtacccgctgagcatccccgccaccctcttcgtctggtacttctggcagaagaagaagcagcgctccggggtgctgtgggacacccccagcccgcccgaggtggagcgggccgtcctggacgacggcatctaccgcatcatgcagcggggcctgctcgggcgctcccaggtgggcgtgggggtcttccaggagaacgtgttccacaccatgtggcacgtgacgcggggcgccgtcctgatgtaccaggggaagcgcctggagcccagctgggcgtccgtgaagaaggacctcatcagctacggcggcgggtggcggctgcagggctcctggaacaccggggaggaggtgcaggtcatcgccgtggagcccggcaagaaccccaagaacgtgcagaccgcccccgggaccttcaagacgcccgagggcgaggtcggcgccatcgccctggacttcaagcccgggaccagcggctcccccatcgtgaaccgcgaggggaagatcgtgggcctctacggcaacggggtcgtgaccaccagcggcacgtacgtgagcgcgatcgcccaggccaaggcctcccaggaggggccgctgcccgagatcgaggacgaggtcttccggaagcgcaacctgaccatcatggacctccaccccggcagcgggaagacccggcgctacctgccggcgatcgtgcgggaggccatcaagcgcaagctgcgcaccctcatcctggcccccacgcgggtggtcgcctccgagatggccgaggcgctgaagggcatgcccatccgctaccagaccaccgccgtcaagagcgagcacaccggcaaggagatcgtggacctcatgtgccacgccacgttcaccatgcggctgctgtcccccgtccgcgtgccgaactacaacatgatcatcatggacgaggcccacttcaccgaccccagctccatcgccgcgcgggggtacatcagcacccgcgtgggcatgggggaggccgccgccatcttcatgacggccacgccgcccggctccgtcgaggcgttcccgcagagcaacgccgtgatccaggacgaggagcgggacatccccgagcgctcctggaacagcgggtacgagtggatcaccgacttccccggcaagaccgtgtggttcgtcccctccatcaagagcggcaacgacatcgccaactgcctccggaagaacgggaagcgcgtgatccagctgtcccggaagacgttcgacaccgagtaccagaagaccaagaacaacgactgggactacgtggtcaccacggacatcagcgagatgggcgccaacttccgcgcggaccgggtgatcgacccgcgccggtgcctgaagcccgtgatcctcaaggacgggcccgagcgcgtcatcctggccggccccatgccggtgaccgtcgcctccgccgcccagcggcgcgggcggatcggccgcaaccacaacaaggagggcgaccagtacatctacatggggcagcccctgaacaacgacgaggaccacgcgcactggaccgaggccaagatgctcctggacaacatcaacacccccgagggcatcatccccgccctgttcgagccggagcgcgagaagtccgccgccatcgacggggagtaccggctccgcggcgaggcgcggaagacgttcgtggagctgatgcgccgcggggacctgcccgtgtggctctcctacaaggtcgccagcgagggcttccagtacagcgaccgccggtggtgcttcgacggcgagcgcaacaaccaggtgctggaggagaacatggacgtggagatctggaccaaggagggggagcggaagaagctgcgcccccggtggctcgacgcccgcacctactccgaccccctggccctgcgggagttcaaggagttcgccgcgggccgccggagcgtctccggggacctcatcctggagatcggcaagctgccgcagcacctcacccagcgcgcccagaacgccctggacaacctggtgatgctccacaacagcgagcagggcgggcgggcctaccgccacgcgatggaggagctgcccgacacgatcgagaccctgatgctcctggccctgatcgccgtgctcaccggcggggtcaccctgttcttcctgtccggccgggggctcggcaagaccagcatcggcctgctgtgcgtgatggcctccagcgtgctcctgtggatggcctccgtcgagccccactggatcgcggccagcatcatcctggagttcttcctcatggtgctgctgatccccgagccggaccgccagcggacgccccaggacaaccagctcgcctacgtggtcatcgggctgctgttcatgatcctcaccgtggccgccaacgagatgggcctgctggagaccaccaagaaggacctcgggatcggccacgtggcggtcgagaaccaccaccacgccgccatgctggacgtggacctgcaccccgcctccgcctggacgctctacgcggtggccaccaccatcatcaccccgatgatgcgccacacgatcgagaacaccaccgccaacatcagcctgaccgccatcgccaaccaggcggccatcctgatggggctcgacaagggctggcccatctccaagatggacatcggcgtccccctgctggccctcgggtgctacagccaggtgaaccccctgacgctgaccgccgcggtgctcatgctggtcgcccactacgccatcatcggcccggggctgcaggccaaggccacccgcgaggcgcagaagcggaccgccgccggcatcatgaagaaccccacggtggacgggatcgtggccatcgacctcgaccccgtcgtgtacgacgccaagttcgagaagcagctgggccagatcatgctgctcatcctgtgcacctcccagatcctgctcatgcgcaccacctgggcgctgtgcgagagcatcacgctggccaccggccccctcaccaccctgtgggaggggtccccgggcaagttctggaacacgaccatcgccgtgagcatggccaacatcttccgggggtcctacctggccggcgcgggcctcgccttcagcctgatgaagtccctcgggggcgggcgccgggggaccggggcccagggcgagaccctcggcgagaagtggaagcgccagctgaaccagctgtccaagagcgagttcaacacgtacaagcggtccgggatcatggaggtcgaccgcagcgaggccaaggagggcctcaagcgcggggagaccaccaagcacgcggtgtcccgcggcaccgccaagctgcggtggttcgtggagcgcaacctggtcaagcccgaggggaaggtgatcgacctgggctgcggccgcgggggctggagctactactgcgccgggctcaagaaggtgacggaggtcaagggctacaccaagggcggccccggccacgaggagcccatcccgatggccacctacgggtggaacctggtgaagctgcactccggcaaggacgtgttcttcatcccgcccgagaagtgcgacaccctcctgtgcgacatcggggagagctcccccaacccgacgatcgaggagggccgcaccctgcgggtcctcaagatggtggagccctggctgcgcgggaaccagttctgcatcaagatcctgaacccctacatgcccagcgtggtcgagaccctcgagcagatgcagcggaagcacggcggcatgctggtgcgcaacccgctgtcccggaacagcacccacgagatgtactgggtgtcctgcgggaccggcaacatcgtcagcgccgtgaacatgacgtcccgcatgctcctgaaccgcttcaccatggcgcaccggaagcccacctacgagcgcgacgtggacctgggggccggcacccggcacgtcgccgtggagcccgaggtggccaacctcgacatcatcggccagcgcatcgagaacatcaagcacgagcacaagagcacgtggcactacgacgaggacaacccctacaagacctgggcctaccacgggtcctacgaggtcaagccgagcggctccgcgagcagcatggtgaacggggtcgtgaagctgctgaccaagccctgggacgtgatccccatggtcacccagatcgccatgacggacaccacccccttcggccagcagcgggtgttcaaggagaaggtggacacccgcacgccgaaggccaagcgggggaccgcccagatcatggaggtcaccgccaagtggctctggggcttcctgtcccgcaacaagaagccccggatctgcacccgcgaggagttcacgcggaaggtgcgcagcaacgcggccatcggcgccgtgttcgtcgacgagaaccagtggaactccgccaaggaggcggtggaggacgagcggttctgggacctggtgcaccgcgagcgggagctccacaagcaggggaagtgcgcgacctgcgtctacaacatgatgggcaagcgcgagaagaagctgggggagttcggcaaggccaaggggagccgggccatctggtacatgtggctgggcgcccgcttcctcgagttcgaggcgctgggcttcatgaacgaggaccactggttctcccgggagaacagcctgtccggggtggagggcgaggggctccacaagctgggctacatcctgcgcgacatcagcaagatccccgggggcaacatgtacgccgacgacaccgccggctgggacacccggatcacggaggacgacctccagaacgaggcccgcatcaccgacatcatggagccggagcacgccctgctggcgaagtccatcttcaagctcacctaccagaacaaggtggtccgcgtgcagcggcccgccaagaacgggaccgtgatggacgtcatcagccgccgggaccagcgcggctccggccaggtggggacgtacggcctgaacaccttcaccaacatggaggcccagctgatccggcagatggagagcgaggggatcttctcccccagcgagctcgagacccccaacctggccgagcgcgtgctggactggctcgagaagtacggcgtcgagcggctgaagcgcatggccatctccggggacgactgcgtggtgaagccgatcgacgaccggttcgcgacggccctgaccgccctcaacgacatgggcaaggtccgcaaggacatcccccagtgggagcccagcaaggggtggaacgactggcagcaggtccccttctgctcccaccacttccaccagctgatcatgaaggacggccgggagatcgtggtcccgtgccgcaaccaggacgagctggtgggccgggcccgcgtgagccagggggccggctggagcctccgggagaccgcgtgcctggggaagtcctacgcccagatgtggcagctgatgtacttccaccgccgggacctccgcctggccgccaacgcgatctgcagcgccgtccccgtggactggatccccacctcccggacgacctggagcatccacgcccaccaccagtggatgaccaccgaggacatgctgtccgtgtggaaccgcgtctggatcgaggagaacccctggatggaggacaagacgcacatcagctcctggggcgacgtgccgtacctcgggaagcgcgaggaccagtggtgcggcagcctgatcggcctgaccgcccgggccacctgggcgaccaacatccaggtggccatcaaccaggtccgccggctcatcgggaacgagaactacctggactacatgacctccatgaagcgcttcaagaacgagagcgaccccgagggcgccctgtggtga

SEQ ID NO: 8323 - RNA, 9879 nt, synthetic construct
  misc_feature 1..9879: note = derived and/or modified CDS sequence (opt1) from DENV-1__FJ024439__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgcgacaagcggtccgtggccctcgcgccccacgtgggcctggggctggagacccgcaccgagacctggatgagctccgagggcgcctggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcatcatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtggggaagctggtccaccagatcttcggcaccgcctacggggtcctgttctccggcgtgagctggacgatgaagatcgggatcggcgtcctgctgacctggctcggcctgaactcccgcagcacctccttcagcatgacctgcatcgccgtggggctggtgacgctctacctgggcgtcatggtgcaggccgactccgggtgcgtgatcaactggaagggccgggagctgaagtgcgggagcggcatcttcgtcaccaacgaggtgcacacctggaccgagcagtacaagttccaggccgacagcccgaagcgcctctccgcggccatcggcaaggcctgggaggagggggtgtgcggcatccggagcgccacccgcctggagaacatcatgtggaagcagatctccaacgagctgaaccacatcctcctggagaacgacatgaagttcacggtcgtggtgggggacgtcgccggcatcctggcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctcaagctgcgggacagctacacccaggtctgcgaccaccgcctgatgtccgcggccatcaaggacagcaaggccgtgcacgccgacatgggctactggatcgagtccgagaagaacgagacctggaagctcgcccgggcgagcttcatcgaggtgaagacgtgcatctggcccaagtcccacaccctgtggagcaacggcgtcctggagtccgagatgatcatccccaagatctacgggggcccgatcagccagcacaactaccgccccgggtacttcacccagaccgccggcccctggcacctcgggaagctggagctggacttcgacctctgcgagggcacgaccgtggtggtcgacgagcactgcggcaaccgggggccgtccctgcgcaccaccacggtgaccggcaagatcatccacgagtggtgctgccggagctgcaccctgccgcccctgcgcttccgcggggaggacggctgctggtacgggatggagatccgccccgtgaaggagaaggaggagaacctggtcaagtccatggtgagcgccggcagcggcgaggtggactccttcagcctggggctcctgtgcatctccatcatgatcgaggaggtcatgcggagccgctggtcccggaagatgctgatgaccggcacgctcgccgtgttcttcctgctgatcatggggcagctcacctggaacgacctgatccgcctgtgcatcatggtgggcgccaacgcgagcgaccgcatggggatgggcaccacctacctcgccctgatggccacgttcaagatgcggccgatgttcgccgtcgggctcctcttccgccggctgacctcccgcgaggtgctgctcctgaccatcgggctgagcctcgtggcctccgtcgagctgcccaacagcctggaggagctcggcgacgggctggcgatgggcatcatgatcctgaagctcctgaccgacttccagtcccaccagctgtgggccacgctcctgagcctgaccttcatcaagaccaccttctccctccactacgcctggaagacgatggccatggtgctgagcatcgtctccctgttccccctctgcctgagcaccacctcccagaagaccacgtggctgcccgtgctcctgggcagcctggggtgcaagccgctcaccatgttcctgatcgcggagaacaagatctggggccggcgctcctggcccctgaacgaggggatcatggccgtgggcatcgtcagcatcctcctgagctccctgctcaagaacgacgtgcccctggccgggcccctgatcgccggcggcatgctcatcgcctgctacgtgatcagcgggtccagcgcggacctgtccctggagaaggccgccgaggtcagctgggaggaggaggccgagcactccggcgccagccacaacatcctcgtggaggtgcaggacgacgggaccatgaagatcaaggacgaggagcgggacgacaccctgaccatcctgctcaaggcgacgctgctggccgtctccggcgtgtacccgctcagcatccccgccaccctgttcgtgtggtacttctggcagaagaagaagcagcgctccggggtcctgtgggacacccccagcccgcccgaggtgggccgggccgtgctcgacgacggcatctaccgcatcatgcagcgggggctgctgggccgctcccaggtcggggtgggcgtgttccaggagaacgtcttccacaccatgtggcacgtgacgcgcggggccgtgctgatgtaccagggcaagcgcctcgagcccagctgggcgtccgtcaagaaggacctgatcagctacggcgggggctggcggctgcaggggtcctggaacaccggcgaggaggtccaggtgatcgccgtcgagcccgggaagaaccccaagaacgtgcagaccgcccccggcaccttcaagacgcccgagggcgaggtgggggccatcgccctcgacttcaagcccggcaccagcgggtcccccatcgtcaaccgcgagggcaagatcgtgggcctgtacgggaacggcgtggtcaccaccagcgggacgtacgtgagcgcgatcgcccaggccaaggcctcccaggagggcccgctgcccgagatcgaggacgaggtgttccggaagcgcaacctcaccatcatggacctgcaccccgggagcggcaagacccggcgctacctgccggcgatcgtccgggaggccatcaagcgcaagctccgcaccctgatcctggcccccacgcgggtggtggcctccgagatggccgaggcgctcaagggcatgcccatccgctaccagaccaccgccgtcaagagcgagcacaccgggaaggagatcgtggacctgatgtgccacgccacgttcaccatgcggctgctctcccccgtgcgcgtcccgaactacaacatgatcatcatggacgaggcccacttcaccgaccccagctccatcgccgcgcggggctacatcagcacccgcgtggggatgggcgaggccgccgccatcttcatgacggccacgccgcccgggtccgtggaggcgttcccgcagagcaacgccgtcatccaggacgaggagcgggacatccccgagcgctcctggaacagcggctacgagtggatcaccgacttccccggcaagaccgtgtggttcgtgccctccatcaagagcgggaacgacatcgccaactgcctgcggaagaacggcaagcgcgtcatccagctgtcccggaagacgttcgacaccgagtaccagaagaccaagaacaacgactgggactacgtggtgaccacggacatcagcgagatgggggccaacttccgcgcggaccgggtcatcgacccgcgccggtgcctcaagcccgtgatcctgaaggacggccccgagcgcgtgatcctggccgggcccatgccggtcaccgtggcctccgccgcccagcggcgcggccggatcggccgcaaccacaacaaggagggggaccagtacatctacatgggccagcccctcaacaacgacgaggaccacgcgcactggaccgaggccaagatgctgctggacaacatcaacacccccgaggggatcatccccgccctcttcgagccggagcgcgagaagtccgccgccatcgacggcgagtaccggctgcgcggggaggcgcggaagacgttcgtcgagctgatgcgccggggcgacctccccgtgtggctgtcctacaaggtggccagcgagggcttccagtacagcgaccgccggtggtgcttcgacggggagcgcaacaaccaggtcctggaggagaacatggacgtggagatctggaccaaggagggcgagcggaagaagctccgcccccggtggctggacgcccgcacctactccgaccccctggccctccgggagttcaaggagttcgccgcggggcgccggagcgtgtccggcgacctgatcctggagatcggcaagctcccgcagcacctgacccagcgcgcccagaacgccctggacaacctcgtcatgctgcacaacagcgagcagggcgggcgggcctaccgccaggcgatggaggagctgcccgacacgatcgagaccctcatgctgctggccctcatcgccgtgctgaccgggggcgtgaccctgttcttcctctccgggcggggcctgggcaagaccagcatcgggctgctctgcgtcatggcctccagcgtgctgctgtggatggcctccgtggagccccactggatcgcggccagcatcatcctcgagttcttcctgatggtcctgctcatccccgagccggaccgccagcggacgccccaggacaaccagctggcctacgtggtgatcggcctcctcttcatgatcctgaccgtcgccgccaacgagatggggctgctcgagaccaccaagaaggacctgggcatcgggcacgtggcggtggagaaccaccaccacgccgccatgctggacgtcgacctccaccccgcctccgcctggacgctgtacgcggtggccaccaccatcatcaccccgatgatgcgccacacgatcgagaacaccaccgccaacatcagcctgaccgccatcgccaaccaggcggccatcctcatgggcctggacaagggctggcccatctccaagatggacatcggggtgcccctgctcgccctgggctgctacagccaggtcaaccccctgacgctcaccgccgcggtgctgatgctggtggcccactacgccatcatcgggccgggcctccaggccaaggccacccgcgaggcgcagaagcggaccgccgccgggatcatgaagaaccccacggtcgacggcatcgtggccatcgacctggaccccgtggtctacgacgccaagttcgagaagcagctgggccagatcatgctcctgatcctgtgcacctcccagatcctcctgatgcgcaccacctgggcgctgtgcgagagcatcacgctcgccaccgggcccctgaccaccctgtgggagggctccccggggaagttctggaacacgaccatcgccgtgagcatggccaacatcttccggggctcctacctcgccggcgcggggctggccttcagcctgatgaagtccctcggcgggggccgccgggggaccggcgcccagggcgagaccctgggggagaagtggaagcgccagctgaaccagctctccaagagcgagttcaacacgtacaagcggtccggcatcatggaggtggaccgcagcgaggccaaggaggggctgaagcggggcgagaccaccaagcacgcggtctcccgcgggaccgccaagctgcggtggttcgtggagcgcaacctcgtgaagcccgagggcaaggtcatcgacctgggctgcgggcggggcgggtggagctactactgcgccggcctgaagaaggtgacggaggtgaaggggtacaccaagggcggccccgggcacgaggagcccatcccgatggccacctacggctggaacctggtcaagctccactccgggaaggacgtgttcttcatcccgcccgagaagtgcgacaccctgctgtgcgacatcggcgagagctcccccaacccgacgatcgaggaggggcgcaccctccgggtgctgaagatggtcgagccctggctgcgcggcaaccagttctgcatcaagatcctcaacccctacatgcccagcgtggtggagaccctggagcagatgcagcggaagcacggcgggatgctggtccgcaacccgctctcccggaacagcacccacgagatgtactgggtgtcctgcggcaccgggaacatcgtgagcgccgtcaacatgacgtcccgcatgctgctgaaccgcttcaccatggcgcaccggaagcccacctacgagcgcgacgtggacctcggcgccggcacccggcacgtggccgtcgagcccgaggtggccaacctggacatcatcgggcagcgcatcgagaacatcaagcacgagcacaagagcacgtggcactacgacgaggacaacccctacaagacctgggcctaccacggctcctacgaggtgaagccgagcgggtccgcgagcagcatggtcaacggcgtggtcaagctgctcaccaagccctgggacgtgatccccatggtgacccagatcgccatgacggacaccacccccttcgggcagcagcgggtcttcaaggagaaggtggacacccgcacgccgaaggccaagcggggcaccgcccagatcatggaggtgaccgccaagtggctgtggggcttcctgtcccgcaacaagaagccccggatctgcacccgcgaggagttcacgcggaaggtccgcagcaacgcggccatcggggccgtgttcgtggacgagaaccagtggaactccgccaaggaggcggtcgaggacgagcggttctgggacctcgtgcaccgcgagcgggagctgcacaagcagggcaagtgcgcgacctgcgtgtacaacatgatggggaagcgcgagaagaagctgggcgagttcgggaaggccaagggcagccgggccatctggtacatgtggctcggcgcccgcttcctggagttcgaggcgctggggttcatgaacgaggaccactggttctcccgggagaacagcctctccggcgtcgagggggagggcctgcacaagctggggtacatcctccgcgacatcagcaacatccccggcggcaacatgtacgccgacgacaccgccgggtgggacacccggatcacggaggacgacctgcagaacgaggcccgcatcaccgacatcatggagccggagcacgccctgctcgcgaagtccatcttcaagctgacctaccagaacaaggtggtgcgcgtccagcggcccgccaagaacggcaccgtgatggacgtgatcagccgccgggaccagcgcgggtccggccaggtcggcacgtacgggctgaacaccttcaccaacatggaggcccagctcatccggcagatggagagcgagggcatcttctcccccagcgagctggagacccccaacctggccgagcgcgtgctcgactggctggagaagtacggggtggagcggctgaagcgcatggccatctccggcgacgactgcgtcgtgaagccgatcgacgaccggttcgcgacggccctcaccgccctgaacgacatggggaaggtgcgcaaggacatcccccagtgggagcccagcaagggctggaacgactggcagcaggtccccttctgctcccaccacttccaccagctgatcatgaaggacggccgggagatcgtggtgccgtgccgcaaccaggacgagctcgtcgggcgggcccgcgtgagccagggcgccgggtggagcctgcgggagaccgcgtgcctgggcaagtcctacgcccagatgtggcagctcatgtacttccaccgccgggacctgcgcctggccgccaacgcgatctgcagcgccgtgcccgtcgactggatccccacctcccggacgacctggagcatccacgcccaccaccagtggatgaccaccgaggacatgctctccgtgtggaaccgcgtgtggatcgaggagaacccctggatggaggacaagacgcacatcagctcctggggcgacgtcccgtacctgggcaagcgcgaggaccagtggtgcggcagcctgatcgggctcaccgcccgggccacctgggcgaccaacatccaggtggccatcaaccaggtgcgccggctgatcggcaacgagaactacctggactacatgacctccatgaagcgcttcaagaacgagagcgaccccgagggggccctctggtga

SEQ ID NO: 8324 - RNA, 9879 nt, synthetic construct
  misc_feature 1..9879: note = derived and/or modified CDS sequence (opt1) from DENV-1__FJ024441__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgagaccgagcccgacgacgtggactgctggtgcaacgccaccgacacctgggtgacctacgggacctgcagccagacgggcgagcaccggcgcgacaagcggtccgtggccctcgcgccccacgtgggcctggggctggagacccgcaccgagacctggatgagctccgagggcgcctggcggcagatccagcgcgtcgagacgtgggccctccggcaccccgggttcaccgtgatcgccctgttcctggcccacgcgatcggcaccagcatcacccagaaggggatcatcttcatcctcctgatgctggtgacgccctccatggccatgcgctgcgtcggcatcggcagccgggacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcgcaagctctgcatcgaggcgaagatctccaacaccacgaccgacagccggtgcccgacccagggcgaggccaccctggtggaggagcaggacgccaacttcgtctgccgccggacgttcgtggaccgcggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccggaccggcctcgacttcaacgagatggtcctgctgaccatgaaggagaagtcctggctcgtgcacaagcagtggttcctggacctgcccctcccctggaccagcggggccagcacgtcccaggagacctggaaccgccaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccggctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccgcctgatcaccgccaacccgatcgtgaccgacaaggagaagcccgtcaacatcgaggccgagccgcccttcggggagtcctacatcacgatcggcgccggcgagaaggcgctgaagctcagctggttcaagaaggggtccagcatcggcaagatgttcgaggccaccgcccgcggggcccgccgcatggccatcctgggcgacaccgcgtgggacttcgggtccatcggcggcgtgttcaccagcgtggggaagctggtccaccagatcttcggcacggcctacggggtgctgttctccggcgtgagctggaccatgaagatcgggatcggcgtcctgctgacctggctcggcctgaactcccggagcacctccctgagcatgacgtgcatcgccgtggggctcgtgaccctgtacctgggcgtcatggtgcaggccgactccgggtgcgtgatcaactggaagggccgcgagctcaagtgcgggagcggcatcttcgtcaccaacgaggtgcacacctggaccgagcagtacaagttccaggccgacagcccgaagcggctgtccgcggccatcggcaaggcctgggaggagggggtgtgcggcatccgcagcgccacgcggctggagaacatcatgtggaagcagatctccaacgagctcaaccacatcctgctggagaacgacatgaagttcaccgtcgtggtgggggacgtcgccggcatcctcgcgcaggggaagaagatgatccgcccccagcccatggagtacaagtacagctggaagtcctggggcaaggccaagatcatcggcgccgacgtgcagaacaccaccttcatcatcgacgggcccaacacgccggagtgccccgacgaccagcgggcctggaacatctgggaggtggaggactacggcttcgggatcttcaccaccaacatctggctgaagctgcgcgacagctacacccaggtctgcgaccaccggctcatgtccgcggccatcaaggacagcaaggccgtgcacgccgacatgggctactggatcgagtccgagaagaacgagacgtggaagctggcccgcgcgagcttcatcgaggtgaagacctgcgtctggcccaagtcccacaccctgtggagcaacggcgtgctcgagtccgagatgatcatccccaagatctacgggggcccgatcagccagcacaactaccggcccgggtacttcacccagacggccggcccctggcacctggggaagctggagctcgacttcgacctgtgcgagggcaccaccgtggtcgtggacgagcactgcggcaaccgcgggccgtccctgcggaccacgaccgtgaccggcaagatcatccacgagtggtgctgccgcagctgcaccctgccgcccctccggttccgcggggaggacggctgctggtacgggatggagatccggcccgtcaaggagaaggaggagaacctggtgaagtccatggtgagcgccggcagcggcgaggtcgactccttcagcctcgggctgctgtgcatctccatcatgatcgaggaggtgatgcgcagccggtggtcccgcaagatgctcatgacgggcaccctggccgtgttcttcctgctcatcatggggcagctgacctggaacgacctgatccgcctctgcatcatggtcggcgccaacgcgagcgaccggatggggatgggcaccacgtacctggccctgatggccaccttcaagatgcgcccgatgttcgccgtgggcctcctgttccggcgcctgacctcccgggaggtgctcctgctgaccatcgggctcagcctggtcgcctccgtggagctgcccaacagcctcgaggagctgggcgacgggctggcgatgggcatcatgatcctcaagctgctgacggacttccagtcccaccagctctgggccaccctgctgagcctcaccttcatcaagaccacgttctccctgcactacgcctggaagaccatggccatggtcctgagcatcgtgtccctcttccccctgtgcctgagcaccacctcccagaagacgacctggctccccgtgctgctgggcagcctcgggtgcaagccgctgaccatgttcctgatcgcggagaacaagatctggggccgccggtcctggcccctcaacgaggggatcatggccgtcggcatcgtgagcatcctgctgagctccctcctgaagaacgacgtgcccctggccgggcccctcatcgccggcggcatgctgatcgcctgctacgtcatcagcgggtccagcgcggacctgtccctcgagaaggccgccgaggtgagctgggaggaggaggccgagcactccggcgccagccacaacatcctggtggaggtccaggacgacgggaccatgaagatcaaggacgaggagcgcgacgacaccctgacgatcctcctgaaggcgaccctgctcgccgtgtccggcgtgtacccgctgagcatccccgccaccctgttcgtctggtacttctggcagaagaagaagcagcggtccggggtgctctgggacacccccagcccgcccgaggtggagcgcgccgtcctggacgacggcatctaccggatcatgcagcgcggcctgctggggcggtcccaggtgggcgtgggggtcttccaggagaacgtgttccacacgatgtggcacgtgacccgcggcgccgtcctcatgtaccaggggaagcggctggagcccagctgggcgtccgtgaagaaggacctgatcagctacggcggcgggtggcgcctccagggctcctggaacaccggggaggaggtgcaggtcatcgccgtggagcccggcaagaaccccaagaacgtgcagaccgcccccgggacgttcaagacccccgagggcgaggtcggcgccatcgccctggacttcaagcccgggaccagcggctcccccatcgtgaaccgggaggggaagatcgtgggcctgtacggcaacggggtcgtgaccacgagcggcacctacgtgagcgcgatcgcccaggccaaggcctcccaggaggggccgctccccgagatcgaggacgaggtcttccgcaagcggaacctgaccatcatggacctgcaccccggcagcgggaagacccgccggtacctcccggcgatcgtgcgcgaggccatcaagcgcaagctgcggacgctgatcctcgcccccacccgcgtggtcgcctccgagatggccgaggcgctgaagggcatgcccatccggtaccagaccaccgccgtcaagagcgagcacacgggcaaggagatcgtggacctgatgtgccacgccaccttcaccatgcgcctcctgtcccccgtccgggtgccgaactacaacatgatcatcatggacgaggcccacttcaccgaccccagctccatcgccgcgcgcgggtacatcagcacgcgggtgggcatgggggaggccgccgccatcttcatgaccgccacgccgcccggctccgtcgaggcgttcccgcagagcaacgccgtgatccaggacgaggagcgcgacatccccgagcggtcctggaacagcgggtacgagtggatcaccgacttccccggcaagacggtgtggttcgtcccctccatcaagagcggcaacgacatcgccaactgcctgcgcaagaacgggaagcgggtgatccagctctcccgcaagaccttcgacaccgagtaccagaagaccaagaacaacgactgggactacgtggtcacgaccgacatcagcgagatgggcgccaacttccgggcggaccgcgtgatcgacccgcggcgctgcctgaagcccgtgatcctgaaggacgggcccgagcgggtcatcctcgccggccccatgccggtgaccgtcgcctccgccgcccagcgccgggggcgcatcggccgcaaccacaacaaggagggcgaccagtacatctacatggggcagcccctgaacaacgacgaggaccacgcgcactggaccgaggccaagatgctgctcgacaacatcaacacgcccgagggcatcatccccgccctgttcgagccggagcgggagaagtccgccgccatcgacggggagtaccgcctgcggggcgaggcgcgcaagaccttcgtggagctcatgcggcgcggggacctgcccgtgtggctgtcctacaaggtcgccagcgagggcttccagtacagcgaccggcgctggtgcttcgacggcgagcggaacaaccaggtgctcgaggagaacatggacgtggagatctggaccaaggagggggagcgcaagaagctgcggccccgctggctggacgcccggacctactccgaccccctcgccctgcgcgagttcaaggagttcgccgcgggccggcgcagcgtctccggggacctgatcctcgagatcggcaagctgccgcagcacctgacgcagcgggcccagaacgccctcgacaacctggtgatgctgcacaacagcgagcagggcgggcgcgcctaccggcacgcgatggaggagctccccgacaccatcgagaccctgatgctgctcgccctgatcgccgtgctgaccggcggggtcaccctcttcttcctgtccggccgcgggctgggcaagacgagcatcggcctcctgtgcgtgatggcctccagcgtgctgctctggatggcctccgtcgagccccactggatcgcggccagcatcatcctggagttcttcctgatggtgctcctgatccccgagccggaccggcagcgcacgccccaggacaaccagctggcctacgtggtcatcgggctcctgttcatgatcctgaccgtggccgccaacgagatgggcctcctggagaccacgaagaaggacctggggatcggccacgtggcggtcgagaaccaccaccacgccgccatgctcgacgtggacctgcaccccgcctccgcctggaccctgtacgcggtggccaccaccatcatcacgccgatgatgcgccacaccatcgagaacaccaccgccaacatcagcctcacggccatcgccaaccaggcggccatcctgatggggctggacaagggctggcccatctccaagatggacatcggcgtccccctcctggccctggggtgctacagccaggtgaaccccctcaccctgaccgccgcggtgctgatgctcgtcgcccactacgccatcatcggcccggggctgcaggccaaggccacccgggaggcgcagaagcgcacggccgccggcatcatgaagaaccccaccgtggacgggatcgtggccatcgacctggaccccgtcgtgtacgacgccaagttcgagaagcagctcggccagatcatgctgctgatcctctgcacctcccagatcctgctgatgcggaccacgtgggcgctctgcgagagcatcaccctggccaccggccccctgaccacgctctgggaggggtccccgggcaagttctggaacaccaccatcgccgtgagcatggccaacatcttccgcgggtcctacctggccggcgcgggcctggccttcagcctcatgaagtccctcgggggcgggcggcgcgggaccggggcccagggcgagacgctgggcgagaagtggaagcggcagctcaaccagctgtccaagagcgagttcaacacctacaagcgctccgggatcatggaggtcgaccggagcgaggccaaggagggcctgaagcgcggggagaccaccaagcacgcggtgtcccggggcacggccaagctccgctggttcgtggagcggaacctggtcaagcccgaggggaaggtgatcgacctgggctgcggccgcgggggctggagctactactgcgccgggctgaagaaggtgaccgaggtcaagggctacaccaagggcgggcccggccacgaggagcccatcccgatggccacctacgggtggaacctcgtgaagctgcactccggcaaggacgtgttcttcatcccgcccgagaagtgcgacacgctgctctgcgacatcggggagagctcccccaacccgaccatcgaggagggccggaccctgcgcgtcctgaagatggtggagccctggctccgggggaaccagttctgcatcaagatcctgaacccctacatgcccagcgtggtcgagaccctggagcagatgcagcgcaagcacggcggcatgctcgtgcggaacccgctgtcccgcaacagcacccacgagatgtactgggtgtcctgcgggacgggcaacatcgtcagcgccgtgaacatgacctcccgcatgctgctcaaccggttcaccatggcgcaccgcaagcccacctacgagcgggacgtggacctgggggccggcacgcgccacgtcgccgtggagcccgaggtggccaacctggacatcatcggccagcggatcgagaacatcaagcacgagcacaagagcacctggcactacgacgaggacaacccctacaagacctgggcctaccacgggtcctacgaggtcaagccgagcggctccgcgagcagcatggtgaacggggtcgtgaagctcctgaccaagccctgggacgtgatccccatggtcacgcagatcgccatgaccgacaccacccccttcggccagcagcgcgtgttcaaggagaaggtggacacgcggaccccgaaggccaagcgcgggaccgcccagatcatggaggtcaccgccaagtggctgtggggcttcctctcccggaacaagaagccccgcatctgcacgcgggaggagttcacccgcaaggtgcggagcaacgcggccatcggcgccgtgttcgtcgacgagaaccagtggaactccgccaaggaggcggtggaggacgagcgcttctgggacctggtgcaccgggagcgcgagctgcacaagcaggggaagtgcgcgacctgcgtctacaacatgatgggcaagcgggagaagaagctcggggagttcggcaaggccaaggggagccgcgccatctggtacatgtggctgggcgcccggttcctggagttcgaggcgctcggcttcatgaacgaggaccactggttctcccgcgagaacagcctgtccggggtggagggcgaggggctgcacaagctcggctacatcctgcgggacatcagcaagatccccgggggcaacatgtacgccgacgacaccgccggctgggacacgcgcatcaccgaggacgacctgcagaacgaggcccgcatcaccgacatcatggagccggagcacgccctcctggcgaagtccatcttcaagctgacctaccagaacaaggtggtccgggtgcagcgccccgccaagaacgggacggtgatggacgtcatcagccggcgcgaccagcggggctccggccaggtgggcacctacggcctcaacaccttcaccaacatggaggcccagctgatccgccagatggagagcgaggggatcttctcccccagcgagctggagacgcccaacctcgccgagcgggtgctggactggctggagaagtacggcgtcgagcgcctcaagcggatggccatctccggggacgactgcgtggtgaagccgatcgacgaccgcttcgcgaccgccctgaccgccctgaacgacatgggcaaggtccggaaggacatcccccagtgggagcccagcaaggggtggaacgactggcagcaggtccccttctgctcccaccacttccaccagctcatcatgaaggacggccgcgagatcgtggtcccgtgccggaaccaggacgagctggtgggccgcgcccgggtgagccagggggccggctggagcctgcgcgagaccgcgtgcctcgggaagtcctacgcccagatgtggcagctgatgtacttccaccggcgcgacctgcggctcgccgccaacgcgatctgcagcgccgtccccgtggactggatccccacgtcccgcaccacctggagcatccacgcccaccaccagtggatgaccacggaggacatgctgtccgtgtggaaccgcgtctggatcgaggagaacccctggatggaggacaagacccacatcagctcctggggcgacgtgccgtacctggggaagcgggaggaccagtggtgcggcagcctcatcggcctgaccgcccgcgccacctgggcgaccaacatccaggtggccatcaaccaggtccggcgcctgatcgggaacgagaactacctcgactacatgacgtccatgaagcggttcaagaacgagagcgaccccgagggcgccctgtggtga

SEQ ID NO: 8325 - RNA, 9879 nt, synthetic construct
  misc_feature 1..9879: note = derived and/or modified CDS sequence (opt1) from DENV-1__FJ024442__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagacctccgccggggtgaacatgtgcaccctcatcgccatggacctgggcgagctgtgcgaggacaccatgacctacaagtgcccccgcatcaccgagaccgagcccgacgacgtggactgctggtgcaacgccacggacacctgggtcacctacgggacctgcagccagacgggcgagcaccggcgcgacaagcggtccgtggccctcgcgccccacgtgggcctggggctggagacccgcaccgagacctggatgagctccgagggcgcgtggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcatcatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtggggaagctggtccaccagatcttcggcaccgcctacggggtgctgttctccggcgtgagctggacgatgaagatcgggatcggcgtcctgctgacctggctcggcctgaactcccgcagcacctccctgagcatgacctgcatcgccgtggggctcgtgacgctgtacctgggcgtcatggtgcaggccgactccgggtgcgtgatcaactggaagggccgggagctcaagtgcgggagcggcatcttcgtcaccaacgaggtgcacacctggaccgagcagtacaagttccaggccgacagcccgaagcgcctgtccgcggccatcggcaaggcctgggaggagggggtgtgcggcatccggagcgccacccgcctggagaacatcatgtggaagcagatctccaacgagctcaaccacatcctgctggagaacgacatgaagttcacggtcgtggtgggggacgtcgccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctgaagctgcgggacagctacacccaggtctgcgaccaccgcctcatgtccgcggccatcaaggacagcaaggccgtgcacgccgacatgggctactggatcgagtccgagaagaacgagacctggaagctggcccgggcgagcttcatcgaggtgaagacgtgcatctggcccaagtcccacaccctgtggagcaacggcgtcctcgagtccgagatgatcatccccaagatctacgggggcccgatcagccagcacaactaccgccccgggtacttcacccagaccgccggcccctggcacctggggaagctggagctcgacttcaacctgtgcgagggcacgaccgtggtggtcgacgagcactgcggcaaccgggggccgtccctgcgcaccaccacggtgaccggcaagatcatccacgagtggtgctgccggagctgcaccctgccgcccctccgcttccgcggggaggacggctgctggtacgggatggagatccgccccgtgaaggagaaggaggagaacctggtcaagtccatggtgagcgccggcagcggcgaggtggactccttcagcctcgggctgctgtgcatctccatcatgatcgaggaggtcatgcggagccgctggtcccggaagatgctcatgaccggcacgctggccgtgttcttcctgctcatcatggggcagctgacctggaacgacctgatccgcctctgcatcatggtgggcgccaacgcgagcgaccgcatggggatgggcaccacctacctggccctgatggccacgttcaagatgcggccgatgttcgccgtcggcctcctgttccgccggctgacctcccgcgaggtgctcctgctgaccatcgggctcagcctggtggcctccgtcgagctgcccaacagcctcgaggagctgggcgacgggctggcgatgggcatcatgatcctcaagctgctgaccgacttccagtcccaccagctctgggccacgctgctgagcctcaccttcatcaagaccaccttctccctgcactacgcctggaagacgatggccatggtgctgagcatcgtctccctcttccccctgtgcctgagcaccacctcccagaagaccacgtggctccccgtgctgctgggcagcctcgggtgcaagccgctgaccatgttcctgatcgcggagaacaagatctggggccggcgctcctggcccctcaacgaggggatcatggccgtgggcatcgtcagcatcctgctgagctccctcctgaagaacgacgtgcccctggccgggcccctcatcgccggcggcatgctgatcgcctgctacgtgatcagcgggtccagcgcggacctgtccctcgagaaggccgccgaggtcagctgggaggaggaggccgagcactccggcgccagccacaacatcctggtggaggtgcaggacgacgggaccatgaagatcaaggacgaggagcgggacgacaccctgaccatcctcctgaaggcgacgctgctcgccgtctccggcgtgtacccgctgagcatccccgccaccctgttcgtgtggtacttctggcagaagaagaagcagcgctccggggtcctctgggacacccccagcccgcccgaggtggagcgggccgtgctggacgacggcatctaccgcatcatgcagcggggcctgctggggcgctcccaggtcggcgtgggggtgttccaggagaacgtcttccacaccatgtggcacgtgacgcggggcgccgtgctcatgtaccaggggaagcgcctggagcccagctgggcgtccgtcaagaaggacctgatcagctacggcggcgggtggcggctccagggctcctggaacaccggggaggaggtccaggtgatcgccgtcgagcccggcaagaaccccaagaacgtgcagaccgcccccgggaccttcaagacgcccgagggcgaggtgggcgccatcgccctggacttcaagcccgggaccagcggctcccccatcgtcaaccgcgaggggcggatcgtgggcctgtacggcaacggggtggtcaccaccagcggcacgtacgtgagcgcgatcgcccaggccaaggcctcccaggaggggccgctccccgagatcgaggacgaggtgttccgcaagcggaacctgaccatcatggacctgcaccccggcagcgggaagacccgccggtacctcccggcgatcgtccgcgaggccatcaagcgcaagctgcggaccctgatcctcgcccccacgcgcgtggtggcctccgagatggccgaggcgctgaagggcatgcccatccggtaccagaccaccgccgtcaagagcgagcacaccggcaaggagatcgtggacctgatgtgccacgccacgttcaccatgcgcctcctgtcccccgtgcgggtcccgaactacaacatgatcatcatggacgaggcccacttcaccgaccccagctccatcgccgcgcgcgggtacatcagcacccgggtgggcatgggggaggccgccgccatcttcatgacggccacgccgcccggctccgtggaggcgttcccgcagagcaacgccgtcatccaggacgaggagcgcgacatccccgagcggtcctggaacctggggtacgagtggatcaccgacttccccggcaagaccgtgtggttcgtgcccagcatcaagtccggcaacgacatcgccaactgcctccgcaagaacgggaagcgggtcatccagctgagccgcaagacgttcgacaccgagtaccagaagaccaagaacaacgactgggactacgtggtgaccacggacatctccgagatgggcgccaacttccgggcggaccgcgtcatcgacccgcggcgctgcctgaagcccgtgatcctcaaggacgggcccgagcgggtgatcctggccggccccatgccggtcaccgtggccagcgccgcccagcgccgggggcgcatcggccgcaaccacaacaaggagggcgaccagtacatctacatggggcagcccctgaacaacgacgaggaccacgcgcactggaccgaggccaagatgctcctggacaacatcaacacccccgagggcatcatccccgccctgttcgagccggagcgggagaagtccgccgccatcgacggggagtaccgcctccggggcgaggcgcgcaagacgttcgtcgagctgatgcggcgcggggacctgcccgtgtggctcagctacaaggtggcctccgagggcttccagtacagcgaccggcgctggtgcttcgacggcgagcggaacaaccaggtcctggaggagaacatggacgtggagatctggaccaaggagggggagcgcaagaagctgcggccccgctggctcgacgcccggacctacagcgaccccctggccctgcgcgagttcaaggagttcgccgcgggccggcgctccgtgagcggggacctcatcctggagatcggcaagctgccgcagcacctcacccagcgggcccagaacgccctggacaacctggtcatgctccacaactccgagcagggcgggcgcgcctaccggcacgcgatggaggagctgcccgacacgatcgagaccctgatgctcctggccctgatcgccgtgctcaccggcggggtgaccctgttcttcctgagcggccgcgggctcggcaagacctccatcggcctgctgtgcgtcatggccagctccgtgctcctgtggatggccagcgtggagccccactggatcgcggcctccatcatcctggagttcttcctcatggtcctgctgatccccgagccggaccggcagcgcacgccccaggacaaccagctcgcctacgtggtgatcgggctgctgttcatgatcctcaccgtcgccgccaacgagatgggcctgctggagaccaccaagaaggacctcgggatcggccacgtggcggtggagaaccaccaccacgccgccatgctggacgtcgacctgcaccccgccagcgcctggacgctctacgcggtggccaccaccatcatcaccccgatgatgcgccacacgatcgagaacaccaccgccaacatctccctgaccgccatcgccaaccaggcggccatcctgatggggctcgacaagggctggcccatcagcaagatggacatcggcgtgcccctgctggccctcgggtgctactcccaggtcaaccccctgacgctgaccgccgcggtgctcatgctggtggcccactacgccatcatcggcccggggctgcaggccaaggccacccgggaggcgcagaagcgcaccgccgccggcatcatgaagaaccccacggtcgacgggatcgtggccatcgacctcgaccccgtggtctacgacgccaagttcgagaagcagctgggccagatcatgctgctcatcctgtgcaccagccagatcctgctcatgcggaccacctgggcgctgtgcgagtccatcacgctggccaccggccccctcaccaccctgtgggaggggagcccgggcaagttctggaacacgaccatcgccgtgtccatggccaacatcttccgcgggagctacctggccggcgcgggcctcgccttctccctgatgaagtccctcgggggcgggcggcgcgggaccggggcccagggcgagaccctcggcgagaagtggaagcggcagctgaaccagctgagcaagtccgagttcaacacgtacaagcgcagcgggatcatggaggtggaccggtccgaggccaaggagggcctcaagcgcggggagaccaccaagcacgcggtcagccggggcaccgccaagctgcgctggttcgtggagcggaacctggtgaagcccgaggggaaggtcatcgacctgggctgcggccgcgggggctggtcctactactgcgccgggctcaagaaggtgacggaggtgaagggctacaccaagggcgggcccggccacgaggagcccatcccgatggccacctacgggtggaacctggtcaagctgcacagcggcaaggacgtgttcttcatcccgcccgagaagtgcgacaccctcctgtgcgacatcggggagtccagccccaacccgacgatcgaggagggccggaccctgcgcgtgctcaagatggtcgagccctggctgcgggggaaccagttctgcatcaagatcctgaacccctacatgccctccgtggtggagaccctcgagcagatgcagcgcaagcacggcggcatgctggtccggaacccgctgagccgcaactccacccacgagatgtactgggtgagctgcgggaccggcaacatcgtgtccgccgtcaacatgacgagccgcatgctcctgaaccggttcaccatggcgcaccgcaagcccacctacgagcgggacgtggacctgggggccggcacccgccacgtggccgtcgagcccgaggtggccaacctcgacatcatcggccagcggatcgagaacatcaagcacgagcacaagtccacgtggcactacgacgaggacaacccctacaagacctgggcctaccacgggagctacgaggtgaagccgtccggcagcgcgtccagcatggtcaacggggtggtcaagctgctgaccaagccctgggacgtgatccccatggtgacccagatcgccatgacggacaccacccccttcggccagcagcgcgtcttcaaggagaaggtggacacccggacgccgaaggccaagcgcgggaccgcccagatcatggaggtgaccgccaagtggctctggggcttcctgagccggaacaagaagccccgcatctgcacccgggaggagttcacgcgcaaggtccggtccaacgcggccatcggcgccgtgttcgtggacgagaaccagtggaacagcgccaaggaggcggtcgaggacgagcgcttctgggacctggtgcaccgggagcgcgagctccacaagcaggggaagtgcgcgacctgcgtgtacaacatgatgggcaagcgggagaagaagctgggggagttcggcaaggccaaggggtcccgcgccatctggtacatgtggctgggcgcccggttcctcgagttcgaggcgctgggcttcatgaacgaggaccactggttcagccgcgagaactccctgagcggggtcgagggcgaggggctccacaagctgggctacatcctgcgggacatctccaagatccccgggggcaacatgtacgccgacgacaccgccggctgggacacccgcatcacggaggacgacctccagaacgaggcccgcatcaccgacatcatggagccggagcacgccctgctggccaagagcatcttcaagctcacctaccagaacaaggtggtgcgggtccagcgccccgccaagaacgggaccgtgatggacgtgatctcccggcgcgaccagcggggcagcgggcaggtcggcacgtacggcctgaacaccttcaccaacatggaggcccagctgatccgccagatggagtccgaggggatcttcagcccctccgagctcgagacccccaacctggccgagcgggtgctggactggctcgagaagtacggcgtggagcgcctgaagcggatggccatcagcggggacgactgcgtcgtgaagccgatcgacgaccgcttcgcgacggccctgaccgccctcaacgacatgggcaaggtgcggaaggacatcccccagtgggagccctccaaggggtggaacgactggcagcaggtccccttctgcagccaccacttccaccagctgatcatgaaggacggccgcgagatcgtggtgccgtgccggaaccaggacgagctggtcggccgcgcccgggtgtcccagggggccggctggagcctccgcgagaccgcgtgcctgggcaagagctacgcccagatgtggcagctgatgtacttccaccggcgcgacctccggctggccgccaacgcgatctgctccgccgtgcccgtcgactggatccccaccagccgcacgacctggtccatccacgcccaccaccagtggatgaccaccgaggacatgctgagcgtgtggaaccgcgtgtggatcgaggagaacccctggatggaggacaagacgcacatctccagctggggcgacgtcccgtacctcgggaagcgggaggaccagtggtgcggctccctgatcggcctgaccgcccgcgccacctgggcgaccaacatccaggtggccatcaaccaggtgcggcgcctcatcgggaacgagaactacctggactacatgaccagcatgaagcggttcaagaacgagggcgaccccgagggggccctgtggtga

SEQ ID NO: 8326 - RNA, 9879 nt, synthetic construct
  misc_feature 1..9879: note = derived and/or modified CDS sequence (opt1) from DENV-1__FJ373296__SS-prME
  source 1..9879: mol_type = other RNA
agcgtgaccatgctgctcatgctgatgcccatcgccctggccttccacctcaccacccgcggcggggagccccacatgatcgtgagcaagcaggagcggggcaagagcctgctgttcaagaccagcgcgggggtgaacatgtgcaccctcatcgccatggacctgggcgagctgtgcgaggacaccatgacctacaagtgcccccgcatcaccgaggccgagcccgacgacgtggactgctggtgcaacgccaccgacacctgggtgacgtacgggacctgcagccagaccggcgagcaccggcgcgacaagcggtccgtggccctcgcgccccacgtgggcctggggctggagacccgcacggagacctggatgagctccgagggcgcctggaagcagatccagcgggtggagacctgggccctccgccaccccgggttcaccgtgatcgccctgttcctggcgcacgccatcggcacgagcatcacccagaaggggatcatcttcatcctcctgatgctggtgaccccctccatggccatgcggtgcgtcggcatcggcagccgcgacttcgtggaggggctctccggcgccacctgggtggacgtcgtgctggagcacgggagctgcgtgacgaccatggccaaggacaagcccaccctggacatcgagctcctgaagaccgaggtcacgaaccccgcggtgctgcggaagctctgcatcgaggccaagatctccaacaccaccaccgacagccgctgcccgacgcagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgacgaagctggagggcaagatcgtccagtacgagaacctgaagtacagcgtgatcgtgaccgtccacaccggcgaccagcaccaggtggggaacgagtccaccgagcacggcacgaccgcgaccatcacgccccaggcccccaccacggagatccagctcaccgactacggggccctgaccctggactgcagcccccgcaccggcctcgacttcaacgagatggtcctgctgacgatgaaggagaagtcctggctcgtgcacaagcagtggttcctggacctgcccctcccctggaccagcggggccagcacctcccaggagacctggaaccggcaggacctgctggtgacgttcaagaccgcccacgcgaagaagcaggaggtcgtggtgctcggcagccaggagggcgccatgcacaccgccctgaccggggccacggagatccagacctccggcaccaccacgatcttcgccgggcacctgaagtgccgcctcaagatggacaagctgaccctgaagggcatgagctacgtcatgtgcaccgggtccttcaagctcgagaaggaggtggcggagacccagcacggcacggtgctggtccagatcaagtacgagggcaccgacgccccctgcaagatccccttcagcacccaggacgagaagggggccacccagaacggccggctgatcacggccaacccgatcgtgaccgacaaggagaagcccgtgaacatcgaggcggagccgcccttcggggagtcctacatcgtcatcggcgccggcgagaaggccctgaagctcagctggttcaagaaggggtccagcatcggcaagatgttcgaggccaccgcccgcggggcgcggcgcatggccatcctgggcgacaccgcctgggacttcgggtccatcggcggcgtgttcacgagcgtggggaagctggtccaccagatcttcggcaccgcctacggggtcctcttctccggcgtgagctggaccatgaagatcgggatcggcgtcctgctgacctggctcggcctgaactcccgcagcacgtccctgagcatgacctgcatcgccgtggggctcgtgaccctgtacctgggcgtcatggtgcaggcggactccgggtgcgtgatcaactggaagggccgggagctcaagtgcgggagcggcatcttcgtcaccaacgaggtgcacacgtggaccgagcagtacaagttccaggccgacagcccgaagcgcctgtccgccgccatcggcaaggcctgggaggagggggtgtgcggcatccggagcgcgacccgcctggagaacatcatgtggaagcagatctccaacgagctcaaccacatcctgctggagaacgacatgaagctcaccgtcgtggtgggggacgtcgccggcatcctggggcagggcaagaagatgatccggccccagcccatggagtacaagtacagctggaagtcctggggcaaggccaagatcatcggggccgacgcgcagaacaccacgttcatcatcgacggccccaacaccccggagtgccccgacgaccagcgcgcctggaacatctgggaggtggaggactacgggttcggcatcttcaccaccaacatctggctgaagctccgggacagctacacccaggtgtgcgaccaccgcctgatgtccgccgccatcaaggacagcaaggccgtccacgcggacatgggctactggatcgagtccgagaagaacgagacctggaagctggcccgggccagcttcatcgaggtgaagacctgcatctggcccaagtcccacaccctctggagcaacggggtgctggagtccgagatgatcatccccaagatctacggcgggccgatcagccagcacaactaccgccccggctacttcacgcagaccgccgggccctggcacctgggcaagctcgagctggacttcgacctgtgcgagggcaccaccgtcgtggtggacgagcactgcgggaaccggggcccgtccctccgcacgaccaccgtcaccgggaagatcatccacgagtggtgctgccggagctgcacgctgccgcccctgcgcttccggggcgaggacgggtgctggtacggcatggagatccgccccgtgaaggagaaggaggagaacctcgtgaagtccatggtcagcgccggcagcggggaggtggactccttcagcctgggcctgctctgcatctccatcatgatcgaggaggtgatgcggagccgctggtcccggaagatgctgatgaccgggaccctggcggtcttcttcctcctgatcatgggccagctgacctggaacgacctcatccgcctgtgcatcatggtgggggccaacgccagcgaccgcatgggcatgggcacgacctacctggccctcatggccaccttcaagatgcggccgatgttcgcggtggggctgctgttccgccggctcacctcccgcgaggtcctgctgctcacgatcggcctgagcctggtggcctccgtggagctccccaacagcctggaggagctgggggacggcctcgccatgggcatcatgatcctgaagctgctcaccgacttccagtcccaccagctgtgggccaccctgctcagcctgaccttcatcaagacgaccttctccctgcactacgcgtggaagaccatggccatggtcctcagcatcgtgtccctgttccccctgtgcctcagcaccacgtcccagaagaccacctggctgcccgtcctgctcgggagcctgggctgcaagccgctgaccatgttcctcatcgccgagaacaagatctgggggcggaagtcctggcccctgaacgagggcatcatggccgtggggatcgtgagcatcctgctcagctccctgctgaagaacgacgtccccctcgccggccccctgatcgcgggcgggatgctgatcgcctgctacgtgatcagcggctccagcgccgacctctccctggagaaggccgccgaggtgagctgggaggaggaggcggagcactccggggccagccacaacatcctggtcgaggtgcaggacgacggcacgatgaagatcaaggacgaggagcgcgacgacaccctcaccatcctgctgaaggccaccctcctggccgtgtccggggtctacccgctgagcatccccgccaccctcttcgtgtggtacttctggcagaagaagaagcagcggtccggcgtgctgtgggacacgcccagcccgcccgaggtcgagcgcgcggtgctggacgacggcatctaccggatcatgcagcgcgggctgctcggccggtcccaggtgggggtcggcgtgttccaggagaacgtgttccacaccatgtggcacgtcacccgcggggccgtgctgatgtaccagggcaagcggctggagcccagctgggcctccgtgaagaaggacctcatcagctacggcgggggctggcgcctgcgggggtcctggaacaccggcgaggaggtccaggtgatcgccgtggagcccgggaagaaccccaagaacgtccagacggcccccggcaccttcaagacccccgagggcgaggtgggggcgatcgccctggacttcaagcccggcaccagcgggtcccccatcgtgaaccgcgagggcaagatcgtcggcctctacgggaacggcgtggtgacgaccagcgggacctacgtcagcgccatcgcccaggcgaaggcctcccaggagggcccgctgcccgagatcgaggacgaggtgttccggaagcgcaacctgaccatcatggacctccaccccgggagcggcaagacgcggcgctacctgccggccatcgtgcgggaggccatcaagcgcaagctgcgcaccctcatcctggcccccacccgggtcgtggcgtccgagatggccgaggccctgaagggcatgcccatccgctaccagaccacggccgtcaagagcgagcacaccgggaaggagatcgtcgacctcatgtgccacgccaccttcaccatgcggctgctgtcccccgtgcgcgtgccgaactacaacatgatcatcatggacgaggcgcacttcacggaccccagctccatcgccgcccggggctacatcagcacccgcgtcgggatgggcgaggccgccgcgatcttcatgaccgccacgccgcccgggtccgtggaggccttcccgcagagcaacgccgtgatccaggacgaggagcgggacatccccgagcgctcctggaacagcggctacgagtggatcacggacttccccggcaagaccgtctggttcgtgccctccatcaagagcgggaacgacatcgcgaactgcctccggaagaacggcaagcgcgtgatccagctgtcccggaagaccttcgacaccgagtaccagaagacgaagaacaacgactgggactacgtcgtgaccaccgacatcagcgagatgggggccaacttccgcgccgaccgggtgatcgacccgcgccggtgcctgaagcccgtcatcctcaaggacggccccgagcgcgtgatcctggccgggcccatgccggtgaccgtcgcctccgcggcccagcggcgcggccggatcggccgcaaccacaacaaggagggggaccagtacatctacatgggccagcccctgaacaacgacgaggaccacgcccactggacggaggccaagatgctcctggacaacatcaacacccccgaggggatcatccccgccctgttcgagccggagcgcgagaagtccgcggccgtggacggcgagtaccggctccgcggggaggcccggaagaccttcgtcgagctgatgcgccggggcgacctgcccgtgtggctctcctacaaggtggccagcgagggcttccagtacagcgaccgccggtggtgcttcgacggggagcgcaacaaccaggtcctggaggagaacatggacgtggagatctggaccaaggagggcgagcggaagaagctgcgcccccggtggctcgacgcccgcacgtactccgaccccctggcgctgcgggagttcaaggagttcgccgccgggcgccggagcgtgtccggcgacctcatcctggagatcggcaagctgccgcagcacctcacccagcgcgcccagaacgcgctggacaacctggtcatgctccacaacagcgagcagggcgggcgggcctaccgccacgccatggaggagctgcccgacaccatcgagaccctgatgctcctggccctgatcgccgtgctcaccgggggcgtgaccctgttcttcctgtccgggcggggcctcggcaagaccagcatcgggctgctgtgcgtcatggcgtccagcgtgctcctgtggatggcctccgtggagccccactggatcgccgccagcatcatcctggagttcttcctcatggtcctgctgatccccgagccggaccgccagcggacgccccaggacaaccagctcgcctacgtggtgatcggcctgctgttcatgatcctcaccgtcgcggccaacgagatggggctgctggagacgaccaagaaggacctcggcatcgggcacgtggccgtggagaaccaccaccacgccgccatgctggacgtcgacctgcaccccgcgtccgcctggaccctctacgccgtggccaccacgatcatcaccccgatgatgcgccacaccatcgagaacaccacggccaacatcagcctgaccgcgatcgccaaccaggccgccatcctgatgggcctcgacaagggctggcccatctccaagatggacatcggggtgcccctgctggcgctcggctgctacagccaggtcaaccccctgaccctgaccgccgccgtgctcatgctggtggcccactacgccatcatcgggccgggcctgcaggcgaaggccacgcgcgaggcccagaagcggaccgccgccgggatcatgaagaaccccaccgtcgacggcatcgtggcgatcgacctcgaccccgtggtctacgacgccaagttcgagaagcagctgggccagatcatgctgctcatcctgtgcacctcccagatcctgctcatgcgcacgacctgggccctgtgcgagagcatcaccctggccaccgggcccctcacgaccctgtgggagggctccccggggaagttctggaacaccaccatcgccgtgagcatggcgaacatcttccggggctcctacctggccggcgccgggctcgccttcagcctgatgaagtccctgggcgggggccgccgggggacgggcgcgcagggcgagaccctcggggagaagtggaagcgccagctgaaccagctgtccaagagcgagttcaacacctacaagcggtccggcatcatggaggtggaccgcagcgaggccaaggaggggctcaagcggggcgagaccacgaagcacgccgtctcccgcgggaccgccaagctgcggtggttcgtggagcgcaacctggtgaagcccgagggcaaggtcatcgacctgggctgcgggcggggcgggtggagctactactgcgccggcctcaagaaggtgaccgaggtgaaggggtacaccaagggcggccccgggcacgaggagcccatcccgatggcgacgtacggctggaacctggtcaagctgcactccgggaaggacgtgttcttcatcccgcccgagaagtgcgacaccctcctgtgcgacatcggcgagagctcccccaacccgaccatcgaggaggggcgcaccctgcgggtgctcaagatggtcgagccctggctgcgcggcaaccagttctgcatcaagatcctgaacccctacatgcccagcgtggtggagacgctcgagcagatgcagcggaagcacggcgggatgctggtccgcaacccgctgtcccggaacagcacccacgagatgtactgggtgtcctgcggcaccgggaacatcgtgagcgccgtcaacatgacctcccgcatgctcctgaaccgcttcaccatggcccaccggaagcccacgtacgagcgcgacgtggacctgggcaccggcacccggcacgtggccgtcgagcccgaggtggccaacctcgacatcatcgggcagcgcatcgagaacatcaagcacgagcacaagagcacctggcactacgacgaggacaacccctacaagacgtgggcgtaccacggctcctacgaggtgaagccgagcgggtccgccagcagcatggtcaacggcgtggtcaagctgctgaccaagccctgggacgtgatccccatggtgacccagatcgccatgaccgacacgacccccttcgggcagcagcgggtcttcaaggagaaggtggacacccgcaccccgaaggccaagcggggcacggcccagatcatggaggtgaccgcgcgctggctctggggcttcctgtcccggaacaagaagccccgcatctgcacccgggaggagttcacccgcaaggtccggagcaacgccgccatcggggccgtgttcgtggacgagaaccagtggaactccgcgaaggaggccgtcgaggacgagcgcttctgggacctggtgcaccgggagcgcgagctccacaagcagggcaagtgcgccacgtgcgtgtacaacatgatggggaagcgggagaagaagctgggcgagttcgggaaggccaagggcagccgcgccatctggtacatgtggctgggcgcgcggttcctcgagttcgaggccctggggttcatgaacgaggaccactggttctcccgcgagaacagcctgtccggcgtcgagggggagggcctccacaagctggggtacatcctgcgggacatcagcaagatccccggcggcaacatgtacgccgacgacaccgccgggtgggacacccgcatcaccgaggacgacctccagaacgaggccaagatcacggacatcatggagccggagcacgcgctgctggccaaggccatcttcaagctcacctaccagaacaaggtggtgcgcgtccagcggcccgccaagaacggcaccgtgatggacgtgatctcccgccgggaccagcgcgggagcggccaggtcggcacctacgggctgaacacgttcaccaacatggaggcccagctgatccggcagatggagtccgagggcatcttcagcccctccgagctcgagacccccaacctggcggagcgcgccctggactggctcgagaagtacggggtggagcggctgaagcgcatggccatcagcggcgacgactgcgtggtcaagccgatcgacgaccggttcgccaccgccctgacggcgctcaacgacatggggaaggtgcgcaaggacatcccccagtgggagccctccaagggctggaacgactggcagcaggtccccttctgcagccaccacttccaccagctgatcatgaaggacggccgggagatcgtcgtgccgtgccgcaaccaggacgagctggtggggcgggcccgcgtctcccagggcgccgggtggagcctccgggagaccgcctgcctgggcaagagctacgcgcagatgtggcagctgatgtacttccaccgccgggacctccgcctggccgccaacgccatctgctccgccgtgcccgtggactgggtccccaccagccggaccacgtggtccatccacgcgcaccaccagtggatgaccaccgaggacatgctgagcgtgtggaaccgcgtgtggatcgaggagaacccctggatggaggacaagacccacatctccagctgggaggacgtcccgtacctcgggaagcgcgaggaccagtggtgcggctccctgatcggcctgacggcccgggccacctgggccaccaacatccaggtggccatcaaccaggtgcgccggctcatcgggaacgagaactacctggactacatgaccagcatgaagcgcttcaagaacgagtccgaccccgagggcgcgctgtggtga

SEQ ID NO: 8327 - RNA, 9879 nt, synthetic construct
  misc_feature 1..9879: note = derived and/or modified CDS sequence (opt1) from DENV-1__FJ182018__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgggacaagcggtccgtggccctcgcgccccacgtgggcctggggctggagacccgcaccgagacctggatgagctccgagggcgcctggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcatcatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtggggaagctggtccaccagatcttcggcaccgcctacggggtgctgttctccggcgtgagctggacgatgaagatcgggatcggcgtcctgctgacctggctcggcctgaactcccgcagcacctccctgagcatgacctgcatcgccgtggggctcgtgacgctgtacctgggcgtcatggtgcaggccgactccgggtgcgtgatcaactggaagggccgggagctcaagtgcgggagcggcatcttcgtcaccaacgaggtgcacacctggaccgagcagtacaagttccaggccgacagcccgaagcgcctgtccgcggccatcggcaaggcctgggaggagggggtgtgcggcatccggagcgccacccgcctggagaacatcatgtggaagcagatctccaacgagctcaaccacatcctgctggagaacgacatgaagttcacggtcgtggtgggggacgtcgccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctgaagctgcgggacagccacacccaggtctgcgaccaccgcctcatgtccgcggccatcaaggacagcaaggccgtgcacgccgacatgggctactggatcgagtccgagaagaacgagacctggaagctggcccgggcgagcttcatcgaggtgaagacgtgcatctggcccaagtcccacaccctgtggagcaacggcgtcctcgagtccgagatgatcatccccaagatctacgggggcccgatcagccagcacaactaccgccccgggtacttcacccagaccgccggcccctggcacctggggaagctggagctcgacttcgacctgtgcgagggcacgaccgtggtggtcgacgagcactgcggcaaccgggggccgtccctgcgcaccaccacggtgaccggcaagatcatccacgagtggtgctgccggagctgcaccctgccgcccctccgcttccgcggggaggacggctgctggtacgggatggagatccgccccgtgaaggagaaggaggagaacctggtcaagtccatggtgagcgccggcagcggcgaggtggactccttcagcctcgggctgctgtgcatctccatcatgatcgaggaggtcatgcggagccgctggtcccggaagatgctcatgaccggcacgctggccgtgttcttcctgctcatcatggggcagctgacctggaacgacctgatccgcctctgcatcatggtgggcgccaacgcgagcgaccgcatggggatgggcaccacctacctggccctgatggccacgttcaagatgcggccgatgttcgccgtcggcctcctgttccgccggctgacctcccgcgaggtgctcctgctgaccatcgggctcagcctggtggcctccgtcgagctgcccaacagcctcgaggagctgggcgacgggctggcgatgggcatcatgatcctcaagctgctgaccgacttccagtcccaccagctctgggccacgctgctgagcctcaccttcatcaagaccaccttctccctgcactacgcctggaagacgatggccatggtgctgagcatcgtctccctcttccccctgtgcctgagcaccacctcccagaagaccacgtggctccccgtgctgctgggcagcctcgggtgcaagccgctgaccatgttcctgatcgcggagaacaagatctggggccggcgctcctggcccctcaacgaggggatcatggccgtgggcatcgtcagcatcctgctgagctccctcctgaagaacgacgtgcccctggccgggcccctcatcgccggcggcatgctgatcgcctgctacgtgatcagcgggtccagcgcggacctgtccctcgagaaggccgccgaggtcagctgggaggaggaggccgagcactccggcgccagccacaacatcctggtggaggtgcaggacgacgggaccatgaagatcaaggacgaggagcgggacgacaccctgaccatcctcctgaaggcgacgctgctcgccgtctccggcgtgtacccgctgagcatccccgccaccctgttcgtgtggtacttctggcagaagaagaagcagcgctccggggtcctctgggacacccccagcccgcccgaggtggagcgggccgtgctggacgacggcatctaccgcatcatgcagcggggcctgctggggcgctcccaggtcggcgtgggggtgttccaggagaacgtcttccacaccatgtggcacgtgacgcggggcgccgtgctcatgtaccaggggaagcgcctggagcccagctgggcgtccgtcaagaaggacctgatcagctacggcggcgggtggcggctccagggctcctggaacaccggggaggaggtccaggtgatcgccgtcgagcccggcaagaaccccaagaacgtgcagaccgcccccgggaccttcaagacgcccgagggcgaggtgggcgccatcgccctggacttcaagcccgggaccagcggctcccccatcgtcaaccgcgaggggaagatcgtgggcctgtacggcaacggggtggtcaccaccagcggcacgtacgtgagcgcgatcgcccaggccaaggcctcccaggaggggccgctccccgagatcgaggacgaggtgttccggaagcgcaacctgaccatcatggacctgcaccccggcagcgggaagacccggcgctacctcccggcgatcgtccgggaggccatcaagcgcaagctgcgcaccctgatcctcgcccccacgcgggtggtggcctccgagatggccgaggcgctgaagggcatgcccatccgctaccagaccaccgccgtcaagagcgagcacaccggcaaggagatcgtggacctgatgtgccacgccacgttcaccatgcggctcctgtcccccgtgcgcgtcccgaactacaacatgatcatcatggacgaggcccacttcaccgaccccagctccatcgccgcgcgggggtacatcagcacccgcgtgggcatgggggaggccgccgccatcttcatgacggccacgccgcccggctccgtggaggcgttcccgcagagcaacgccatcatccaggacgaggagcgggacatccccgagcgctcctggaacagcgggtacgagtggatcaccgacttccccggcaagaccgtctggttcgtgccctccatcaagagcggcaacgacatcgccaactgcctgcggaagaacgggaagcgcgtgatccagctctcccggaagacgttcgacaccgagtaccagaagaccaagaacaacgactgggactacgtcgtgaccacggacatcagcgagatgggcgccaacttccgcgcggaccgggtgatcgacccgcgccggtgcctgaagcccgtcatcctgaaggacgggcccgagcgcgtgatcctcgccggccccatgccggtgaccgtcgcctccgccgcccagcggcgcgggcggatcggccgcaaccacaacaaggagggcgaccagtacatctacatggggcagcccctgaacaacgacgaggaccacgcgcactggaccgaggccaagatgctgctcgacaacatcaacacccccgagggcatcatccccgccctgttcgagccggagcgcgagaagtccgccgccatcgacggggagtaccggctgcgcggcgaggcgcggaagacgttcgtggagctcatgcgccgcggggacctgcccgtctggctgtcctacaaggtggccagcgagggcttccagtacagcgaccgccggtggtgcttcgacggcgagcgcaacaaccaggtgctcgaggagaacatggacgtcgagatctggaccaaggagggggagcggaagaagctgcgcccccggtggctggacgcccgcacctactccgaccccctcgccctgcgggagttcaaggagttcgccgcgggccgccggagcgtgtccggggacctgatcctcgagatcggcaagctgccgcagcacctgacccagcgcgcccagaacgccctcgacaacctggtgatgctgcacaacagcgagcagggcgggcgggcctaccgccacgcgatggaggagctccccgacacgatcgagaccctgatgctgctcgccctgatcgccgtcctgaccggcggggtgaccctcttcttcctgtccggccgggggctgggcaagaccagcatcggcctcctgtgcgtgatggcctccagcgtcctgctctggatggcctccgtggagccccactggatcgcggccagcatcatcctggagttcttcctgatggtgctcctgatccccgagccggaccgccagcggacgccccaggacaaccagctggcctacgtcgtgatcgggctcctgttcatgatcctgaccgtggccgccaacgagatgggcctcctggagaccaccaagaaggacctggggatcggccacgtcgcggtggagaaccaccaccacgccgccatgctcgacgtggacctgcaccccgcctccgcctggacgctgtacgcggtcgccaccaccatcatcaccccgatgatgcgccacacgatcgagaacaccaccgccaacatcagcctcaccgccatcgccaaccaggcggccatcctgatggggctggacaagggctggcccatctccaagatggacatcggcgtgcccctcctggccctggggtgctacagccaggtgaaccccctcacgctgaccgccgcggtcctgatgctcgtggcccactacgccatcatcggcccggggctgcaggccaaggccacccgcgaggcgcagaagcggaccgccgccggcatcatgaagaaccccacggtggacgggatcgtcgccatcgacctggaccccgtggtgtacgacgccaagttcgagaagcagctcggccagatcatgctgctgatcctctgcacctcccagatcctgctgatgcgcaccacctgggcgctctgcgagagcatcacgctggccaccggccccctgaccaccctctgggaggggtccccgggcaagttctggaacacgaccatcgccgtcagcatggccaacatcttccgggggtcctacctggccggcgcgggcctggccttcagcctcatgaagtccctcgggggcgggcgccgggggaccggggcccagggcgagaccctgggcgagaagtggaagcgccagctcaaccagctgtccaagagcgagttcaacacgtacaagcggtccgggatcatggaggtggaccgcagcgaggccaaggagggcctgaagcgcggggagaccaccaagcacgcggtgtcccgcggcaccgccaagctccggtggttcgtcgagcgcaacctggtgaagcccgaggggaaggtgatcgacctgggctgcggccgcgggggctggagctactactgcgccgggctgaagaaggtcacggaggtgaagggctacaccaagggcggccccggccacgaggagcccatcccgatggccacctacgggtggaacctcgtgaagctgcactccggcaaggacgtcttcttcatcccgcccgagaagtgcgacaccctgctctgcgacatcggggagagctcccccaacccgacgatcgaggagggccgcaccctgcgggtgctgaagatggtggagccctggctccgcgggaaccagttctgcatcaagatcctgaacccctacatgcccagcgtcgtggagaccctggagcagatgcagcggaagcacggcggcatgctcgtgcgcaacccgctgtcccggaacagcacccacgagatgtactgggtctcctgcgggaccggcaacatcgtgagcgccgtgaacatgacgtcccgcatgctgctcaaccgcttcaccatggcgcaccggaagcccacctacgagcgcgacgtcgacctgggggccggcacccggcacgtggccgtggagcccgaggtcgccaacctggacatcatcggccagcgcatcgagaacatcaagcacgagcacaagagcacgtggcactacgacgaggacaacccctacaagacctgggcctaccacgggtcctacgaggtgaagccgagcggctccgcgagcagcatggtgaacggggtcgtgaagctcctgaccaagccctgggacgtcatccccatggtgacccagatcgccatgacggacaccacccccttcggccagcagcgggtgttcaaggagaaggtcgacacccgcacgccgaaggccaagcgggggaccgcccagatcatggaggtgaccgccaagtggctgtggggcttcctctcccgcaacaagaagccccggatctgcacccgcgaggagttcacgcggaaggtgcgcagcaacgcggccatcggcgccgtcttcgtggacgagaaccagtggaactccgccaaggaggcggtggaggacgagcggttctgggacctggtccaccgcgagcgggagctgcacaagcaggggaagtgcgcgacctgcgtgtacaacatgatgggcaagcgcgagaagaagctcggggagttcggcaaggccaaggggagccgggccatctggtacatgtggctgggcgcccgcttcctggagttcgaggcgctcggcttcatgaacgaggaccactggttctcccgggagaacagcctgtccggggtggagggcgaggggctgcacaagctcggctacatcctgcgcgacatcagcaagatccccgggggcaacatgtacgccgacgacaccgccggctgggacacccggatcacggaggacgacctgcagaacgaggcccgcatcaccgacatcatggagccggagcacgccctcctggcgaagtccatcttcaagctgacctaccagaacaaggtcgtgcgcgtgcagcggcccgccaagaacgggaccgtcatggacgtgatcagccgccgggaccagcgcggctccggccaggtggggacgtacggcctcaacaccttcaccaacatggaggcccagctgatccggcagatggagagcgaggggatcttctcccccagcgagctggagacccccaacctcgccgagcgcgtcctggactggctggagaagtacggcgtggagcggctcaagcgcatggccatctccggggacgactgcgtggtcaagccgatcgacgaccggttcgcgacggccctgaccgccctgaacgacatgggcaaggtgcgcaaggacatcccccagtgggagcccagcaaggggtggaacgactggcagcaggtccccttctgctcccaccacttccaccagctcatcatgaaggacggccgggagatcgtcgtgccgtgccgcaaccaggacgagctggtgggccgggcccgcgtcagccagggggccggctggagcctgcgggagaccgcgtgcctcgggaagtcctacgcccagatgtggcagctgatgtacttccaccgccgggacctgcgcctcgccgccaacgcgatctgcagcgccgtgcccgtggactggatccccacctcccggacgacctggagcatccacgcccaccaccagtggatgaccaccgaggacatgctgtccgtctggaaccgcgtgtggatcgaggagaacccctggatggaggacaagacgcacatcagctcctggggcgacgtgccgtacctggggaagcgcgaggaccagtggtgcggcagcctcatcggcctgaccgcccgggccacctgggcgaccaacatccaggtcgccatcaaccaggtgcgccggctgatcgggaacgagaactacctcgactacatgacctccatgaagcgcttcaagaacgagggcgaccccgagggggccctgtggtga

SEQ ID NO: 8328 - RNA, 9879 nt, synthetic construct
  misc_feature 1..9879: note = derived and/or modified CDS sequence (opt1) from DENV-1__FJ410287__SS-prME
  source 1..9879: mol_type = other RNA
agcgtgaccatgctgctgatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtcacctacgggacctgcagccagacgggcgagcaccggcgcgacaagcggagcgtggccctcgcgccccacgtgggcctggggctggagacccggaccgagacctggatgagctccgagggcgcctggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgccccacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgagccaggcgcccaccaccgagatccagctcaccgactacggggccctgacgctggactgcagcccccggaccggcctcgacttcaacgagatggtcctgctgaccatgaaggagaagtcctggctcgtgcacaagcagtggttcctggacctgcccctcccgtggaccagcggggcctccacgagccaggagacctggaaccggcaggacctgctggtgaccttcaagaccgcccacgccaagaagcaggaggtcgtggtgctcggctcccaggagggcgcgatgcacacggccctgaccggggccaccgagatccagaccagcggcacgaccaccatcttcgccgggcacctgaagtgccgcctcaagatggacaagctgaccctgaagggcatgtcctacgtcatgtgcacggggagcttcaagctcgagaaggaggtggccgagacccagcacggcaccgtgctggtccagatcaagtacgagggcaccgacgcgccctgcaagatccccttcctgacgcaggacgagaagggggtgacccagaacggccggctgatcaccgccaaccccatcgtgaccgacaaggagaagccggtcaacatcgaggccgagccgcccttcggggagtcctacatcatcatcggcgccggcgagaaggcgctcaagctgagctggttcaagaaggggtccagcatcggcaagatgttcgaggccacggcccgcggggcccggcgcatggccatcctgggcgacaccgcgtgggacttcgggtccatcggcggcgtgttcaccagcgtggggaagctcgtccaccagatcttcggcaccgcctacggggtgctgttctccggcgtgagctggacgatgaagatcgggatcggcgtcctgctcacctggctgggcctgaactcccgcagcacctccctcagcatgacctgcatcgccgtggggctggtgacgctgtacctcggcgtcatggtgcaggccgactccgggtgcgtgatcaactggaagggccgggagctgaagtgcgggagcggcatcttcgtcaccaacgaggtgcacacctggaccgagcagtacaagttccaggccgacagccccaagcgcctgtccgcggccatcggcaaggcctgggaggagggggtgtgcggcatccggagcgccacccgcctcgagaacatcatgtggaagcagatctccaacgagctgaaccacatcctgctcgagaacgacatgaagttcacggtcgtggtgggggacgtcgccggcatcctggcgcaggggaagaagatgatccggccgcagcccatggagtacaagtacagctggaagtcctggggcaaggccaagatcatcggcgccgacgtgcagaacaccaccttcatcatcgacgggcccaacacccccgagtgcccggacgaccagcgcgcctggaacatctgggaggtggaggactacggcttcgggatcttcacgaccaacatctggctgaagctccgggacagctacacccaggtctgcgaccaccgcctgatgtccgcggccatcaaggacagcaaggccgtgcacgccgacatgggctactggatcgagtccgagaagaacgagacctggaagctggcccgggcgagcttcatcgaggtgaagacgtgcatctggcccaagtcccacaccctctggagcaacggcgtcctggagtccgagatgatcatccccaagatctacgggggccccatcagccagcacaactaccgcccggggtacttcacccagaccgccggcccctggcacctggggaagctcgagctggacttcgacctgtgcgagggcacgaccgtggtggtcgacgagcactgcggcaaccgggggccctccctccgcaccaccacggtgaccggcaagatcatccacgagtggtgctgccggagctgcaccctgccgcccctgcgcttccgcggggaggacggctgctggtacgggatggagatccgccccgtgaaggagaaggaggagaacctcgtcaagtccatggtgagcgccggcagcggcgaggtggactccttcagcctggggctgctctgcatctccatcatcatcgaggaggtcatgcggagccgctggtcccggaagatgctgatgaccggcacgctggccgtgttcttcctcctgatcatggggcagctgacctggaacgacctcatccgcctgtgcatcatggtgggcgccaacgcgagcgaccgcatggggatgggcaccacctacctggccctcatggccacgttcaagatgcggcccatgttcgccgtcggcctgctgttccgccggctcacctcccgcgaggtgctgctgctcaccatcgggctgagcctggtggcctccgtcgagctcccgaacagcctggaggagctgggcgacgggctcgcgatgggcatcatgatcctgaagctgctcaccgacttccagtcccaccagctgtgggccacgctgctcagcctgaccttcatcaagaccaccttctccctgcactacgcctggaagacgatggccatggtgctcagcatcgtctccctgttccccctgtgcctcagcaccacctcccagaagaccacgtggctgcccgtgctgctcggcagcctggggtgcaagcccctgaccatgttcctcatcgcggagaacaagatctggggccggcgctcctggccgctgaacgaggggatcatggccgtgggcatcgtcagcatcctgctcagctccctgctgaagaacgacgtgcccctcgccgggcccctgatcgccggcggcatgctgatcgcctgctacgtgatcagcgggtccagcgcggacctctccctggagaaggccgccgaggtcagctgggaggaggaggccgagcactccggcgccagccacaacatcctggtggaggtgcaggacgacgggaccatgaagatcaaggacgaggagcgggacgacaccctcaccatcctgctgaaggcgacgctcctggccgtctccggcgtgtaccccctgagcatcccggccaccctcttcgtgtggtacttctggcagaagaagaagcagcgctccggggtcctgtgggacaccccctccccgcccgaggtggagcgggccgtgctggacgacggcatctaccgcatcatgcagcggggcctgctcgggcgctcccaggtcggcgtgggggtgttccaggagaacgtcttccacaccatgtggcacgtgacgcggggcgccgtgctgatgtaccaggggaagcgcctggagccgagctgggcgtccgtcaagaaggacctcatcagctacggcggcgggtggcggctgcagggctcctggaacaccggggaggaggtccaggtgatcgccgtcgagcccggcaagaaccccaagaacgtgcagaccgcccccgggaccttcaagacgccggagggcgaggtgggcgccatcgccctggacttcaagcccgggaccagcggctcccccatcgtcaaccgcgaggggaagatcgtgggcctctacggcaacggggtggtcaccaccagcggcacgtacgtgagcgcgatcgcccaggccaaggcctcccaggaggggcccctgccggagatcgaggacgaggtgttccggaagcgcaacctgaccatcatggacctccaccccggcagcgggaagacccggcgctacctgcccgcgatcgtccgggaggccatcaagcgcaagctgcgcaccctcatcctggccccgacgcgggtggtggcctccgagatggccgaggcgctgaagggcatgcccatccgctaccagaccaccgccgtcaagagcgagcacaccggcaaggagatcgtggacctcatgtgccacgccacgttcaccatgcggctgctgtcccccgtgcgcgtccccaactacaacatgatcatcatggacgaggcccacttcaccgacccgagctccatcgccgcgcgggggtacatcagcacccgcgtgggcatgggggaggccgccgccatcttcatgacggccacgccgcccggctccgtggaggcgttcccccagagcaacgccgtcatccaggacgaggagcgggacatcccggagcgctcctggaacagcgggtacgagtggatcaccgacttccccggcaagaccgtgtggttcgtgccctccatcaagagcggcaacgacatcgccaactgcctccggaagaacgggaagcgcgtcatccagctgtcccggaagacgttcgacaccgagtaccagaagaccaagaacaacgactgggactacgtggtgaccacggacatcagcgagatgggcgccaacttccgcgcggaccgggtcatcgacccccgccggtgcctgaagccggtgatcctcaaggacgggcccgagcgcgtgatcctggccggccccatgcccgtcaccgtggcctccgccgcccagcggcgcgggcggatcggccgcaaccacaacaaggagggcgaccagtacatctacatggggcagccgctgaacaacgacgaggaccacgcgcactggaccgaggccaagatgctcctggacaacatcaacacccccgagggcatcatccccgccctgttcgagcccgagcgcgagaagtccgccgccatcgacggggagtaccggctccgcggcgaggcgcggaagacgttcgtcgagctgatgcgccgcggggacctgccggtgtggctctcctacaaggtggccagcgagggcttccagtacagcgaccgccggtggtgcttcgacggcgagcgcaacaaccaggtcctggaggagaacatggacgtggagatctggaccaaggagggggagcggaagaagctgcgcccccggtggctcgacgcccgcacctactccgaccccctggccctgcgggagttcaaggagttcgccgcgggccgccggagcgtgtccggggacctcatcctggagatcggcaagctgccccagcacctcacccagcgcgcccagaacgccctggacaacctggtcatgctccacaacagcgagcagggcgggcgggcctaccgccacgcgatggaggagctgccggacacgatcgagaccctgatgctcctggccctgatcgccgtgctcaccggcggggtgaccctgttcttcctgtccggccgggggctcggcaagaccagcatcggcctgctgtgcgtcatggcctccagcgtgctcctgtggatggcctccgtggagccccactggatcgcggccagcatcatcctggagttcttcctcatggtcctgctgatccccgagcccgaccgccagcggacgccgcaggacaaccagctcgcctacgtggtgatcgggctgctgttcatgatcctcaccgtcgccgccaacgagatgggcctgctggagaccaccaagaaggacctcgggatcggccacgtggcggtggagaaccaccaccacgccgccatgctggacgtcgacctgcaccccgcctccgcctggacgctctacgcggtggccaccaccatcatcacccccatgatgcgccacacgatcgagaacaccaccgccaacatcagcctgaccgccatcgccaaccaggcggccatcctgatggggctcgacaagggctggccgatctccaagatggacatcggcgtgcccctgctggccctcgggtgctacagccaggtcaaccccctgacgctgaccgccgcggtgctcatgctggtggcccactacgccatcatcggccccgggctgcaggccaaggccacccgcgaggcgcagaagcggaccgccgccggcatcatgaagaacccgacggtcgacgggatcgtggccatcgacctcgaccccgtggtctacgacgccaagttcgagaagcagctgggccagatcatgctgctcatcctgtgcacctcccagatcctgctcatgcgcaccacctgggcgctgtgcgagagcatcacgctggccaccggccccctcaccaccctgtgggaggggtcccccggcaagttctggaacacgaccatcgccgtgagcatggccaacatcttccgggggtcctacctggccggcgcgggcctcgccttcagcctgatgaagtccctcgggggcgggcgccgggggaccggggcccagggcgagaccctcggcgagaagtggaagcgccagctgaaccagctgtccaagagcgagttcaacacgtacaagcggtccgggatcatggaggtggaccgcagcgaggccaaggagggcctcaagcgcggggagaccaccaagcacgcggtctcccgcggcaccgccaagctgcggtggttcgtggagcgcaacctggtgaagccggaggggaaggtcatcgacctgggctgcggccgcgggggctggagctactactgcgccgggctcaagaaggtgacggaggtgaagggctacaccaagggcggccccggccacgaggagcccatccccatggccacctacgggtggaacctggtcaagctgcactccggcaaggacgtgttcttcatcccgcccgagaagtgcgacaccctcctgtgcgacatcggggagagctcccccaaccccacgatcgaggagggccgcaccctgcgggtgctcaagatggtcgagccgtggctgcgcgggaaccagttctgcatcaagatcctgaacccctacatgcccagcgtggtggagaccctcgagcagatgcagcggaagcacggcggcatgctggtccgcaaccccctgtcccggaacagcacccacgagatgtactgggtgtcctgcgggaccggcaacatcgtgagcgccgtcaacatgacgtcccgcatgctcctgaaccgcttcaccatggcgcaccggaagccgacctacgagcgcgacgtggacctgggggccggcacccggcacgtggccgtcgagcccgaggtggccaacctcgacatcatcggccagcgcatcgagaacatcaagcacgagcacaagagcacgtggcactacgacgaggacaacccctacaagacctgggcctaccacgggtcctacgaggtgaagcccagcggctccgcgagcagcatggtcaacggggtggtcaagctgctgaccaagccgtgggacgtgatccccatggtgacccagatcgccatgacggacaccacccccttcggccagcagcgggtcttcaaggagaaggtggacacccgcacgcccaaggccaagcgggggaccgcccagatcatggaggtgaccgccaagtggctctggggcttcctgtcccgcaacaagaagccgcggatctgcacccgcgaggagttcacgcggaaggtccgcagcaacgcggccatcggcgccgtgttcgtggacgagaaccagtggaactccgccaaggaggcggtcgaggacgagcggttctgggacctggtgcaccgcgagcgggagctccacaagcaggggaagtgcgcgacctgcgtgtacaacatgatgggcaagcgcgagaagaagctgggggagttcggcaaggccaaggggagccgggccatctggtacatgtggctgggcgcccgcttcctcgagttcgaggcgctgggcttcatgaacgaggaccactggttctcccgggagaacagcctgtccggggtcgagggcgaggggctccacaagctgggctacatcctgcgcgacatcagcaagatccccgggggcaacatgtacgccgacgacaccgccggctgggacacccggatcacggaggacgacctccagaacgaggcccgcatcaccgacatcatggagcccgagcacgccctgctggcgaagtccatcttcaagctcacctaccagaacaaggtggtgcgcgtccagcggccggccaagaacgggaccgtgatggacgtgatcagccgccgggaccagcgcggctccgggcaggtcggcacgtacggcctgaacaccttcaccaacatggaggcccagctgatccggcagatggagagcgaggggatcttctcccccagcgagctcgagacccccaacctggccgagcgcgtgctggactggctcgagaagtacggcgtggagcggctgaagcgcatggccatctccggggacgactgcgtcgtgaagcccatcgacgaccggttcgcgacggccctgaccgccctcaacgacatgggcaaggtgcgcaaggacatcccgcagtgggagcccagcaaggggtggaacgactggcagcaggtccccttctgctcccaccacttccaccagctgatcatgaaggacggccgggagatcgtggtgccctgccgcaaccaggacgagctggtcggccgggcccgcgtgagccagggggccggctggagcctccgggagaccgcgtgcctggggaagtcctacgcccagatgtggcagctgatgtacttccaccgccgggacctccgcctggccgccaacgcgatctgcagcgccgtgccggtcgactggatccccacctcccggacgacctggagcatccacgcccaccaccagtggatgaccaccgaggacatgctgtccgtgtggaaccgcgtgtggatcgaggagaacccctggatggaggacaagacgcacatcagctcctggggcgacgtcccctacctcgggaagcgcgaggaccagtggtgcggcagcctgatcggcctgaccgcccgggccacctgggcgaccaacatccaggtggccatcaaccaggtgcgccggctcatcgggaacgagaactacctggactacatgacctccatgaagcgcttcaagaacgagggcgacccggagggggccctgtggtga

SEQ ID NO: 8329 - RNA, 9879 nt, synthetic construct
  misc_feature 1..9879: note = derived and/or modified CDS sequence (opt1) from DENV-1__FJ432719__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacacgatgacctacaagtgcccccggatcaccgagaccgagcccgacgacgtggactgctggtgcaacgccacggacacctgggtcacctacgggacctgcagccagacgggcgagcaccggcgggacaagcggtccgtggccctcgcgccccacgtgggcctggggctggagacccgcaccgagacctggatgagctccgagggcgcgtggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccgccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggagctggcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctcaagctgagctggttcaagaaggggtccagcatcggcaagatgttcgaggccaccgcccgcggggcccggcgcatggcgatcctgggcgacacggcctgggacttcgggtccatcggcggcgtgttcaccagcgtggggaagctcgtccaccagatcttcggcaccgcctacggggtgctgttctccggcgtgagctggaccatgaagatcgggatcggcgtcctgctcacgtggctgggcctgaactcccgcagcacctccctcagcatgacctgcatcgccgtggggctggtgaccctgtacctcggcgtcatggtgcaggccgactccgggtgcgtgatcaactggaagggccgggagctgaagtgcgggagcggcatcttcgtcacgaacgaggtgcacacctggaccgagcagtacaagttccaggcggacagcccgaagcgcctgtccgccgccatcggcaaggcctgggaggagggggtgtgcggcatccggagcgccacccgcctcgagaacatcatgtggaagcagatctccaacgagctgaaccacatcctgctcgagaacgacatgaagttcaccgtcgtggtgggggacgtcgcgggcatcctggcccaggggaagaagatgatccggccccagcccatggagtacaagtacagctggaagtcctggggcaaggccaagatcatcggcgccgacgtgcagaacacgaccttcatcatcgacgggcccaacaccccggagtgccccgacgaccagcgcgcgtggaacatctgggaggtggaggactacggcttcgggatcttcaccacgaacatctggctgaagctccgggacagctacacccaggtctgcgaccaccgcctgatgtccgccgccatcaaggacagcaaggccgtgcacgccgacatgggctactggatcgagtccgagaagaacgagacctggaagctggcgcgggccagcttcatcgaggtgaagacctgcatctggcccaagtcccacacgctctggagcaacggcgtcctggagtccgagatgatcatccccaagatctacgggggcccgatcagccagcacaactaccgccccgggtacttcacccagaccgccggcccctggcacctggggaagctcgagctggacttcgacctgtgcgagggcaccacggtggtggtcgacgagcactgcggcaaccgggggccgtccctccgcaccaccaccgtgacgggcaagatcatccacgagtggtgctgccggagctgcaccctgccgcccctgcgcttccgcggggaggacggctgctggtacgggatggagatccgccccgtgaaggagaaggaggagaacctcgtcaagtccatggtgagcgccggcagcggcgaggtggactccttcagcctggggctgctctgcatctccatcatgatcgaggaggtcatgcggagccgctggtcccggaagatgctgatgaccggcaccctggccgtgttcttcctcctgatcatggggcagctgacgtggaacgacctcatccgcctgtgcatcatggtgggcgcgaacgccagcgaccgcatggggatgggcaccacctacctggccctcatggccaccttcaagatgcggccgatgttcgccgtcggcctgctgttccgccggctcacgtcccgcgaggtgctgctgctcaccatcgggctgagcctggtggcgtccgtcgagctccccaacagcctggaggagctgggcgacgggctcgccatgggcatcatgatcctgaagctgctcaccgacttccagtcccaccagctgtgggccaccctgctcagcctgacgttcatcaagaccaccttctccctgcactacgcctggaagaccatggcgatggtgctcagcatcgtctccctgttccccctgtgcctcagcacgacctcccagaagaccacctggctgcccgtgctgctcggcagcctggggtgcaagccgctgacgatgttcctcatcgccgagaacaagatctggggccggcgctcctggcccctgaacgaggggatcatggccgtgggcatcgtcagcatcctgctcagctccctgctgaagaacgacgtgcccctcgccgggcccctgatcgccggcggcatgctgatcgcgtgctacgtgatcagcgggtccagcgccgacctctccctggagaaggccgccgaggtcagctgggaggaggaggccgagcactccggcgcgagccacaacatcctggtggaggtgcaggacgacgggaccatgaagatcaaggacgaggagcgggacgacaccctcaccatcctgctgaaggccaccctcctggccgtctccggcgtgtacccgctgagcatccccgccaccctgttcgtgtggtacttctggcagaagaagaagcagcgctccggggtcctgtgggacacccccagcccgcccgaggtggagcgggccgtgctggacgacggcatctaccgcatcatgcagcggggcctgctcgggcgctcccaggtcggcgtgggggtgttccaggagaacgtcttccacaccatgtggcacgtgacccggggcgcggtgctgatgtaccaggggaagcgcctggagcccagctgggcctccgtcaagaaggacctcatcagctacggcggcgggtggcggctgcagggctcctggaacacgggggaggaggtccaggtgatcgccgtcgagcccggcaagaaccccaagaacgtgcagaccgcccccgggaccttcaagacccccgagggcgaggtgggcgccatcgcgctggacttcaagcccgggacgagcggctcccccatcgtcaaccgcgaggggaagatcgtgggcctctacggcaacggggtggtcaccaccagcggcacctacgtgagcgccatcgcccaggccaaggcgtcccaggaggggccgctgcccgagatcgaggacgaggtgttccggaagcgcaacctgacgatcatggacctccaccccggcagcgggaagacccggcgctacctgccggccatcgtccgggaggccatcaagcgcaagctgcgcaccctcatcctggcccccacccgggtggtggcctccgagatggcggaggccctgaagggcatgcccatccgctaccagacgaccgccgtcaagagcgagcacaccggcaaggagatcgtggacctcatgtgccacgccaccttcacgatgcggctgctgtcccccgtgcgcgtcccgaactacaacatgatcatcatggacgaggcccacttcaccgaccccagctccatcgcggcccgggggtacatcagcacccgcgtgggcatgggggaggccgccgccatcttcatgaccgcgacgccgcccggctccgtggaggccttcccgcagagcaacgccgtcatccaggacgaggagcgggacatccccgagcgctcctggaacagcgggtacgagtggatcaccgacttccccggcaagaccgtgtggttcgtgccctccatcaagagcggcaacgacatcgccaactgcctccggaagaacgggaagcgcgtcatccagctgtcccggaagaccttcgacacggagtaccagaagaccaagaacaacgactgggactacgtggtgaccaccgacatcagcgagatgggcgcgaacttccgcgccgaccgggtcatcgacccgcgccggtgcctgaagcccgtgatcctcaaggacgggcccgagcgcgtgatcctggccggccccatgccggtcacggtggcctccgccgcgcagcggcgcgggcggatcggccgcaaccacaacaaggagggcgaccagtacatctacatggggcagcccctgaacaacgacgaggaccacgcccactggaccgaggccaagatgctcctggacaacatcaacacccccgagggcatcatccccgccctgttcgagccggagcgcgagaagtccgccgcgatcgacggggagtaccggctccgcggcgaggcccggaagaccttcgtcgagctgatgcgccgcggggacctgcccgtgtggctctcctacaaggtggccagcgagggcttccagtacagcgaccgccggtggtgcttcgacggcgagcgcaacaaccaggtcctggaggagaacatggacgtggagatctggacgaaggagggggagcggaagaagctgcgcccccggtggctcgacgcccgcacctactccgaccccctggccctgcgggagttcaaggagttcgcggccggccgccggagcgtgtccggggacctcatcctggagatcggcaagctgccgcagcacctcacccagcgcgcccagaacgccctggacaacctggtcatgctccacaacagcgagcagggcgggcgggcgtaccgccacgccatggaggagctgcccgacaccatcgagacgctgatgctcctggccctgatcgccgtgctcaccggcggggtgaccctgttcttcctgtccggccgggggctcggcaagaccagcatcggcctgctgtgcgtcatggcctccagcgtgctcctgtggatggcgtccgtggagccccactggatcgccgccagcatcatcctggagttcttcctcatggtcctgctgatccccgagccggaccgccagcggacgccccaggacaaccagctcgcctacgtggtgatcgggctgctgttcatgatcctcacggtcgccgcgaacgagatgggcctgctggagaccaccaagaaggacctcgggatcggccacgtggccgtggagaaccaccaccacgccgccatgctggacgtcgacctgcaccccgcctccgcgtggaccctctacgccgtggccacgaccatcatcaccccgatgatgcgccacaccatcgagaacacgaccgccaacatcagcctgaccgccatcgcgaaccaggccgccatcctgatggggctcgacaagggctggcccatctccaagatggacatcggcgtgcccctgctggccctcgggtgctacagccaggtcaaccccctgaccctgacggcggccgtgctcatgctggtggcccactacgccatcatcggcccggggctgcaggccaaggcgacccgcgaggcccagaagcggaccgccgccggcatcatgaagaaccccaccgtcgacgggatcgtggccatcgacctcgaccccgtggtctacgacgcgaagttcgagaagcagctgggccagatcatgctgctcatcctgtgcacgtcccagatcctgctcatgcgcaccacctgggccctgtgcgagagcatcaccctggccacgggccccctcaccaccctgtgggaggggtccccgggcaagttctggaacaccacgatcgccgtgagcatggccaacatcttccgggggtcctacctggcgggcgccggcctcgccttcagcctgatgaagtccctcgggggcgggcgccgggggaccggggcccagggcgagaccctcggcgagaagtggaagcgccagctgaaccagctgtccaagagcgagttcaacacctacaagcggtccgggatcatggaggtggaccgcagcgaggcgaaggagggcctcaagcgcggggagacgaccaagcacgccgtctcccgcggcaccgccaagctgcggtggttcgtggagcgcaacctggtgaagcccgaggggaaggtcatcgacctgggctgcggccgcgggggctggagctactactgcgccgggctcaagaaggtgaccgaggtgaagggctacacgaagggcggccccggccacgaggagcccatcccgatggccacctacgggtggaacctggtcaagctgcactccggcaaggacgtgttcttcatcccgcccgagaagtgcgacaccctcctgtgcgacatcggggagagctcccccaacccgaccatcgaggagggccgcacgctgcgggtgctcaagatggtcgagccctggctgcgcgggaaccagttctgcatcaagatcctgaacccctacatgcccagcgtggtggagaccctcgagcagatgcagcggaagcacggcggcatgctggtccgcaacccgctgtcccggaacagcacccacgagatgtactgggtgtcctgcgggaccggcaacatcgtgagcgcggtcaacatgacctcccgcatgctcctgaaccgcttcacgatggcccaccggaagcccacctacgagcgcgacgtggacctgggggccggcacccggcacgtggccgtcgagcccgaggtggccaacctcgacatcatcggccagcgcatcgagaacatcaagcacgagcacaagagcacctggcactacgacgaggacaacccctacaagacgtgggcgtaccacgggtcctacgaggtgaagccgagcggctccgccagcagcatggtcaacggggtggtcaagctgctgaccaagccctgggacgtgatccccatggtgacccagatcgccatgaccgacacgacccccttcggccagcagcgggtcttcaaggagaaggtggacacccgcaccccgaaggccaagcgggggacggcccagatcatggaggtgaccgcgaagtggctctggggcttcctgtcccgcaacaagaagccccggatctgcacccgcgaggagttcacccggaaggtccgcagcaacgccgccatcggcgccgtgttcgtggacgagaaccagtggaactccgcgaaggaggccgtcgaggacgagcggttctgggacctggtgcaccgcgagcgggagctccacaagcaggggaagtgcgccacgtgcgtgtacaacatgatgggcaagcgcgagaagaagctgggggagttcggcaaggccaaggggagccgggccatctggtacatgtggctgggcgcgcgcttcctcgagttcgaggccctgggcttcatgaacgaggaccactggttctcccgggagaacagcctgtccggggtcgagggcgaggggctccacaagctgggctacatcctgcgcgacatcagcaagatccccgggggcaacatgtacgccgacgacaccgccggctgggacacccggatcaccgaggacgacctccagaacgaggcccgcatcacggacatcatggagccggagcacgcgctgctggccaagtccatcttcaagctcacctaccagaacaaggtggtgcgcgtccagcggcccgccaagaacgggaccgtgatggacgtgatcagccgccgggaccagcgcggctccgggcaggtcggcacctacggcctgaacacgttcaccaacatggaggcccagctgatccggcagatggagagcgaggggatcttctcccccagcgagctcgagacccccaacctggccgagcgcgtgctggactggctcgagaagtacggcgtggagcggctgaagcgcatggcgatctccggggacgactgcgtcgtgaagccgatcgacgaccggttcgccaccgccctgacggccctcaacgacatgggcaaggtgcgcaaggacatcccccagtgggagcccagcaaggggtggaacgactggcagcaggtccccttctgctcccaccacttccaccagctgatcatgaaggacggccgggagatcgtggtgccgtgccgcaaccaggacgagctggtcggccgggcccgcgtgagccagggggcgggctggagcctccgggagaccgcctgcctggggaagtcctacgcccagatgtggcagctgatgtacttccaccgccgggacctccgcctggccgcgaacgccatctgcagcgccgtgcccgtcgactggatccccacctcccggaccacgtggagcatccacgcccaccaccagtggatgaccaccgaggacatgctgtccgtgtggaaccgcgtgtggatcgaggagaacccctggatggaggacaagacccacatcagctcctggggcgacgtcccgtacctcgggaagcgcgaggaccagtggtgcggcagcctgatcggcctgacggcccgggcgacctgggccaccaacatccaggtggccatcaaccaggtgcgccggctcatcgggaacgagaactacctggactacatgacctccatgaagcgcttcaagaacgagagcgaccccgagggcgccctgtggtga

SEQ ID NO: 8330 - RNA, 9879 nt, synthetic construct
  misc_feature 1..9879: note = derived and/or modified CDS sequence (opt1) from DENV-1__FJ182020__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagaccagcgccggggtgaacatgtgcaccctcatcgccatggacctgggcgagttctgcgaggacaccatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggaccagcggggcctccaccagccaggagacctggaaccggaaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctcgtccagatcaagtacgagggcaccgacgccccctgcaagatccccttctccacccaggacgagaagggggtgacccagaacggccggctgatcacggccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacaccgcctgggacttcgggagcatcggcggcgtgttcacgtccgtcgggaagctggtgcaccagatcttcggcaccgcctacggggtgctgttcagcggcgtctcctggaccatgaagatcgggatcggcgtgctcctgacctggctgggcctcaacagccgctccacgagcctgtccatgacctgcatcgccgtggggctggtcaccctctacctgggcgtgatggtgcaggccgacagcgggtgcgtcatcaactggaagggccgggagctgaagtgcgggagcggcatcttcgtgaccaacgaggtgcacacgtggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagttcaccgtggtggtcggggacgtggcgggcatcctggcccaggggaagaagatgatccggccccagcccatggagtacaagtactcctggaagtcctggggcaaggccaagatcatcggcgccgacgtgcagaacaccacgttcatcatcgacgggcccaacaccccggagtgccccgacgaccagcgcgcgtggaacatctgggaggtcgaggactacggcttcgggatcttcaccaccaacatctggctcaagctgcgggactcctacacccaggtgtgcgaccaccgcctgatgagcgccgccatcaaggactccaaggccgtgcacgccgacatgggctactggatcgagagcgagaagaacgagacctggaagctcgcgcgggcctccttcatcgaggtcaagacctgcatctggcccaagagccacaccctgtggtccaacggcgtgctggagagcgagatgatcatccccaagatctacgggggcccgatctcccagcacaactaccgccccgggtacttcacgcagaccgccggcccctggcacctcgggaagctggagctggacttcgacctctgcgagggcaccaccgtggtcgtggacgagcactgcggcaaccgggggccgagcctgcgcacgaccaccgtgaccggcaagatcatccacgagtggtgctgccggtcctgcacgctgccgcccctgcgcttcaagggggaggacggctgctggtacgggatggagatccggcccgtcaaggagaaggaggagaacctggtcaagagcatggtgagcgccggctccggcgaggtcgacagcttctccctggggctcctgtgcatcagcatcatgatcgaggaggtgatgcgctcccggtggagccgcaagatgctgatgaccggcaccctcgccgtgttcttcctgctgatcatggggcagctcacctggaacgacctgatccggctgtgcatcatggtcggcgcgaacgcctccgaccgcatggggatgggcacgacctacctcgccctgatggccaccttcaagatgcgcccgatgttcgccgtggggctcctgttccggcgcctgaccagccgggaggtgctgctcctgacgatcgggctgtccctcgtcgcgagcgtggagctgcccaactccctggaggagctcggcgacgggctggccatgggcatcatgatcctgaagctcctgaccgacttccagagccaccagctgtgggccaccctcctgtccctgaccttcatcaagacgaccttcagcctccactacgcctggaagaccatggcgatggtcctgtccatcgtgagcctgttccccctctgcctgtccaccacgagccagaagaccacctggctgcccgtgctcctgggctccctggggtgcaagccgctcaccatgttcctgatcgccgagaacaagatctggggccgcaagagctggcccctgaacgaggggatcatggccgtcggcatcgtgagcatcctcctgtccagcctgctcaagaacgacgtgcccctggccgggcccctgatcgccggcggcatgctcatcgcgtgctacgtcatctccgggagctccgccgacctgagcctggagaaggccgccgaggtgtcctgggaggaggaggccgagcacagcggcgcgtcccacaacatcctcgtggaggtccaggacgacgggacgatgaagatcaaggacgaggagcgggacgacaccctgaccatcctgctcaaggccaccctgctggccgtgagcggcgtgtacccgctctccatccccgccaccctgttcgtctggtacttctggcagaagaagaagcagcgcagcggggtgctgtgggacacgcccagcccgcccgaggtggagcgggccgtcctcgacgacggcatctaccgcatcatgcagcggggcctgctggggcgcagccaggtgggcgtgggggtcttccaggagaacgtgttccacaccatgtggcacgtgacccggggcgcggtcctgatgtaccaggggaagcgcctcgagccctcctgggccagcgtgaagaaggacctgatctcctacggcggcgggtggcggctgcagggcagctggaacaccggggaggaggtgcaggtcatcgccgtggagcccggcaagaaccccaagaacgtgcagacggcccccgggaccttcaagacctccgagggcgaggtcggcgccatcgcgctcgacttcaagcccgggaccagcggcagccccatcgtgaaccgcgaggggaagatcgtgggcctgtacggcaacggggtcgtgacgacctccggcacctacgtgagcgccatcgcccaggccaaggcgtcccaggaggggcccctgccggagatcgaggacgaggtcttccggaagcgcaacctcaccatcatggacctgcaccccggcagcgggaagacgcggcgctacctgcccgccatcgtgcgggaggccatcaagcgcaagctccggaccctgatcctggccccgacccgcgtggtcgcctccgagatggcggaggccctcaagggcatgcccatccgctaccagaccacggccgtcaagagcgagcacaccggcaaggagatcgtggacctgatgtgccacgccaccttcaccatgcggctgctctcccccgtccgcgtgcccaactacaacatgatcatcatggacgaggcccacttcacggacccgagctccatcgcggcccgggggtacatcagcacccgcgtgggcatgggggaggccgccgccatcttcatgaccgcgacgccgcccggctccgtcgaggccttcccccagagcaacgccgtgatccaggacgaggagcgggacatcccggagcgctcctggaacagcgggtacgagtggatcacggacttccccggcaagaccgtgtggttcgtcccctccatcaagagcggcaacgacatcgccaactgcctgcggaagaacgggaagcgcgtgatccagctgtcccggaagaccttcgacaccgagtaccagaagacgaagaacaacgactgggactacgtggtcaccaccgacatcagcgagatgggcgcgaacttccgcgccgaccgggtgatcgacccccgccggtgcctcaagccggtgatcctgaaggacgggcccgagcgcgtcatcctggccggccccatgcccgtgaccgtcgcctccgccgcgcagcggcgcgggcggatcggccgcaaccacaacaaggagggcgaccagtacatctacatggggcagccgctcaacaacgacgaggaccacgcccactggacggaggccaagatgctgctggacaacatcaacacccccgagggcatcatccccgccctcttcgagcccgagcgggagaagtccgccgcgatcgacggggagtaccgcctgcgcggcgaggcccggaagaccttcgtggagctgatgcgccgcggggacctcccggtgtggctgagctacaaggtcgcctccgagggcttccagtacagcgaccgccggtggtgcttcgacggcgagcgcaacaaccaggtgctggaggagaacatggacgtggagatctggaccaaggagggggagcggaagaagctccgcccccggtggctggacgcccgcacgtactccgaccccctggccctccgggagttcaaggagttcgcggccggccgccggagcgtctccggggacctgatcctggagatcggcaagctcccccagcacctgacccagcgcgcccagaacgccctggacaacctcgtgatgctgcacaacagcgagcagggcgggcgggcgtaccgccacgccatggaggagctgccggacaccatcgagaccctcatgctgctggccctcatcgccgtgctgacgggcggggtcaccctgttcttcctctccggccgggggctgggcaagaccagcatcggcctgctctgcgtgatggcctccagcgtgctgctgtggatggcgtccgtcgagccccactggatcgccgccagcatcatcctcgagttcttcctgatggtgctgctcatccccgagcccgaccgccagcggaccccgcaggacaaccagctggcctacgtggtcatcgggctcctcttcatgatcctgaccgtggccgcgaacgagatgggcctgctcgagacgaccaagaaggacctggggatcggccacgtggccgtcgagaaccaccaccacgccgccatgctggacgtggacctccaccccgcctccgcgtggaccctgtacgccgtggccaccacgatcatcacccccatgatgcgccacaccatcgagaacaccacggccaacatcagcctgaccgccatcgcgaaccaggccgccatcctcatggggctggacaagggctggccgatctccaagatggacatcggcgtccccctgctcgccctggggtgctacagccaggtgaaccccctgaccctcaccgcggccgtgctgatgctggtcgcccactacgccatcatcggccccgggctccaggccaaggcgacgcgggaggcccagaagcgcaccgccgccggcatcatgaagaacccgaccgtggacgggatcgtggccatcgacctggaccccgtcgtgtacgacgcgaagttcgagaagcagctgggccagatcatgctcctgatcctgtgcacctcccagatcctcctgatgcgcacgacctgggccctgtgcgagagcatcaccctcgccaccggccccctgacgaccctgtgggaggggtcccccggcaagttctggaacaccaccatcgccgtgagcatggccaacatcttccgggggagctacctcgcgggcgccggcctggccttctccctgatgaagtccctcgggggcgggcgccggggcacgggggcccagggcgagaccctgggcgagaagtggaagcgccagctgaaccagctctccaagagcgagttcaacacctacaagcggtccgggatcatggaggtcgaccgcagcgaggcgaaggagggcctgaagcgcggggagaccacgaagcacgccgtgtcccgcggcaccgccaagctgcggtggttcgtggagcgcaacctcgtcaagccggaggggaaggtgatcgacctgggctgcggccgcggcgggtggagctactactgcgccgggctgaagaaggtgaccgaggtcaaggggtacaccaagggcgggcccggccacgaggagcccatccccatggccacgtacgggtggaacctggtgaagctccactccggcaaggacgtgttcttcatcccgcccgagaagtgcgacaccctgctgtgcgacatcggggagagctcccccaaccccaccatcgaggagggccgcaccctccgggtcctgaagatggtggagccgtggctgcgcgggaaccagttctgcatcaagatcctcaacccctacatgcccagcgtggtcgagacgctggagcagatgcagcggaagcacggcggcatgctggtgcgcaaccccctctcccggaacagcacccacgagatgtactgggtgtcctgcgggaccggcaacatcgtcagcgcggtgaacatgacctcccgcatgctgctgaaccggttcaccatggcccaccgcaagccgacgtacgagcgcgacgtggacctcggggccggcacccggcacgtcgccgtggagcccgaggtggccaacctggacatcatcggccagcgcatcgagaacatcaagcacgagcacaagagcacctggcactacgacgaggacaacccctacaagacctgggcgtaccacgggtcctacgaggtcaagcccagcggcagcgcctccagcatggtgaacggggtcgtgaagctgctcacgaagccgtgggacgtgatccccatggtcacccagatcgccatgaccgacaccacgcccttcggccagcagcgggtgttcaaggagaaggtggacacccgcacccccaaggccaagcgggggaccgcccagatcatggaggtcacggcgaagtggctgtggggcttcctgtcccgcaacaagaagccgcggatctgcacccgcgaggagttcacccggaaggtgcgcagcaacgccgccatcggcgccgtgttcgtcgacgagaaccagtggaactccgcgaaggaggccgtggaggacgagcggttctgggacctcgtgcaccgcgagcgggagctgcacaagcaggggaagtgcgcgacctgcgtctacaacatgatgggcaagcgcgagaagaagctgggggagttcggcaaggccaaggggagccgggccatctggtacatgtggctcggcgcgcgcttcctggagttcgaggccctgggcttcatgaacgaggaccactggttctcccgggagaacagcctctccggggtggagggcgaggggctgcacaagctgggctacatcctccgcgacatcagcaagatccccgggggcaacatgtacgccgacgacacggccggctgggacacccggatcaccgaggacgacctgcagaacgaggccaagatcaccgacatcatggagcccgagcacgcgctgctcgccaagtccatcttcaagctgacgtaccagaacaaggtggtccgcgtgcagcggccggccaagaacgggaccgtgatggacgtcatcagccgccgcgaccagcggggctccggccaggtgggcacctacggcctgaacaccttcacgaacatggaggcccagctcatccgccagatggagagcgaggggatcttctcccccagcgagctggagacccccaacctggccggccgggtgctcgactggctggagaagcacggggtcgagcgcctgaagcggatggcgatctccggcgacgactgcgtggtgaagcccatcgacgaccgcttcgccaccgccctcaccgccctgaacgacatggggaaggtccggaaggacatcccgcagtgggagcccagcaagggctggaacgactggcagcaggtccccttctgcagccaccacttccaccagctgatcatgaaggacggccgcgagatcgtggtcccctgccggaaccaggacgagctcgtggggcgcgcccgggtgtcccagggcgcggggtggagcctgcgcgagacggcctgcctgggcaagtcctacgcccagatgtggcagctcatgtacttccaccggcgcgacctgcggctggccgcgaacgccatctgcagcgccgtcccggtggactgggtgcccacctcccgcaccacctggagcatccacgcccaccaccagtggatgacgaccgaggacatgctctccgtctggaaccgggtgtggatcgaggagaacccctggatggaggacaagacccacatcagctcctggggcgacgtgccctacctgggcaagcgcgaggaccagtggtgcggcagcctgatcgggctcaccgcccgggcgacgtgggccaccaacatccaggtcgccatcaaccaggtgcgccgcctgatcggcaacgagaactacctggactacatgacctccatgaagcggttcaagaacgagagcgacccggagggggccctctggtga

SEQ ID NO: 8331 - RNA, 9879 nt, synthetic construct
  misc_feature 1..9879: note = derived and/or modified CDS sequence (opt1) from DENV-1__FJ182022__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgagaccgagcccgacgacgtggactgctggtgcaacgccacggacacctgggtgacctacgggacctgcagccagacgggcgagcaccggcgcgacaagcggtccgtggccctcgcgccccacgtgggcctggggctggagacccgcaccgagacctggatgagctccgagggcgcctggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgcggggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccgcctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccacggcccgcggggcccgccgcatggccatcctgggcgacaccgcgtgggacttcgggtccatcggcggcgtgttcaccagcgtcgggaagctggtgcaccagatcttcggcaccgcctacggggtgctgttctccggcgtcagctggacgatgaagatcgggatcggcgtgctgctgacctggctcggcctgaactcccggagcacctccctgagcatgacctgcatcgccgtggggctcgtcacgctgtacctgggcgtgatggtgcaggccgactccgggtgcgtcatcaactggaagggccgcgagctcaagtgcgggagcggcatcttcgtgaccaacgaggtgcacacctggaccgagcagtacaagttccaggccgacagcccgaagcggctgtccgcggccatcggcaaggcctgggaggagggggtctgcggcatccgcagcgccacccggctggagaacatcatgtggaagcagatctccaacgagctcaaccacatcctgctggagaacgacatgaagttcacggtggtggtcggggacgtggccggcatcctcgcgcaggggaagaagatgatccgcccccagcccatggagcacaagtacagctggaagtcctggggcaaggccaagatcatcggcgccgacgtgcagaacaccaccttcatcatcgacgggcccaacaccccggagtgccccgacgaccagcgggcctggaacatctgggaggtcgaggactacggcttcgggatcttcacgaccaacatctggctgaagctgcgcgacagctacacccaggtgtgcgaccaccggctcatgtccgcggccatcaaggacagcaaggccgtgcacgccgacatgggctactggatcgagtccgagaagaacgagacctggaagctggcccgcgcgagcttcatcgaggtcaagacgtgcatctggcccaagtcccacaccctgtggagcaacggcgtgctcgagtccgagatgatcatccccaagatctacgggggcccgatcagccagcacaactaccggcccgggtacttcacccagaccgccggcccctggcacctggggaagctggagctcgacttcgacctgtgcgagggcacgaccgtggtcgtggacgagcactgcggcaaccgcgggccgtccctgcggaccaccacggtgaccggcaagatcatccacgagtggtgctgccgcagctgcaccctgccgcccctccggttccgcggggaggacggctgctggtacgggatggagatccggcccgtcaaggagaaggaggagaacctggtgaagtccatggtgagcgccggcagcggcgaggtcgactccttcagcctcgggctgctgtgcatctccatcatgatcgaggaggtgatgcgcagccggtggtcccgcaagatgctcatgaccggcacgctggccgtgttcttcctgctcatcatggggcagctgacctggaacgacctgatccgcctctgcatcatggtcggcgccaacgcgagcgaccggatggggatgggcaccacctacctggccctgatggccacgttcaagatgcgcccgatgttcgccgtgggcctcctgttccggcgcctgacctcccgggaggtgctcctgctgaccatcgggctcagcctggtcgcctccgtggagctgcccaacagcctcgaggagctgggcgacgggctggcgatgggcatcatgatcctcaagctgctgaccgacttccagtcccaccagctctgggccacgctgctgagcctcaccttcatcaagaccaccttctccctgcactacgcctggaagacgatggccatggtcctgagcatcgtgtccctcttccccctgtgcctgagcaccacctcccagaagaccacgtggctccccgtgctgctgggcagcctcgggtgcaagccgctgaccatgttcctgatcgcggagaacaagatctggggccgccggtcctggcccctcaacgaggggatcatggccgtcggcatcgtgagcatcctgctgagctccctcctgaagaacgacgtgcccctggccgggcccctcatcgccggcggcatgctgatcgcctgctacgtcatcagcgggtccagcgcggacctgtccctcgagaaggccgccgaggtgagctgggaggaggaggccgagcactccggcgccagccacaacatcctggtggaggtccaggacgacgggaccatgaagatcaaggacgaggagcgcgacgacaccctgaccatcctcctgaaggcgacgctgctcgccgtgtccggcgtgtacccgctgagcatccccgccaccctgttcgtctggtacttctggcagaagaagaagcagcggtccggggtgctctgggacacccccagcccgcccgaggtggagcgcgccgtcctggacgacggcatctaccggatcatgcagcgcggcctgctggggcggtcccaggtgggcgtgggggtcttccaggagaacgtgttccacaccatgtggcacgtgacgcgcggcgccgtcctcatgtaccaggggaagcggctggagcccagctgggcgtccgtgaagaaggacctgatcagctacggcggcgggtggcgcctccagggctcctggaacaccggggaggaggtgcaggtcatcgccgtggagcccggcaagaaccccaagaacgtgcagaccgcccccgggaccttcaagacgcccgagggcgaggtcggcgccatcgccctggacttcaagcccgggaccagcggctcccccatcgtgaaccgggaggggaagatcgtgggcctgtacggcaacggggtcgtgaccaccagcggcacgtacgtgagcgcgatcgcccaggccaaggcctcccaggaggggccgctccccgagatcgaggacgaggtcttccgcaagcggaacctgaccatcatggacctgcaccccggcagcgggaagacccgccggtacctcccggcgatcgtgcgcgaggccatcaagcgcaagctgcggaccctgatcctcgcccccacgcgcgtggtcgcctccgagatggccgaggcgctgaagggcatgcccatccggtaccagaccaccgccgtcaagagcgagcacaccggcaaggagatcgtggacctgatgtgccacgccacgttcaccatgcgcctcctgtcccccgtccgggtgccgaactacaacatgatcatcatggacgaggcccacttcaccgaccccagctccatcgccgcgcgcgggtacatcagcacccgggtgggcatgggggaggccgccgccatcttcatgacggccacgccgcccggctccgtcgaggcgttcccgcagagcaacgccgtgatccaggacgaggagcgcgacatccccgagcggtcctggaacagcgggtacgagtggatcaccgacttccccggcaagaccgtgtggttcgtcccctccatcaagagcggcaacgacatcgccaactgcctgcgcaagaacgggaagcgggtgatccagctctcccgcaagacgttcgacaccgagtaccagaagaccaagaacaacgactgggactacgtggtcaccacggacatcagcgagatgggcgccaacttccgggcggaccgcgtgatcgacccgcggcgctgcctgaagcccgtgatcctgaaggacgggcccgagcgggtcatcctcgccggccccatgccggtgaccgtcgcctccgccgcccagcgccgggggcgcatcggccgcaaccacaacaaggagggcgaccagtacatctacatggggcagcccctgaacaacgacgaggaccacgcgcactggaccgaggccaagatgctgctcgacaacatcaacacccccgagggcatcatccccgccctgttcgagccggagcgggagaagtccgccgccatcgacggggagtaccgcctgcggggcgaggcgcgcaagacgttcgtggagctcatgcggcgcggggacctgcccgtgtggctgtcctacaaggtcgccagcgagggcttccagtacagcgaccggcgctggtgcttcgacggcgagcggaacaaccaggtgctcgaggagaacatggacgtggagatctggaccaaggagggggagcgcaagaagctgcggccccgctggctggacgcccggacctactccgaccccctcgccctgcgcgagttcaaggagttcgccgcgggccggcgcagcgtctccggggacctgatcctcgagatcggcaagctgccgcagcacctgacccagcgggcccagaacgccctcgacaacctggtgatgctgcacaacagcgagcagggcgggcgcgcctaccggcacgcgatggaggagctccccgacacgatcgagaccctgatgctgctcgccctgatcgccgtgctgaccggcggggtcaccctcttcttcctgtccggccgcgggctgggcaagaccagcatcggcctcctgtgcgtgatggcctccagcgtgctgctctggatggcctccgtcgagccccactggatcgcggccagcatcatcctggagttcttcctgatggtgctcctgatccccgagccggaccggcagcgcacgccccaggacaaccagctggcctacgtggtcatcgggctcctgttcatgatcctgaccgtggccgccaacgagatgggcctcctggagaccaccaagaaggacctggggatcggccacgtggcggtcgagaaccaccaccacgccgccatgctcgacgtggacctgcaccccgcctccgcctggacgctgtacgcggtggccaccaccatcatcaccccgatgatgcgccacacgatcgagaacaccaccgccaacatcagcctcaccgccatcgccaaccaggcggccatcctgatggggctggacaagggctggcccatctccaagatggacatcggcgtccccctcctggccctggggtgctacagccaggtgaaccccctcacgctgaccgccgcggtgctgatgctcgtcgcccactacgccatcatcggcccggggctgcaggccaaggccacccgggaggcgcagaagcgcaccgccgccggcatcatgaagaaccccacggtggacgggatcgtggccatcgacctggaccccgtcgtgtacgacgccaagttcgagaagcagctcggccagatcatgctgctgatcctctgcacctcccagatcctgctgatgcggaccacctgggcgctctgcgagagcatcacgctggccaccggccccctgaccaccctctgggaggggtccccgggcaagttctggaacacgaccatcgccgtgagcatggccaacatcttccgcgggtcctacctggccggcgcgggcctggccttcagcctcatgaagtccctcgggggcgggcggcgcgggaccggggcccagggcgagaccctgggcgagaagtggaagcggcagctcaaccagctgtccaagagcgagttcaacacgtacaagcgctccgggatcatggaggtcgaccggagcgaggccaaggagggcctgaagcgcggggagaccaccaagcacgcggtgtcccggggcaccgccaagctccgctggttcgtggagcggaacctggtcaagcccgaggggaaggtgatcgacctgggctgcggccgcgggggctggagctactactgcgccgggctgaagaaggtgacggaggtcaagggctacaccaagggcgggcccggccacgaggagcccatcccgatggccacctacgggtggaacctcgtgaagctgcactccggcaaggacgtgttcttcatcccgcccgagaagtgcgacaccctgctctgcgacatcggggagagctcccccaacccgacgatcgaggagggccggaccctgcgcgtcctgaagatggtggagccctggctccgggggaaccagttctgcatcaagatcctgaacccctacatgcccagcgtggtcgagaccctggagcagatgcagcgcaagcacggcggcatgctcgtgcggaacccgctgtcccgcaacagcacccacgagatgtactgggtgtcctgcgggaccggcaacatcgtcagcgccgtgaacatgacgtcccgcatgctgctcaaccggttcaccatggcgcaccgcaagcccacctacgagcgggacgtggacctgggggccggcacccgccacgtcgccgtggagcccgaggtggccaacctggacatcatcggccagcggatcgagaacatcaagcacgagcacaagagcacgtggcactacgacgaggacaacccctacaagacctgggcctaccacgggtcctacgaggtcaagccgagcggctccgcgagcagcatggtgaacggggtcgtgaagctcctgaccaagccctgggacgtgatccccatggtcacccagatcgccatgacggacaccacccccttcggccagcagcgcgtgttcaaggagaaggtggacacccggacgccgaaggccaagcgcgggaccgcccagatcatggaggtcaccgccaagtggctgtggggcttcctctcccggaacaagaagccccgcatctgcacccgggaggagttcacgcgcaaggtgcggagcaacgcggccatcggcgccgtgttcgtcgacgagaaccagtggaactccgccaaggaggcggtggaggacgagcgcttctgggacctggtgcaccgggagcgcgagctgcacaagcaggggaagtgcgcgacctgcgtctacaacatgatgggcaagcgggagaagaagctcggggagttcggcaaggccaaggggagccgcgccatctggtacatgtggctgggcgcccggttcctggagttcgaggcgctcggcttcatgaacgaggaccactggttctcccgcgagaacagcctgtccggggtggagggcgaggggctgcacaagctcggctacatcctgcgggacatcagcaagatccccgggggcaacatgtacgccgacgacaccgccggctgggacacccgcatcacggaggacgacctgcagaacgaggcccgcatcaccgacatcatggagccggagcacgccctcctggcgaagtccatcttcaagctgacctaccagaacaaggtggtccgggtgcagcgccccgccaagaacgggaccgtgatggacgtcatcagccggcgcgaccagcggggctccggccaggtgggcacgtacggcctcaacaccttcaccaacatggaggcccagctgatccgccagatggagagcgaggggatcttctcccccagcgagctggagacccccaacctcgccgagcgggtgctggactggctggagaagtacggcgtcgagcgcctcaagcggatggccatctccggggacgactgcgtggtgaagccgatcgacgaccgcttcgcgacggccctgaccgccctgaacgacatgggcaaggtccggaaggacatcccccagtgggagcccagcaaggggtggaacgactggcagcaggtccccttctgctcccaccacttccaccagctcatcatgaaggacggccgcgagatcgtggtcccgtgccggaaccaggacgagctggtgggccgcgcccgggtgagccagggggccggctggagcctgcgcgagaccgcgtgcctcgggaagtcctacgcccagatgtggcagctgatgtacttccaccggcgcgacctgcggctcgccgccaacgcgatctgcagcgccgtccccgtggactggatccccacctcccgcacgacctggagcatccacgcccaccaccagtggatgaccaccgaggacatgctgtccgtgtggaaccgcgtctggatcgaggagaacccctggatggaggacaagacgcacatcagctcctggggcgacgtgccgtacctggggaagcgggaggaccagtggtgcggcagcctcatcggcctgaccgcccgcgccacctgggcgaccaacatccaggtggccatcaaccaggtccggcgcctgatcgggaacgagaactacctcgactacatgacctccatgaagcggttcaagaacgagagcgaccccgagggcgccctgtggtga

SEQ ID NO: 8332 - RNA, 9879 nt, synthetic construct
  misc_feature 1..9879: note = derived and/or modified CDS sequence (opt1) from DENV-1__FJ024447__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgcgacaagcggtccgtggccctcgcgccccacgtgggcctggggctggagacccgcaccgagacctggatgagctccgagggcgcctggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtcgggaaggtggtgcaccagatcttcggcaccgcctacggggtcctgttctccggcgtgagctggacgatgaagatcgggatcggcgtgctcctgacctggctgggcctcaactcccgcagcacctccctgagcatgacctgcatcgccgtcgggctggtgacgctctacctgggcgtgatggtccaggccgactccgggtgcgtgatcaactggaagggccgggagctgaagtgcgggagcggcatcttcgtgaccaacgaggtccacacctggaccgagcagtacaagttccaggccgacagcccgaagcgcctctccgcggccatcggcaaggcctgggaggagggggtgtgcggcatccggagcgccacccgcctggagaacatcatgtggaagcagatctccaacgagctgaaccacatcctcctggagaacgacatgaagttcacggtggtcgtgggggacgtggccggcatcctggcgcaggggaagaagatgatccggccccagcccatggagtacaagtacagctggaagtcctggggcaaggccaagatcatcggcgccgacgtccagaacaccaccttcatcatcgacgggcccaacaccccggagtgccccgacgaccagcgcgcctggaacatctgggaggtggaggactacggcttcgggatcttcacgaccaacatctggctcaagctgcgggacagctacacccaggtgtgcgaccaccgcctgatgtccgcggccatcaaggacagcaaggccgtccacgccgacatgggctactggatcgagtccgagaagaacgagacctggaagctcgcccgggcgagcttcatcgaggtgaagacgtgcatctggcccaagtcccacaccctgtggagcaacggcgtgctggagtccgagatgatcatccccaagatctacgggggcccgatcagccagcacaactaccgccccgggtacttcacccagaccgccggcccctggcacctcgggaagctggagctggacttcgacctctgcgagggcacgaccgtcgtggtggacgagcactgcggcaaccgggggccgtccctgcgcaccaccacggtcaccggcaagatcatccacgagtggtgctgccggagctgcaccctgccgcccctgcgcttccgcggggaggacggctgctggtacgggatggagatccgccccgtgaaggagaaggaggagaacctggtgaagtccatggtcagcgccggcagcggcgaggtggactccttcagcctggggctcctgtgcatctccatcatgatcgaggaggtgatgcggagccgctggtcccggaagatgctgatgaccggcacgctcgccgtcttcttcctgctgatcatggggcagctcacctggaacgacctgatccgcctgtgcatcatggtgggcgccaacgcgagcgaccgcatggggatgggcaccacctacctcgccctgatggccacgttcaagatgcggccgatgttcgccgtggggctcctgttccgccggctgacctcccgcgaggtcctgctcctgaccatcgggctgagcctcgtggcctccgtcgagctgcccaacagcctggaggagctcggcgacgggctggcgatgggcatcatgatcctgaagctcctgaccgacttccagtcccaccagctgtgggccacgctcctgagcctgaccttcatcaagaccaccttctccctccactacgcctggaagacgatggccatggtgctgagcatcgtgtccctgttccccctctgcctgagcaccacctcccagaagaccacgtggctgcccgtcctcctgggcagcctggggtgcaagccgctcaccatgttcctgatcgcggagaacaagatctggggccggcgctcctggcccctgaacgaggggatcatggccgtgggcatcgtgagcatcctcctgagctccctgctcaagaacgacgtccccctggccgggcccctgatcgccggcggcatgctcatcgcctgctacgtgatcagcgggtccagcgcggacctgtccctggagaaggccgccgaggtgagctgggaggaggaggccgagcactccggcgccagccacaacatcctcgtcgaggtgcaggacgacgggaccatgaagatcaaggacgaggagcgggacgacaccctgaccatcctgctcaaggcgacgctgctggccgtgtccggcgtctacccgctcagcatccccgccaccctgttcgtgtggtacttctggcagaagaagaagcagcgctccggggtgctgtgggacacccccagcccgcccgaggtcggccgggccgtgctcgacgacggcatctaccgcatcatgcagcgggggctgctgggccgctcccaggtgggggtcggcgtgttccaggagaacgtgttccacaccatgtggcacgtcacgcgcggggccgtgctgatgtaccagggcaagcgcctcgagcccagctgggcgtccgtgaagaaggacctgatcagctacggcgggggctggcggctgcaggggtcctggaacaccggcgaggaggtccaggtgatcgccgtggagcccgggaagaaccccaagaacgtccagaccgcccccggcaccttcaagacgcccgagggcgaggtgggggccatcgccctcgacttcaagcccggcaccagcgggtcccccatcgtgaaccgcgagggcaagatcgtcggcctgtacgggaacggcgtggtgaccaccagcgggacgtacgtcagcgcgatcgcccaggccaaggcctcccaggagggcccgctgcccgagatcgaggacgaggtgttccggaagcgcaacctcaccatcatggacctgcaccccgggagcggcaagacccggcgctacctgccggcgatcgtgcgggaggccatcaagcgcaagctccgcaccctgatcctggcccccacgcgggtcgtggcctccgagatggccgaggcgctcaagggcatgcccatccgctaccagaccaccgccgtcaagagcgagcacaccgggaaggagatcgtcgacctgatgtgccacgccacgttcaccatgcggctgctctcccccgtgcgcgtgccgaactacaacatgatcatcatggacgaggcccacttcaccgaccccagctccatcgccgcgcggggctacatcagcacccgcgtcgggatgggcgaggccgccgccatcttcatgacggccacgccgcccgggtccgtggaggcgttcccgcagagcaacgccgtgatccaggacgaggagcgggacatccccgagcgctcctggaacagcggctacgagtggatcaccgacttccccggcaagaccgtctggttcgtgccctccatcaagagcgggaacgacatcgccaactgcctgcggaagaacggcaagcgcgtgatccagctgtcccggaagacgttcgacaccgagtaccagaagaccaagaacaacgactgggactacgtcgtgaccacggacatcagcgagatgggggccaacttccgcgcggaccgggtgatcgacccgcgccggtgcctcaagcccgtcatcctgaaggacggccccgagcgcgtgatcctggccgggcccatgccggtcaccgtggcctccgccgcccagcggcgcggccggatcggccgcaaccacaacaaggagggggaccagtacatctacatgggccagcccctcaacaacgacgaggaccacgcgcactggaccgaggccaagatgctgctggacaacatcaacacccccgaggggatcatccccgccctcttcgagccggagcgcgagaagtccgccgccatcgacggcgagtaccggctgcgcggggaggcgcggaagacgttcgtggagctgatgcgccggggcgacctccccgtctggctgtcctacaaggtggccagcgagggcttccagtacagcgaccgccggtggtgcttcgacggggagcgcaacaaccaggtgctggaggagaacatggacgtcgagatctggaccaaggagggcgagcggaagaagctccgcccccggtggctggacgcccgcacctactccgaccccctggccctccgggagttcaaggagttcgccgcggggcgccggagcgtgtccggcgacctgatcctggagatcggcaagctcccgcagcacctgacccagcgcgcccagaacgccctggacaacctcgtgatgctgcacaacagcgagcagggcgggcgggcctaccgccacgcgatggaggagctgcccgacacgatcgagaccctcatgctgctggccctcatcgccgtcctgaccgggggcgtgaccctgttcttcctctccgggcggggcctgggcaagaccagcatcgggctgctctgcgtgatggcctccagcgtcctgctgtggatggcctccgtggagccccactggatcgcggccagcatcatcctcgagttcttcctgatggtgctgctcatccccgagccggaccgccagcggacgccccaggacaaccagctggcctacgtcgtgatcggcctcctcttcatgatcctgaccgtggccgccaacgagatggggctgctcgagaccaccaagaaggacctgggcatcgggcacgtcgcggtggagaaccaccaccacgccgccatgctggacgtggacctccaccccgcctccgcctggacgctgtacgcggtcgccaccaccatcatcaccccgatgatgcgccacacgatcgagaacaccaccgccaacatcagcctgaccgccatcgccaaccaggcggccatcctcatgggcctggacaagggctggcccatctccaagatggacatcggggtgcccctgctcgccctgggctgctacagccaggtgaaccccctgacgctcaccgccgcggtcctgatgctggtggcccactacgccatcatcgggccgggcctccaggccaaggccacccgcgaggcgcagaagcggaccgccgccgggatcatgaagaaccccacggtggacggcatcgtcgccatcgacctggaccccgtggtgtacgacgccaagttcgagaagcagctgggccagatcatgctcctgatcctgtgcacctcccagatcctcctgatgcgcaccacctgggcgctgtgcgagagcatcacgctcgccaccgggcccctgaccaccctgtgggagggctccccggggaagttctggaacacgaccatcgccgtcagcatggccaacatcttccggggctcctacctcgccggcgcggggctggccttcagcctgatgaagtccctcggcgggggccgccgggggaccggcgcccagggcgagaccctgggggagaagtggaagcgccagctgaaccagctctccaagagcgagttcaacacgtacaagcggtccggcatcatggaggtggaccgcagcgaggccaaggaggggctgaagcggggcgagaccaccaagcacgcggtgtcccgcgggaccgccaagctgcggtggttcgtcgagcgcaacctcgtgaagcccgagggcaaggtgatcgacctgggctgcgggcggggcgggtggagctactactgcgccggcctgaagaaggtcacggaggtgaaggggtacaccaagggcggccccgggcacgaggagcccatcccgatggccacctacggctggaacctggtgaagctccactccgggaaggacgtcttcttcatcccgcccgagaagtgcgacaccctgctgtgcgacatcggcgagagctcccccaacccgacgatcgaggaggggcgcaccctccgggtgctgaagatggtggagccctggctgcgcggcaaccagttctgcatcaagatcctcaacccctacatgcccagcgtcgtggagaccctggagcagatgcagcggaagcacggcgggatgctggtgcgcaacccgctctcccggaacagcacccacgagatgtactgggtctcctgcggcaccgggaacatcgtgagcgccgtgaacatgacgtcccgcatgctgctgaaccgcttcaccatggcgcaccggaagcccacctacgagcgcgacgtcgacctcggcgccggcacccggcacgtggccgtggagcccgaggtcgccaacctggacatcatcgggcagcgcatcgagaacatcaagcacgagcacaagagcacgtggcactacgacgaggacaacccctacaagacctgggcctaccacggctcctacgaggtgaagccgagcgggtccgcgagcagcatggtcaacggcgtggtgaagctgctcaccaagccctgggacgtcatccccatggtgacccagatcgccatgacggacaccacccccttcgggcagcagcgggtgttcaaggagaaggtcgacacccgcacgccgaaggccaagcggggcaccgcccagatcatggaggtgaccgccaagtggctgtggggcttcctgtcccgcaacaagaagccccggatctgcacccgcgaggagttcacgcggaaggtgcgcagcaacgcggccatcggggccgtcttcgtggacgagaaccagtggaactccgccaaggaggcggtggaggacgagcggttctgggacctcgtccaccgcgagcgggagctgcacaagcagggcaagtgcgcgacctgcgtgtacaacatgatggggaagcgcgagaagaagctgggcgagttcgggaaggccaagggcagccgggccatctggtacatgtggctcggcgcccgcttcctggagttcgaggcgctggggttcatgaacgaggaccactggttctcccgggagaacagcctctccggcgtggagggggagggcctgcacaagctggggtacatcctccgcgacatcagcaacatccccggcggcaacatgtacgccgacgacaccgccgggtgggacacccggatcacggaggacgacctgcagaacgaggcccgcatcaccgacatcatggagccggagcacgccctgctcgcgaagtccatcttcaagctgacctaccagaacaaggtcgtgcgcgtgcagcggcccgccaagaacggcaccgtcatggacgtgatcagccgccgggaccagcgcgggtccggccaggtgggcacgtacgggctgaacaccttcaccaacatggaggcccagctcatccggcagatggagagcgagggcatcttctcccccagcgagctggagacccccaacctggccgagcgcgtcctcgactggctggagaagtacggggtggagcggctgaagcgcatggccatctccggcgacgactgcgtggtcaagccgatcgacgaccggttcgcgacggccctcaccgccctgaacgacatggggaaggtgcgcaaggacatcccccagtgggagcccagcaagggctggaacgactggcagcaggtccccttctgctcccaccacttccaccagctgatcatgaaggacggccgggagatcgtcgtgccgtgccgcaaccaggacgagctcgtggggcgggcccgcgtcagccagggcgccgggtggagcctgcgggagaccgcgtgcctgggcaagtcctacgcccagatgtggcagctcatgtacttccaccgccgggacctgcgcctggccgccaacgcgatctgcagcgccgtgcccgtggactggatccccacctcccggacgacctggagcatccacgcccaccaccagtggatgaccaccgaggacatgctctccgtctggaaccgcgtgtggatcgaggagaacccctggatggaggacaagacgcacatcagctcctggggcgacgtgccgtacctgggcaagcgcgaggaccagtggtgcggcagcctgatcgggctcaccgcccgggccacctgggcgaccaacatccaggtcgccatcaaccaggtgcgccggctgatcggcaacgagaactacctggactacatgacctccatgaagcgcttcaagaacgagagcgaccccgagggggccctctggtga

SEQ ID NO: 8333 - RNA, 9879 nt, synthetic construct
  misc_feature 1..9879: note = derived and/or modified CDS sequence (opt1) from DENV-1__FJ182025__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgcgacaagcggtccgtggccctcgcgccccacgtgggcctggggctggagacccgcaccgagacctggatgagctccgagggcgcctggaagcagatccagcgggtggagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtcgggaagctggtgcaccagatcttcggcaccgcctacggggtcctcttctccggcgtcagctggacgatgaagatcgggatcggcgtgctgctgacctggctcggcctgaactcccgcagcacctccctgagcatgacctgcatcgccgtggggctcgtcacgctgtacctgggcgtgatggtgcaggccgactccgggtgcgtcatcaactggaagggccgggagctcaagtgcgggagcggcatcttcgtgaccaacgaggtgcacacctggaccgagcagtacaagttccaggccgacagcccgaagcgcctgtccgcggccatcggcaaggcctgggaggagggggtctgcggcatccggagcgccacccgcctggagaacatcatgtggaagcagatctccaacgagctcaaccacatcctgctggagaacgacatgaagttcacggtggtggtcggggacgtggccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtcgaggactacggcttcgggatcttcacgaccaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacgtgcatctggcccaagtcccacaccctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcacgaccgtggtcgtggacgagcactgcggcaaccgggggccgtccctgcgcaccaccacggtgaccggcaagatcatccacgagtggtgctgccggagctgcaccctgccgcccctccgcttccgcggggaggacggctgctggtacgggatggagatccgccccgtcaaggagaaggaggagaacctggtgaagtccatggtgagcgccggcagcggcgaggtcgactccttcagcctcgggctgctgtgcatctccatcatgatcgaggaggtgatgcggagccgctggtcccggaagatgctcatgaccggcacgctggccgtgttcttcctgctcatcatggggcagctgacctggaacgacctgatccgcctctgcatcatggtcggcgccaacgcgagcgaccgcatggggatgggcaccacctacctggccctgatggccacgttcaagatgcggccgatgttcgccgtggggctcctgttccgccggctgacctcccgcgaggtgctcctgctgaccatcgggctcagcctggtcgcctccgtggagctgcccaacagcctcgaggagctgggcgacgggctggcgatgggcatcatgatcctcaagctgctgaccgacttccagtcccaccagctctgggccacgctgctgagcctcaccttcatcaagaccaccttctccctgcactacgcctggaagacgatggccatggtcctgagcatcgtgtccctcttccccctgtgcctgagcaccacctcccagaagaccacgtggctccccgtgctgctgggcagcctcgggtgcaagccgctgaccatgttcctgatcgcggagaacaagatctggggccggcgctcctggcccctcaacgaggggatcatggccgtcggcatcgtgagcatcctgctgagctccctcctgaagaacgacgtgcccctggccgggcccctcatcgccggcggcatgctgatcgcctgctacgtcatcagcgggtccagcgcggacctgtccctcgagaaggccgccgaggtgagctgggaggaggaggccgagcactccggcgccagccacaacatcctggtggaggtccaggacgacgggaccatgaagatcaaggacgaggagcgggacgacaccctgaccatcctcctgaaggcgacgctgctcgccgtgtccggcgtgtacccgctgagcatccccgccaccctgttcgtctggtacttctggcagaagaagaagcagcgctccggggtgctctgggacacccccagcccgcccgaggtgggccgggccgtcctggacgacggcatctaccgcatcatgcagcgggggctgctgggccgctcccaggtgggggtgggcgtcttccaggagaacgtgttccacaccatgtggcacgtgacgcgcggggccgtcctcatgtaccagggcaagcgcctggagcccagctgggcgtccgtgaagaaggacctgatcagctacggcgggggctggcggctccaggggtcctggaacaccggcgaggaggtgcaggtcatcgccgtggagcccgggaagaaccccaagaacgtgcagaccgcccccggcaccttcaagacgcccgagggcgaggtcggggccatcgccctggacttcaagcccggcaccagcgggtcccccatcgtgaaccgcgagggcaagatcgtgggcctgtacgggaacggcgtcgtgaccaccagcgggacgtacgtgagcgcgatcgcccaggccaaggcctcccaggagggcccgctccccgagatcgaggacgaggtcttccggaagcgcaacctgaccatcatggacctgcaccccgggagcggcaagacccggcgctacctcccggcgatcgtgcgggaggccatcaagcgcaagctgcgcaccctgatcctcgcccccacgcgggtggtcgcctccgagatggccgaggcgctgaagggcatgcccatccgctaccagaccaccgccgtcaagagcgagcacaccgggaaggagatcgtggacctgatgtgccacgccacgttcaccatgcggctcctgtcccccgtccgcgtgccgaactacaacatgatcatcatggacgaggcccacttcaccgaccccagctccatcgccgcgcggggctacatcagcacccgcgtggggatgggcgaggccgccgccatcttcatgacggccacgccgcccgggtccgtcgaggcgttcccgcagagcaacgccgtgatccaggacgaggagcgggacatccccgagcgctcctggaacagcggctacgagtggatcaccgacttccccggcaagaccgtgtggttcgtcccctccatcaagagcgggaacgacatcgccaactgcctgcggaagaacggcaagcgcgtgatccagctctcccggaagacgttcgacaccgagtaccagaagaccaagaacaacgactgggactacgtggtcaccacggacatcagcgagatgggggccaacttccgcgcggaccgggtgatcgacccgcgccggtgcctgaagcccgtgatcctgaaggacggccccgagcgcgtcatcctcgccgggcccatgccggtgaccgtcgcctccgccgcccagcggcgcggccggatcggccgcaaccacaacaaggagggggaccagtacatctacatgggccagcccctgaacaacgacgaggaccacgcgcactggaccgaggccaagatgctgctcgacaacatcaacacccccgaggggatcatccccgccctgttcgagccggagcgcgagaagtccgccgccatcgacggcgagtaccggctgcgcggggaggcgcggaagacgttcgtggagctcatgcgccggggcgacctgcccgtgtggctgtcctacaaggtcgccagcgagggcttccagtacagcgaccgccggtggtgcttcgacggggagcgcaacaaccaggtgctcgaggagaacatggacgtggagatctggaccaaggagggcgagcggaagaagctgcgcccccggtggctggacgcccgcacctactccgaccccctcgccctgcgggagttcaaggagttcgccgcggggcgccggagcgtctccggcgacctgatcctcgagatcggcaagctgccgcagcacctgacccagcgcgcccagaacgccctcgacaacctggtgatgctgcacaacagcgagcagggcgggcgggcctaccgccacgcgatggaggagctccccgacacgatcgagaccctgatgctgctcgccctgatcgccgtgctgaccgggggcgtcaccctcttcttcctgtccgggcggggcctgggcaagaccagcatcgggctcctgtgcgtgatcgcctccagcgtgctgctctggatggcctccgtcgagccccactggatcgcggccagcatcatcctggagttcttcctgatggtgctcctgatccccgagccggaccgccagcggacgccccaggacaaccagctggcctacgtggtcatcggcctcctgttcatgatcctgaccgtggccgccaacgagatggggctcctggagaccaccaagaaggacctgggcatcgggcacgtggcggtcgagaaccaccaccacgccgccatgctcgacgtggacctgcaccccgcctccgcctggacgctgtacgcggtggccaccaccatcatcaccccgatgatgcgccacacgatcgagaacaccaccgccaacatcagcctcaccgccatcgccaaccaggcggccatcctgatgggcctggacaagggctggcccatctccaagatggacatcggggtccccctcctggccctgggctgctacagccaggtgaaccccctcacgctgaccgccgcggtgctgatgctcgtcgcccactacgccatcatcgggccgggcctgcaggccaaggccacccgcgaggcgcagaagcggaccgccgccgggatcatgaagaaccccacggtggacggcatcgtggccatcgacctggaccccgtcgtgtacgacgccaagttcgagaagcagctcggccagatcatgctgctgatcctctgcacctcccagatcctgctgatgcgcaccacctgggcgctctgcgagagcatcacgctggccaccgggcccctgaccaccctctgggagggctccccggggaagttctggaacacgaccatcgccgtgagcatggccaacatcttccggggctcctacctggccggcgcggggctggccttcagcctcatgaagtccctgggcgggggccgccgggggaccggcgcccagggcgagaccctgggggagaagtggaagcgccagctcaaccagctgtccaagagcgagttcaacacgtacaagcggtccggcatcatggaggtcgaccgcagcgaggccaaggaggggctgaagcggggcgagaccaccaagcacgcggtgtcccgcgggaccgccaagctccggtggttcgtggagcgcaacctggtcaagcccgagggcaaggtgatcgacctgggctgcgggcggggcgggtggagctactactgcgccggcctgaagaaggtgacggaggtcaaggggtacaccaagggcggccccgggcacgaggagcccatcccgatggccacctacggctggaacctcgtgaagctgcactccgggaaggacgtgttcttcatcccgcccgagaagtgcgacaccctgctctgcgacatcggcgagagctcccccaacccgacgatcgaggaggggcgcaccctgcgggtcctgaagatggtggagccctggctccgcggcaaccagttctgcatcaagatcctgaacccctacatgcccagcgtggtcgagaccctggagcagatgcagcggaagcacggcgggatgctcgtgcgcaacccgctgtcccggaacagcacccacgagatgtactgggtgtcctgcggcaccgggaacatcgtcagcgccgtgaacatgacgtcccgcatgctgctcaaccgcttcaccatggcgcaccggaagcccacctacgagcgcgacgtggacctgggcgccggcacccggcacgtcgccgtggagcccgaggtggccaacctggacatcatcgggcagcgcatcgagaacatcaagcacgagcacaagagcacgtggcactacgacgaggacaacccctacaagacctgggcctaccacggctcctacgaggtcaagccgagcgggtccgcgagcagcatggtgaacggcgtcgtgaagctcctgaccaagccctgggacgtgatccccatggtcacccagatcgccatgacggacaccacccccttcgggcagcagcgggtgttcaaggagaaggtggacacccgcacgccgaaggccaagcggggcaccgcccagatcatggaggtcaccgccaagtggctgtggggcttcctctcccgcaacaagaagccccggatctgcacccgcgaggagttcacgcggaaggtgcgcagcaacgcggccatcggggccgtgttcgtcgacgagaaccagtggaactccgccaaggaggcggtggaggacgagcggttctgggacctggtgcaccgcgagcgggagctgcacaagcagggcaagtgcgcgacctgcgtctacaacatgatggggaagcgcgagaagaagctcggcgagttcgggaaggccaagggcagccgggccatctggtacatgtggctgggcgcccgcttcctggagttcgaggcgctcgggttcatgaacgaggaccactggttctcccgggagaacagcctgtccggcgtggagggggagggcctgcacaagctcgggtacatcctgcgcgacatcagcaacatccccggcggcaacatgtacgccgacgacaccgccgggtgggacacccggatcacggaggacgacctgcagaacgaggcccgcatcaccgacatcatggagccggagcacgccctcctggcgaagtccatcttcaagctgacctaccagaacaaggtggtccgcgtgcagcggcccaccaagaacggcacggtgatggacgtcatcagccgccgggaccagcgcgggtccggccaggtgggcacctacgggctcaacaccttcaccaacatggaggcccagctgatccggcagatggagagcgagggcatcttctcccccagcgagctggagacgcccaacctcgccgagcgcgtgctggactggctggagaagtacggggtcgagcggctcaagcgcatggccatctccggcgacgactgcgtggtgaagccggtcgacgaccggttcgccaccgcgctgaccgccctgaacgacatggggaaggtgcgcaaggacatcccccagtgggagcccagcaagggctggaacgactggcagcaggtccccttctgctcccaccacttccaccagctcatcatgaaggacggccgggagatcgtcgtgccgtgccgcaaccaggacgagctggtggggcgggcccgcgtcagccagggcgccgggtggagcctgcgggagaccgcctgcctcggcaagtcctacgcgcagatgtggcagctgatgtacttccaccgccgggacctgcgcctcgccgccaacgccatctgcagcgcggtgcccgtggactggatccccacgtcccggaccacctggagcatccacgcccaccaccagtggatgaccacggaggacatgctgtccgtctggaaccgcgtgtggatcgaggagaacccctggatggaggacaagacccacatcagctcctggggcgacgtgccgtacctgggcaagcgcgaggaccagtggtgcggcagcctcatcgggctgaccgcccgggccacctgggccaccaacatccaggtcgcgatcaaccaggtgcgccggctgatcggcaacgagaactacctcgactacatgacgtccatgaagcgcttcaagaacgagagcgaccccgagggggccctgtggtga

SEQ ID NO: 8334 - RNA, 9879 nt, synthetic construct
  misc_feature 1..9879: note = derived and/or modified CDS sequence (opt1) from DENV-1__FJ373297__SS-prME
  source 1..9879: mol_type = other RNA
tccgtgaccatgctgctcatgctgatgcccaccgccctggccttccacctcaccacccggggcggggagccccacatgatcgtgtccaagcaggagcggggcaagagcctgctgttcaagacctccgccggggtgaacatgtgcaccctcatcgccatggacctgggcgagctgtgcgaggacaccatgacctacaagtgcccccggatcaccgaggtggagcccgacgacgtggactgctggtgcaacaccaccgacacctgggtgacctacgggacctgcagccagacgggcgagcaccggcgcgacaagcggtccgtggccctcgcgccccacgtcggcctggggctggagacccgggccgagacctggatgagctccgagggcgcgtggaagcagatccagaaggtggagacctgggccctccggcaccccgggttcacggtgatcgccctgttcctggcccacgcgatcggcaccagcatcacccagaaggggatcatcttcatcctcctgatgctggtcaccccctccatggccatgcgctgcgtgggcatcggcagccgggacttcgtggaggggctctccggcgccacgtgggtcgacgtggtgctggagcacgggagctgcgtcaccaccatggccaaggacaagcccaccctggacatcgagctcctgaagacggaggtgaccaaccccgccgtgctgcgcaagctctgcatcgaggcgaagatctccaacaccaccacggacagccggtgcccgacccagggcgaggccaccctggtcgaggagcaggacgccaacttcgtgtgccgccggaccttcgtggaccgcggctgggggaacggctgcgggctgttcggcaaggggtccctcatcacgtgcgccaagttcaagtgcgtcaccaagctggagggcaagatcgtgcagtacgagaacctgaagtacagcgtgatcgtcaccgtgcacaccggcgaccagcaccaggtcgggaacgagtccacggagcacggcaccaccgccaccatcacgccccaggcgcccacgagcgagatccagctcaccgactacggggccctgaccctggactgcagcccccggaccggcctcgacttcaacgagatggtgctgctgacgatgaaggagaagtcctggctcgtgcacaagcagtggttcctggacctgcccctcccctggaccagcggggcctccaccagccaggagacctggaaccgccaggacctgctggtcacgttcaagaccgcccacgccaagaagcaggaggtggtggtcctcggctcccaggagggcgcgatgcacaccgccctgaccggggccacggagatccagaccagcggcaccaccacgatcttcgccgggcacctgaagtgccggctcaagatggacaagctgaccctgaagggcatgtcctacgtgatgtgcaccgggctgttcaagctggagaaggaggtggccgagacccagcacggcacggtcctggtgcagatcaagtacgagggcaccgacgcgccctgcaagatccccttcagcacccaggacgagaagggggtgacccagaacggccgcctgatcacggccaacccgatcgtcaccgacaaggagaagcccgtgaacatcgaggccgagccgcccttcggggagtcctacatcgtgatcggcgccggcgagaaggcgctcaagctgagctggttcaagaaggggtccagcatcggcaagatgttcgaggccaccgcccgcggggcccgccggatggccatcctgggcgacaccgcgtgggacttcgggtccatcggcggcgtcttcacgagcgtggggaagctcgtgcaccagatcttcggcaccgcctacggggtcctgttctccggcgtgagctggaccatgaagatcgggatcggcgtgctgctcacctggctgggcctgaactcccgcagcacgtccctcagcatgacctgcatcgccgtcgggctggtgaccctgtacctcggcgtgatggtccaggccgactccgggtgcgtgatcaactggaagggccgcgagctgaagtgcgggagcggcatcttcgtgaccaacgaggtccacacgtggaccgagcagtacaagttccaggccgacagcccgaagcggctgtccgcggccatcggcaaggcctgggaggagggggtgtgcggcatccgcagcgccacccggctcgagaacatcatgtggcgccagatctccaacgagctgaaccacatcctgctcgagaacgacatgaagttcaccgtggtcgtgggggacgtggtcggcatcctggcccaggggaagaagatgatccggccccagcccatggagcacaagtacagctggaagtcctggggcaaggcgaagatcatcggcgccgacgtgcagaacaccacgttcatcatcgacgggcccaacaccccggagtgccccgacgaccagcgcgcctggaacatctgggaggtggaggactacggcttcgggatcttcaccaccaacatctggctgaagctccgggacagctacacgcaggtctgcgaccaccgcctgatgtccgccgcgatcaaggacagcaaggccgtgcacgccgacatgggctactggatcgagtccgagaagaacgagacctggaagctggcccgggccagcttcatcgaggtgaagacctgcatctggcccaagtcccacaccctctggagcaacggcgtcctggagtccgagatgatcatccccaagatctacgggggcccgatcagccagcacaactaccgccccgggtacttcacgcagaccgcgggcccctggcacctggggaagctcgagctggacttcgacctgtgcgagggcaccaccgtggtggtcgacgagcactgcggcaaccgggggccgtccctccgcacgaccaccgtgaccggcaagatcatccacgagtggtgctgccggagctgcacgctgccgcccctgcgcttcaagggggaggacggctgctggtacgggatggagatccggcccgtgaaggagaaggaggagaacctcgtcaagtccatggtgagcgccggcagcggcgaggtggactccttcagcctggggctgctctgcatctccatcatgatcgaggaggtcatgcgcagccggtggtcccgcaagatgctgatgaccggcaccctggccgtgttcttcctcctgatcatggggcagctgacctggaacgacctcatccggagctgcatcatggtgggcgccaacgcctccgaccgcatggggatgggcacgacctacctggcgctgatggccaccttcaagatgcgcccgatgttcgccgtcggcctcctgttccggcgcctgaccagccgggaggtgctcctgctgacgatcgggctctccctggtcgccagcgtggagctgcccaactccctcgaggagctgggcgacgggctggccatgggcatcatgatcctcaagctgctgaccgacttccagagctaccagctctgggcgaccctgctgtccctcaccttcatcaagacgaccttcagcctgcactacgcctggaagaccatggccatggtgctgtccatcgtcagcctcctgcccctgtgcctctccaccacgagccagaagaccacctggctgcccgtgctgctcggctccctggggtgcaagccgctgaccatgttcctcatcgccgagaacaagatctggggccgcaagagctggcccctgaacgaggggatcatggcggtgggcatcgtcagcatcctgctctccagcctgctgaagaacgacgtgcccctcgccgggcccctgatcgccggcggcatgctgatcgcctgctacgtgatctccgggagctccgccgacctcagcctggagaaggcggccgaggtctcctgggaggaggaggccgagcacagcggcgcctcccacaacatcctggtggaggtgcaggacgacgggacgatgaagatcaaggacgaggagcgggacgacaccctcaccatcctgctgaaggccaccctcctggcggtcagcggcgtgtacccgctgtccatccccgccaccctcttcgtgtggtacttctggcagaagaagaagcagcgcagcggggtcctgtgggacacgcccagcccgcccgaggtggagcgggccgtgctggacgacggcatctaccgcatcatgcagcggggcctgctcgggcgcagccaggtcggcgtgggggtgttccaggagaacgtcttccacaccatgtggcacgtgacccggggcgccgtgctgatgtaccaggggaagcgcctggagccctcctgggccagcgtcaagaaggacctcatctcctacggcggcgggtggcggctgcagggcagctggaacaccggggaggaggtccaggtgatcgcggtcgagcccggcaagaaccccaagaacgtgcagacggcccccgggaccttcaagacccccgagggcgaggtgggcgccatcgccctggacttcaagcccgggacctccggcagccccatcgtcaaccgcgaggggaagatcgtgggcctctacggcaacggggtggtcacgaccagcggcacctacgtgtccgccatcgcgcaggccaaggccagccaggaggggccgctgcccgagatcgaggacgaggtgttccggaagcgcaacctgaccatcatggacctccaccccggctccgggaagacgcggcgctacctgccggccatcgtccgggaggcgatcaagcgcaagctgcggaccctcatcctggcccccacccgcgtggtggccagcgagatggccgaggccctgaagggcatgcccatccgctaccagaccacggcggtcaagtccgagcacaccggccgggagatcgtggacctcatgtgccacgccaccttcaccatgcgcctgctgagccccgtgcgggtcccgaactacaacatgatcatcatggacgaggcccacttcacggacccctccagcatcgccgcccgcgggtacatctccacccgggtgggcatgggggaggcggccgccatcttcatgaccgccacgccgcccggcagcgtggaggccttcccgcagtccaacgcggtcatccaggacgaggagcgcgacatccccgagcggagctggaactccgggtacgagtggatcacggacttccccggcaagaccgtgtggttcgtgcccagcatcaagtccggcaacgacatcgccaactgcctccgcaagaacgggaagcgggtcatccagctgagccgcaagaccttcgacaccgagtaccagaagacgaagaacaacgactgggactacgtggtgaccaccgacatctccgagatgggcgccaacttccgggccgaccgcgtcatcgacccgcggcgctgcctgaagcccgtgatcctcaaggacgggcccgagcgggtcatcctggcgggccccatgccggtgaccgtggccagcgccgcccagcgccgggggcgcatcggccggaaccacaacaaggagggcgaccagtacatctacatggggcagcccctgaacaacgacgaggaccacgcccactggacggaggcgaagatgctcctggacaacatcaacacccccgagggcatcatccccgccctgttcgagccggagcgcgagaagtccgccgccatcgacggggagtaccgcctccggggcgaggcccgcaagaccttcgtcgagctgatgcggcgcggggacctgcccgtgtggctcagctacaaggtggcgagcgagggcttccagtactccgaccggcgctggtgcttcgacggcgagcggaacaaccaggtcctggaggagaacatggacgtggagatctggaccaaggagggggagcgcaagaagctgcggccccgctggctcgacgcccggacgtacagcgaccccctggccctgcgcgagttcaaggagttcgccgccggccggcgctccgtgagcggggacctcatcctggagatcggcaagctgccgcagcacctcacccagcgggcgcagaacgccctggacaacctggtcatgctccacaactccgagcagggcgggcgcgcctaccggcacgccatggaggagctgcccgacaccatcgagaccctgatgctcctggcgctgatcgccgtgctcacgggcggggtgaccctgttcttcctgagcggccgcgggctcggcaagacctccatcggcctgctgtgcgtcatggccagctccgccctcctgtggatggccagcgtggagccccactggatcgcggcctccatcatcctggagttcttcctcatggtgctgctgatccccgagccggaccggcagcgcacgccccaggacaaccagctcgcctacgtcgtgatcgggctgctgttcatgatcctcaccgtggccgccaacgagatgggcctgctggagacgaccaagaaggacctcgggatcggccacgtcgcggtggagaaccaccaccacgccaccatgctggacgtggacctgcaccccgccagcgcctggaccctctacgccgtcgcgacgaccatcatcaccccgatgatgcggcacaccatcgagaacacgaccgccaacatctccctgaccgccatcgccaaccaggccgcgatcctgatggggctcgacaagggctggcccatcagcaagatggacatcggcgtgcccctgctggccctcgggtgctactcccaggtgaaccccctgaccctgacggccgccgtcctcatgctggtggcgcactacgccatcatcggcccggggctgcaggccaaggccacccgcgaggcccagaagcgcaccgcggccggcatcatgaagaaccccaccgtggacgggatcgtcgccatcgacctcgaccccgtggtgtacgacgccaagttcgagaagcagctgggccagatcatgctgctcatcctgtgcacgagccagatcctgctcatgcggaccacctgggccctgtgcgagtccatcaccctggcgacgggccccctcaccaccctgtgggaggggagcccgggcaagttctggaacaccacgatcgccgtctccatggccaacatcttccgcgggagctacctggccggcgccggcctcgcgttcagcctgatgaagtccctcgggggcgggcggcgcgggaccggggcccagggcgagaccctcggcgagaagtggaagcggcagctgaaccagctgagcaagtccgagttcaacacctacaagcgcagcgggatcatggaggtggaccggtccgaggccaaggagggcctccgccgcggggagacgaccaagcacgccgtgagccgcggcaccgcgaagctgcggtggttcgtcgagcgcaacctggtgaagcccgaggggaaggtgatcgacctgggctgcggccgcggcgggtggtcctactactgcgccgggctcaagaaggtcaccgaggtgaaggggtacacgaagggcggccccggccacgaggagcccatcccgatggccacctacgggtggaacctggtgaagctgcacagcggcaaggacgtcttcttcatcccgcccgagaagtgcgacaccctcctgtgcgacatcggggagtccagccccaacccgaccatcgaggagggccgcacgctgcgggtgctcaagatggtggagccctggctgcgcgggaaccagttctgcatcaagatcctgaacccctacatgccctccgtcgtggagaccctcgagcagatgcagcggaagcacggcggcatgctggtgcgcaacccgctgagccggaactccacccacgagatgtactgggtcagctgcgggaccggcaacatcgtgtccgccgtgaacatgaccagccgcatgctcctgaaccgcttcacgatggcccaccggaagcccacctacgagcgcgacgtcgacctgggggcgggcacccggcacgtggccgtggagcccgaggtcgccaacctcgacatcatcggccagcgcatcgagaacatcaagcacgagcacaagtccacctggcactacgacgaggacaacccctacaagacgtgggcctaccacgggagctacgaggtgaagccgtccggcagcgccagctccatggtcaacggggtggtgaagctgctgaccaagccctgggacgtcatccccatggtgacccagatcgcgatgaccgacacgacccccttcggccagcagcgggtgttcaaggagaaggtcgacacccgcaccccgaaggccaagcgggggacggcccagatcatggaggtgaccgcccgctggctctggggcttcctgagccggaacaagaagccccgcatctgcacccgggaggagttcacccgcaaggtgcggtccaacgccgcgatcggcgccgtcttcgtggacgagaaccagtggaacagcgccaaggaggccgtggaggacgagcgcttctgggacctggtccaccgggagcgcgagctccacaagcaggggaagtgcgcgacgtgcgtgtacaacatgatgggcaagcgggagaagaagctgggggagttcggcaaggccaaggggtcccgcgccatctggtacatgtggctgggcgcccggttcctcgagttcgaggccctgggcttcatgaacgaggaccactggttcagccgcgagaactccctgagcggggtggagggcgaggggctccacaagctgggctacatcctgcgggacatctccaagatccccgggggcaacatgtacgcggacgacaccgccggctgggacacccgcatcaccgaggacgacctccagaacgaggccaagatcacggacatcatggagccggagcacgccctgctggccaccagcatcttcaagctcacctaccagaacaaggtcgtgcgcgtgcagcggcccgcgcgcaacgggaccgtcatggacgtgatctcccggcgcgaccagcggggcagcggccaggtgggcacgtacggcctgaacaccttcaccaacatggaggcccagctgatccgccagatggagtccgaggggatcttcagcccctccgagctcgagacccccaacctggccgagcgggtcctggactggctcgagaagcacggcgtggagcgcctgaagcggatggccatcagcggggacgactgcgtggtcaagccgatcgacgaccgcttcgccacggcgctgtccgccctcaacgacatgggcaaggtgcggaaggacatcccccagtgggagcccagcaaggggtggaacgactggcagcaggtccccttctgcagccaccacttccaccagctgatcatgaaggacggccgcgagatcgtcgtgccgtgccggaaccaggacgagctggtgggccgcgcccgggtctcccagggggccggctggagcctccgcgagaccgcctgcctggggaagtcctacgcgcagatgtggcagctgatgtacttccaccggcgcgacctccggctggccgccaacgccatctgcagcgcggtgcccgtggactgggtccccaccaaccgcaccacgtggtccatccacgcccaccaccagtggatgaccaccgaggacatgctgagcgtgtggaaccgcgtgtggatcgaggagaacccctggatggaggacaagacccacatctccagctggggcgacgtcccgtacctcgggaagcgggaggaccagtggtgcggctccctgatcggcctgacggcccgcgccacctgggccaccaacatccaggtggcgatcaaccaggtgcggcgcctcatcgggaacgagaactacctggactacatgaccagcatgaagcggttcaagaacgactccgaccccgagggcgccctgtggtga

SEQ ID NO: 8335 - RNA, 9879 nt, synthetic construct
  misc_feature 1..9879: note = derived and/or modified CDS sequence (opt1) from DENV-1__FJ024448__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatcacctacaagtgcccccgcatcaccgagaccgagcccgacgacgtggactgctggtgcaacgccacggacacctgggtcacctacgggacctgcagccagacgggcgagcaccggcgcgacaagcggtccgtggccctcgcgccccacgtgggcctggggctggagacccgcaccgagacctggatgagctccgagggcgcctggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgcggggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccgcctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccacggcccgcggggcccgccgcatggccatcctgggcgacaccgcgtgggacttcgggtccatcggcggcgtgttcaccagcgtcgggaagctggtgcaccagatcttcggcaccgcctacggggtgctgttctccggcgtcagctggacgatgaagatcgggatcggcgtgctgctgacctggctcggcctgaactcccggagcacctccctgagcatgacctgcatcgccgtggggctcgtcacgctgtacctgggcgtgatggtgcaggccgactccgggtgcgtcatcaactggaagggccgcgagctcaagtgcgggagcggcatcttcgtgaccaacgaggtgcacacctggaccgagcagtacaagttccaggccgacagcccgaagcggctgtccgcggccatcggcaaggcctgggaggagggggtctgcggcatccgcagcgccacccggctggagaacatcatgtggaagcagatctccaacgagctcaaccacatcctgctggagaacgacatgaagttcacggtggtggtcggggacgtggccggcatcctcgcgcaggggaagaagatgatccgcccccagcccatggagcacaagtacagctggaagtcctggggcaaggccaagatcatcggcgccgacgtgcagaacaccaccttcatcatcgacgggcccaacaccccggagtgccccgacgaccagcgggcctggaacatctgggaggtcgaggactacggcttcgggatcttcacgaccaacatctggctgaagctgcgcgacagctacacccaggtgtgcgaccaccggctcatgtccgcggccatcaaggacagcaaggccgtgcacgccgacatgggctactggatcgagtccgagaagaacgagacctggaagctggcccgcgcgagcttcatcgaggtcaagacgtgcatctggcccaagtcccacaccctgtggagcaacggcgtgctcgagtccgagatgatcatccccaagatctacgggggcccgatcagccagcacaactaccggcccgggtacttcacccagaccgccggcccctggcacctggggaagctggagctcgacttcgacctgtgcgagggcacgaccgtggtcgtggacgagcactgcggcaaccgcgggccgtccctgcggaccaccacggtgaccggcaagatcatccacgagtggtgctgccgcagctgcaccctgccgcccctccggttccgcggggaggacggctgctggtacgggatggagatccggcccgtcaaggagaaggaggagaacctggtgaagtccatggtgagcgccggcagcggcgaggtcgactccttcagcctcgggctgctgtgcatctccatcatgatcgaggaggtgatgcgcagccggtggtcccgcaagatgctcatgaccggcacgctggccgtgttcttcctgctcatcatggggcagctgacctggaacgacctgatccgcctctgcatcatggtcggcgccaacgcgagcgaccggatggggatgggcaccacctacctggccctgatggccacgttcaagatgcgcccgatgttcgccgtgggcctcctgttccggcgcctgacctcccgggaggtgctcctgctgaccatcgggctcagcctggtcgcctccgtggagctgcccaacagcctcgaggagctgggcgacgggctggcgatgggcatcatgatcctcaagctgctgaccgacttccagtcccaccagctctgggccacgctgctgagcctcaccttcatcaagaccaccttctccctgcactacgcctggaagacgatggccatggtcctgagcatcgtgtccctcttccccctgtgcctgagcaccacctcccagaagaccacgtggctccccgtgctgctgggcagcctcgggtgcaagccgctgaccatgttcctgatcgcggagaacaagatctggggccgccggtcctggcccctcaacgaggggatcatggccgtcggcatcgtgagcatcctgctgagctccctcctgaagaacgacgtgcccctggccgggcccctcatcgccggcggcatgctgatcgcctgctacgtcatcagcgggtccagcgcggacctgtccctcgagaaggccgccgaggtgagctgggaggaggaggccgagcactccggcgccagccacaacatcctggtggaggtccaggacgacgggaccatgaagatcaaggacgaggagcgcgacgacaccctgaccatcctcctgaaggcgacgctgctcgccgcctccggcgtgtacccgctgagcatccccgccaccctgttcgtgtggtacttctggcagaagaagaagcagcggtccggggtcctctgggacacccccagcccgcccgaggtggagcgcgccgtgctggacgacggcatctaccggatcatgcagcgcggcctgctggggcggtcccaggtcggcgtgggggtgttccaggagaacgtcttccacaccatgtggcacgtgacgcgcggcgcggtgctcatgtaccaggggaagcggctggagcccagctgggcctccgtcaagaaggacctgatcagctacggcggcgggtggcgcctccagggctcctggaacaccggggaggaggtccaggtgatcgccgtcgagcccggcaagaaccccaagaacgtgcagaccgcccccgggaccttcaagacgcccgagggcgaggtgggcgccatcgcgctggacttcaagcccgggaccagcggctcccccatcgtcaaccgggaggggaagatcgtgggcctgtacggcaacggggtggtcaccaccagcggcacgtacgtgagcgccatcgcccaggccaaggcgtcccaggaggggccgctccccgagatcgaggacgaggtgttccgcaagcggaacctgaccatcatggacctgcaccccggcagcgggaagacccgccggtacctcccggccatcgtccgcgaggccatcaagcgcaagctgcggaccctgatcctcgcccccacgcgcgtggtggcctccgagatggcggaggccctgaagggcatgcccatccggtaccagaccaccgccgtcaagagcgagcacaccggcaaggagatcgtggacctgatgtgccacgccacgttcaccatgcgcctcctgtcccccgtgcgggtcccgaactacaacatgatcatcatggacgaggcccacttcaccgaccccagctccatcgcggcccgcgggtacatcagcacccgggtgggcatgggggaggccgccgccatcttcatgacggcgacgccgcccggctccgtggaggccttcccgcagagcaacgccgtcatccaggacgaggagcgcgacatccccgagcggtcctggaacagcgggtacgagtggatcaccgacttccccggcaagaccgtgtggttcgtgccctccatcaagagcggcaacgacatcgccaactgcctgcgcaagaacgggaagcgggtcatccagctctcccgcaagacgttcgacaccgagtaccagaagaccaagaacaacgactgggactacgtggtgaccacggacatcagcgagatgggcgcgaacttccgggccgaccgcgtcatcgacccgcggcgctgcctgaagcccgtgatcctgaaggacgggcccgagcgggtgatcctcgccggccccatgccggtcaccgtggcctccgccgcgcagcgccgggggcgcatcggccgcaaccacaacaaggagggcgaccagtacatctacatggggcagcccctgaacaacgacgaggaccacgcccactggaccgaggccaagatgctgctcgacaacatcaacacccccgagggcatcatccccgccctgttcgagccggagcgggagaagtccgccgcgatcgacggggagtaccgcctgcggggcgaggcccgcaagacgttcgtcgagctcatgcggcgcggggacctgcccgtgtggctgtcctacaaggtggccagcgagggcttccagtacagcgaccggcgctggtgcttcgacggcgagcggaacaaccaggtcctcgaggagaacatggacgtggagatctggaccaaggagggggagcgcaagaagctgcggccccgctggctggacgcccggacctactccgaccccctcgccctgcgcgagttcaaggagttcgcggccggccggcgcagcgtgtccggggacctgatcctcgagatcggcaagctgccgcagcacctgacccagcgggcccagaacgccctcgacaacctggtcatgctgcacaacagcgagcagggcgggcgcgcgtaccggcacgccatggaggagctccccgacacgatcgagaccctgatgctgctcgccctgatcgccgtgctgaccggcggggtgaccctcttcttcctgtccggccgcgggctgggcaagaccagcatcggcctcctgtgcgtcatggcctccagcgtgctgctctggatggcgtccgtggagccccactggatcgccgccagcatcatcctggagttcttcctgatggtcctcctgatccccgagccggaccggcagcgcacgccccaggacaaccagctggcctacgtggtgatcgggctcctgttcatgatcctgaccgtcgccgcgaacgagatgggcctcctggagaccaccaagaaggacctggggatcggccacgtggccgtggagaaccaccaccacgccgccatgctcgacgtcgacctgcaccccgcctccgcgtggacgctgtacgccgtggccaccaccatcatcaccccgatgatgcgccacacgatcgagaacaccaccgccaacatcagcctcaccgccatcgcgaaccaggccgccatcctgatggggctggacaagggctggcccatctccaagatggacatcggcgtgcccctcctggccctggggtgctacagccaggtcaaccccctcacgctgaccgcggccgtgctgatgctcgtggcccactacgccatcatcggcccggggctgcaggccaaggcgacccgggaggcccagaagcgcaccgccgccggcatcatgaagaaccccacggtcgacgggatcgtggccatcgacctggaccccgtggtctacgacgcgaagttcgagaagcagctcggccagatcatgctgctgatcctctgcacctcccagatcctgctgatgcggaccacctgggccctctgcgagagcatcacgctggccaccggccccctgaccaccctctgggaggggtccccgggcaagttctggaacacgaccatcgccgtgagcatggccaacatcttccgcgggtcctacctggcgggcgccggcctggccttcagcctcatgaagtccctcgggggcgggcggcgcgggaccggggcccagggcgagaccctgggcgagaagtggaagcggcagctcaaccagctgtccaagagcgagttcaacacgtacaagcgctccgggatcatggaggtggaccggagcgaggcgaaggagggcctgaagcgcggggagaccaccaagcacgccgtctcccggggcaccgccaagctccgctggttcgtggagcggaacctggtgaagcccgaggggaaggtcatcgacctgggctgcggccgcgggggctggagctactactgcgccgggctgaagaaggtgacggaggtgaagggctacaccaagggcggccccggccacgaggagcccatcccgatggccacctacgggtggaacctcgtcaagctgcactccggcaaggacgtgttcttcatcccgcccgagaagtgcgacaccctgctctgcgacatcggggagagctcccccaacccgacgatcgaggagggccggaccctgcgcgtgctgaagatggtcgagccctggctccgggggaaccagttctgcatcaagatcctgaacccctacatgcccagcgtggtggagaccctggagcagatgcagcgcaagcacggcggcatgctcgtccggaacccgctgtcccgcaacagcacccacgagatgtactgggtgtcctgcgggaccggcaacatcgtgagcgcggtcaacatgacgtcccgcatgctgctcaaccggttcaccatggcccaccgcaagcccacctacgagcgggacgtggacctgggggccggcacccgccacgtggccgtcgagcccgaggtggccaacctggacatcatcggccagcggatcgagaacatcaagcacgagcacaagagcacgtggcactacgacgaggacaacccctacaagacctgggcgtaccacgggtcctacgaggtgaagccgagcggctccgccagcagcatggtcaacggggtggtcaagctcctgaccaagccctgggacgtgatccccatggtgacccagatcgccatgacggacaccacccccttcggccagcagcgcgtcttcaaggagaaggtggacacccggacgccgaaggccaagcgcgggaccgcccagatcatggaggtgaccgcgaagtggctgtggggcttcctctcccggaacaagaagccccgcatctgcacccgggaggagttcacgcgcaaggtccggagcaacgccgccatcggcgccgtgttcgtggacgagaaccagtggaactccgcgaaggaggccgtcgaggacgagcgcttctgggacctggtgcaccgggagcgcgagctgcacaagcaggggaagtgcgcgacctgcgtgtacaacatgatgggcaagcgggagaagaagctcggggagttcggcaaggccaaggggagccgcgccatctggtacatgtggctgggcgcgcggttcctggagttcgaggccctcggcttcatgaacgaggaccactggttctcccgcgagaacagcctgtccggggtcgagggcgaggggctgcacaagctcggctacatcctgcgggacatcagcaagatccccgggggcaacatgtacgccgacgacaccgccggctgggacacccgcatcacggaggacgacctgcagaacgaggcccgcatcaccgacatcatggagccggagcacgcgctcctggccaagtccatcttcaagctgacctaccagaacaaggtggtgcgggtccagcgccccgccaagaacgggaccgtgatggacgtgatcagccggcgcgaccagcggggctccgggcaggtcggcacgtacggcctcaacaccttcaccaacatggaggcccagctgatccgccagatggagagcgaggggatcttctcccccagcgagctggagacccccaacctcgccgagcgggtgctggactggctggagaagtacggcgtggagcgcctcaagcggatggcgatctccggggacgactgcgtcgtgaagccgatcgacgaccgcttcgccacggccctgaccgccctgaacgacatgggcaaggtgcggaaggacatcccccagtgggagcccagcaaggggtggaacgactggcagcaggtccccttctgctcccaccacttccaccagctcatcatgaaggacggccgcgagatcgtggtgccgtgccggaaccaggacgagctggtcggccgcgcccgggtgagccagggggcgggctggagcctgcgcgagaccgcctgcctcgggaagtcctacgcccagatgtggcagctgatgtacttccaccggcgcgacctgcggctcgccgcgaacgccatctgcagcgccgtgcccgtcgactggatccccacctcccgcacgacctggagcatccacgcccaccaccagtggatgaccaccgaggacatgctgtccgtgtggaaccgcgtgtggatcgaggagaacccctggatggaggacaagacgcacatcagctcctggggcgacgtcccgtacctggggaagcgggaggaccagtggtgcggcagcctcatcggcctgaccgcccgcgcgacctgggccaccaacatccaggtggccatcaaccaggtgcggcgcctgatcgggaacgagaactacctcgactacatgacctccatgaagcggttcaagaacgagagcgaccccgagggcgccctgtggtga

SEQ ID NO: 8336 - RNA, 9879 nt, synthetic construct
  misc_feature 1..9879: note = derived and/or modified CDS sequence (opt1) from DENV-1__FJ182026__SS-prME
  source 1..9879: mol_type = other RNA
agcgtgaccatgctgctgatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtcacctacgggacctgcagccagacgggcgagcaccggcgggacaagcggtccgtggccctcgcgccccacgtgggcctggggctggagacccgcaccgagacctggatgagctccgagggcgcgtggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggagctggccgagacccagcacggcaccgtgctggtgcagatcaagtacgagggcaccgacgcgccctgcaagatccccttcagcacgcagaacgagaagggggtcacccagaacggccggctgatcaccgccaacccgatcgtgaccgacaaggagaagcccgtgaacatcgaggccgagccgcccttcggggagtcctacatcgtcatcggcgccggcgagaaggcgctcaagctgagctggttcaagaaggggtccagcatcggcaagatgttcgaggccacggcccgcggggcccggcgcatggccatcctgggcgacaccgcgtgggacttcgggtccatcggcggcgtgttcaccagcgtggggaagctcgtccaccagatcttcggcaccgcctacggggtgctgttctccggcgtgagctggacgatgaagatcgggatcggcgtcctgctcacctggctgggcctgaactcccgcagcacctccctcagcatgacctgcatcgccgtggggctggtgacgctgtacctcggcgtcatggtgcaggccgactccgggtgcgtgatcaactggaagggccgggagctgaagtgcgggagcggcatcttcgtcaccaacgaggtgcacacctggaccgagcagtacaagttccaggccgacagcccgaagcgcctgtccgcggccatcggcaaggcctgggaggagggggtgtgcggcatccggagcgccacccgcctcgagaacatcatgtggaagcagatctccaacgagctgaaccacatcctgctcgagaacgacatgaagttcacggtcgtggtgggggacgtcgccggcatcctggcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctgaagctccgggacagctacacccaggtctgcgaccaccgcctgatgtccgcggccatcaaggacagcaaggccgtgcacgccgacatgggctactggatcgagtccgagaagaacgagacctggaagctggcccgggcgagcttcatcgaggtgaagacgtgcatctggcccaagtcccacaccctctggagcaacggcgtcctggagtccgagatgatcatccccaagatctacgggggcccgatcagccagcacaactaccgccccgggtacttcacccagaccgccggcccctggcacctggggaagctcgagctggacttcgacctgtgcgagggcacgaccgtggtggtcgacgagcactgcggcaaccgggggccgtccctccgcaccaccacggtgaccggcaagatcatccacgagtggtgctgccggagctgcaccctgccgcccctgcgcttccgcggggaggacggctgctggtacgggatggagatccgccccgtgaaggagaaggaggagaacctcgtcaagtccatggtgagcgccggcagcggcgaggtggactccttcagcctggggctgctctgcatctccatcatgatcgaggaggtcatgcggagccgctggtcccggaagatgctgatgaccggcacgctggccgtgttcttcctcctgatcatggggcagctgacctggaacgacctcatccgcctgtgcatcatggtgggcgccaacgcgagcgaccgcatggggatgggcaccacctacctggccctcatggccacgttcaagatgcggccgatgttcgccgtcggcctgctgttccgccggctcacctcccgcgaggtgctgctgctcaccatcgggctgagcctggtggcctccgtcgagctccccaacagcctggaggagctgggcgacgggctcgcgatgggcatcatgatcctgaagctgctcaccgacttccagtcccaccagctgtgggccacgctgctcagcctgaccttcatcaagaccaccttctccctgcactacgcctggaagacgatggccatggtgctcagcatcgtctccctgttccccctgtgcctcagcaccacctcccagaagaccacgtggctgcccgtgctgctcggcagcctggggtgcaagccgctgaccatgttcctcatcgcggagaacaagatctggggccggcgctcctggcccctgaacgaggggatcatggccgtgggcatcgtcagcatcctgctcagctccctgctgaagaacgacgtgcccctcgccgggcccctgatcgccggcggcatgctgatcgcctgctacgtgatcagcgggtccagcgcggacctctccctggagaaggccgccgaggtcagctgggaggaggaggccgagcactccggcgccagccacaacatcctggtggaggtgcaggacgacgggaccatgaagatcaaggacgaggagcgggacgacaccctcaccatcctgctgaaggcgacgctcctggccgtctccggcgtgtacccgctgagcatccccgccaccctcttcgtgtggtacttctggcagaagaagaagcagcgctccggggtcctgtgggacacccccagcccgcccgaggtggagcgggccgtgctggacgacggcatctaccgcatcatgcagcggggcctgctcgggcgctcccaggtcggcgtgggggtgttccaggagaacgtcttccacaccatgtggcacgtgacgcggggcgccgtgctgatgtaccaggggaagcgcctggagcccagctgggcgtccgtcaagaaggacctcatcagctacggcggcgggtggcggctgcagggctcctggaacgccggggaggaggtccaggtgatcgccgtcgagcccggcaagaaccccaagaacgtgcagaccgcccccgggaccttcaagacccccgagggcgaggtgggcgccatcgcgctggacttcaagcccgggacgagcggctcccccatcgtcaaccgcgaggggaagatcgtgggcctctacggcaacggggtggtcaccaccagcggcacctacgtgagcgccatcgcccaggccaaggcgtcccaggaggggccgctgcccgagatcgaggacgaggtgttccggaagcgcaacctgacgatcatggacctccaccccggcagcgggaagacccggcgctacctgccggccatcgtccgggaggccatcaagcgcaagctgcgcaccctcatcctggcccccacccgggtggtggcctccgagatggcggaggccctgaagggcatgcccatccgctaccagacgaccgccgtcaagagcgagcacaccggcaaggagatcgtggacctcatgtgccacgccaccttcacgatgcggctgctgtcccccgtgcgcgtcccgaactacaacatgatcatcatggacgaggcccacttcaccgaccccagctccatcgcggcccgggggtacatcagcacccgcgtgggcatgggggaggccgccgccatcttcatgaccgcgacgccgcccggctccgtggaggccttcccgcagagcaacgccgtcatccaggacgaggagcgggacatccccgagcgctcctggaacagcgggtacgagtggatcaccgacttccccggcaagaccgtgtggttcgtgccctccatcaagagcggcaacgacatcgccaactgcctccggaagaacgggaagcgcgtcatccagctgtcccggaagaccttcgacacggagtaccagaagaccaagaacaacgactgggactacgtggtgaccaccgacatcagcgagatgggcgcgaacttccgcgccgaccgggtcatcgacccgcgccggtgcctgaagcccgtgatcctcaaggacgggcccgagcgcgtgatcctggccggccccatgccggtcacggtggcctccgccgcgcagcggcgcgggcggatcggccgcaaccacaacaaggagggcgaccagtacatctacatggggcagcccctgaacaacgacgaggaccacgcccactggaccgaggccaagatgctcctggacaacatcaacacccccgagggcatcatccccgccctgttcgagccggagcgcgagaagtccgccgcgatcgacggggagtaccggctccgcggcgaggcccggaagaccttcgtcgagctgatgcgccgcggggacctgcccgtgtggctctcctacaaggtggccagcgagggcttccagtacagcgaccgccggtggtgcttcgacggcgagcgcaacaaccaggtcctggaggagaacatggacgtggagatctggacgaaggagggggagcggaagaagctgcgcccccggtggctcgacgcccgcacctactccgaccccctggccctgcgggagttcaaggagttcgcggccggccgccggagcgtgtccggggacctcatcctggagatcggcaagctgccgcagcacctcacccagcgcgcccagaacgccctggacaacctggtcatgctccacaacagcgagcagggcgggcgggcgtaccgccacgccatggaggagctgcccgacaccatcgagacgctgatgctcctggccctgatcgccgtgctcaccggcggggtgaccctgttcttcctgtccggccgggggctcggcaagaccagcatcggcctgctgtgcgtcatggcctccagcgtgctcctgtggatggcgtccgtggagccccactggatcgccgccagcatcatcctggagttcttcctcatggtcctgctgatccccgagccggaccgccagcggacgccccaggacaaccagctcgcctacgtggtgatcgggctgctgttcatgatcctcacggtcgccgcgaacgagatgggcctgctggagaccaccaagaaggacctcgggatcggccacgtggccgtggagaaccaccaccacgccgccatgctggacgtcgacctgcaccccgcctccgcgtggaccctctacgccgtggccacgaccatcatcaccccgatgatgcgccacaccatcgagaacacgaccgccaacatcagcctgaccgccatcgcgaaccaggccgccatcctgatggggctcgacaagggctggcccatctccaagatggacatcggcgtgcccctgctggccctcgggtgctacagccaggtcaaccccctgaccctgacggcggccgtgctcatgctggtggcccactacgccatcatcggcccggggctgcaggccaaggcgacccgcgaggcccagaagcggaccgccgccggcatcatgaagaaccccaccgtcgacgggatcgtggccatcgacctcgaccccgtggtctacgacgcgaagttcgagaagcagctgggccagatcatgctgctcatcctgtgcacgtcccagatcctgctcatgcgcaccacctgggccctgtgcgagagcatcaccctggccacgggccccctcaccaccctgtgggaggggtccccgggcaagttctggaacaccacgatcgccgtgagcatggccaacatcttccgggggtcctacctggcgggcgccggcctcgccttcagcctgatgaagtccctcgggggcgggcgccgggggaccggggcccagggcgagaccctcggcgagaagtggaagcgccagctgaaccagctgtccaagagcgagttcaacacctacaagcggtccgggatcatggaggtggaccgcagcgaggcgaaggagggcctcaagcgcggggagacgaccaagcacgccgtctcccgcggcaccgccaagctgcggtggttcgtggagcgcaacctggtgaagcccgaggggaaggtcatcgacctgggctgcggccgcgggggctggagctactactgcgccgggctcaagaaggtgaccgaggtgaagggctacacgaagggcggccccggccacgaggagcccatcccgatggccacctacgggtggaacctggtcaagctgcactccggcaaggacgtgttcttcatcccgcccgagaagtgcgacaccctcctgtgcgacatcggggagagctcccccaacccgaccatcgaggagggccgcacgctgcgggtgctcaagatggtcgagccctggctgcgcgggaaccagttctgcatcaagatcctgaacccctacatgcccagcgtggtggagaccctcgagcagatgcagcggaagcacggcggcatgctggtccgcaacccgctgtcccggaacagcacccacgagatgtactgggtgtcctgcgggaccggcaacatcgtgagcgcggtcaacatgacctcccgcatgctcctgaaccgcttcacgatggcccaccggaagcccacctacgagcgcgacgtggacctgggggccggcacccggcacgtggccgtcgagcccgaggtggccaacctcgacatcatcggccagcgcatcgagaacatcaagcacgagcacaagagcacctggcactacgacgaggacaacccctacaagacgtgggcgtaccacgggtcctacgaggtgaagccgagcggctccgccagcagcatggtcaacggggtggtcaagctgctgaccaagccctgggacgtgatccccatggtgacccagatcgccatgaccgacacgacccccttcggccagcagcgggtcttcaaggagaaggtggacacccgcaccccgaaggccaagcgggggacggcccagatcatggaggtgaccgcgaagtggctctggggcttcctgtcccgcaacaagaagccccggatctgcacccgcgaggagttcacccggaaggtccgcagcaacgccgccatcggcgccgtgttcgtggacgagaaccagtggaactccgcgaaggaggccgtcgaggacgagcggttctgggacctggtgcaccgcgagcgggagctccacaagcaggggaagtgcgccacgtgcgtgtacaacatgatgggcaagcgcgagaagaagctgggggagttcggcaaggccaaggggagccgggccatctggtacatgtggctgggcgcgcgcttcctcgagttcgaggccctgggcttcatgaacgaggaccactggttctcccgggagaacagcctgtccggggtcgagggcgaggggctccacaagctgggctacatcctgcgcgacatcagcaagatccccgggggcaacatgtacgccgacgacaccgccggctgggacacccggatcaccgaggacgacctccagaacgaggcccgcatcacggacatcatggagccggagcacgcgctgctggccaagtccatcttcaagctcacctaccagaacaaggtggtgcgcgtccagcggcccgccaagaacgggaccgtgatggacgtgatcagccgccgggaccagcgcggctccgggcaggtcggcacctacggcctgaacacgttcaccaacatggaggcccagctgatccggcagatggagagcgaggggatcttctcccccagcgagctcgagacccccaacctggccgagcgcgtgctggactggctcgagaagtacggcgtggagcggctgaagcgcatggcgatctccggggacgactgcgtcgtgaagccgatcgacgaccggttcgccaccgccctgacggccctcaacgacatgggcaaggtgcgcaaggacatcccccagtgggagcccagcaaggggtggaacgactggcagcaggtccccttctgctcccaccacttccaccagctgatcatgaaggacggccgggagatcgtggtgccgtgccgcaaccaggacgagctggtcggccgggcccgcgtgagccagggggcgggctggagcctccgggagaccgcctgcctggggaagtcctacgcccagatgtggcagctgatgtacttccaccgccgggacctccgcctggccgcgaacgccatctgcagcgccgtgcccgtcgactggatccccacctcccggaccacgtggagcatccacgcccaccaccagtggatgaccaccgaggacatgctgtccgtgtggaaccgcgtgtggatcgaggagaacccctggatggaggacaagacccacatcagctcctggggcgacgtcccgtacctcgggaagcgcgaggaccagtggtgcggcagcctgatcggcctgacggcccgggcgacctgggccaccaacatccaggtggccatcaaccaggtgcgccggctcatcgggaacgagaactacctggactacatgacctccatgaagcgcttcaagaacgagagcgaccccgagggcgccctgtggtga

SEQ ID NO: 8337 - RNA, 9879 nt, synthetic construct
  misc_feature 1..9879: note = derived and/or modified CDS sequence (opt1) from DENV-1__FJ182027__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatcacctacaagtgcccccgcatcaccgagaccgagcccgacgacgtggactgctggtgcaacgccacggacacctgggtgacctacgggacctgcagccagacgggcgagcaccggcgcgacaagcggtccgtggccctcgcgccccacgtgggcctggggctggagacccgcaccgagacctggatgagctccgagggcgcctggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgcggggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccgcctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccacggcccgcggggcccgccgcatggccatcctgggcgacaccgcgtgggacttcgggtccatcggcggcgtgttcaccagcgtcgggaagctggtgcaccagatcttcggcaccgcctacggggtgctgttctccggcgtcagctggacgatgaagatcgggatcggcgtgctgctgacctggctcggcctgaactcccggagcacctccctgagcatgacctgcatcgccgtggggctcgtcacgctgtacctgggcgtgatggtgcaggccgactccgggtgcgtcatcaactggaagggccgcgagctcaagtgcgggagcggcatcttcgtgaccaacgaggtgcacacctggaccgagcagtacaagttccaggccgacagcccgaagcggctgtccgcggccatcggcaaggcctgggaggagggggtctgcggcatccgcagcgccacccggctggagaacatcatgtggaagcagatctccaacgagctcaaccacatcctgctggagaacgacatgaagttcacggtggtggtcggggacgtggccggcatcctcgcgcaggggaagaagatgatccgcccccagcccatggagcacaagtacagctggaagtcctggggcaaggccaagatcatcggcgccgacgtgcagaacaccaccttcatcatcgacgggcccaacaccccggagtgccccgacgaccagcgggcctggaacatctgggaggtcgaggactacggcttcgggatcttcacgaccaacatctggctgaagctgcgcgacagctacacccaggtgtgcgaccaccggctcatgtccgcggccatcaaggacagcaaggccgtgcacgccgacatgggctactggatcgagtccgagaagaacgagacctggaagctggcccgcgcgagcttcatcgaggtcaagacgtgcatctggcccaagtcccacaccctgtggagcaacggcgtgctcgagtccgagatgatcatccccaagatctacgggggcccgatcagccagcacaactaccggcccgggtacttcacccagaccgccggcccctggcacctggggaagctggagctcgacttcgacctgtgcgagggcacgaccgtggtcgtggacgagcactgcggcaaccgcgggccgtccctgcggaccaccacggtgaccggcaagatcatccacgagtggtgctgccgcagctgcaccctgccgcccctccggttccgcggggaggacggctgctggtacgggatggagatccggcccgtcaaggagaaggaggagaacctggtgaagtccatggtgagcgccggcagcggcgaggtcgactccttcagcctcgggctgctgtgcatctccatcatgatcgaggaggtgatgcgcagccggtggtcccgcaagatgctcatgaccggcacgctggccgtgttcttcctgctcatcatggggcagctgacctggaacgacctgatccgcctctgcatcatggtcggcgccaacgcgagcgaccggatggggatgggcaccacctacctggccctgatggccacgttcaagatgcgcccgatgttcgccgtgggcctcctgttccggcgcctgacctcccgggaggtgctcctgctgaccatcgggctcagcctggtcgcctccgtggagctgcccaacagcctcgaggagctgggcgacgggctggcgatgggcatcatgatcctcaagctgctgaccgacttccagtcccaccagctctgggccacgctgctgagcctcaccttcatcaagaccaccttctccctgcactacgcctggaagacgatggccatggtcctgagcatcgtgtccctcttccccctgtgcctgagcaccacctcccagaagaccacgtggctccccgtgctgctgggcagcctcgggtgcaagccgctgaccatgttcctgatcgcggagaacaagatctggggccgccggtcctggcccctcaacgaggggatcatggccgtcggcatcgtgagcatcctgctgagctccctcctgaagaacgacgtgcccctggccgggcccctcatcgccggcggcatgctgatcgcctgctacgtcatcagcgggtccagcgcggacctgtccctcgagaaggccgccgaggtgagctgggaggaggaggccgagcactccggcgccagccacaacatcctggtggaggtccaggacgacgggaccatgaagatcaaggacgaggagcgcgacgacaccctgaccatcctcctgaaggcgacgctgctcgccgtgtccggcgtgtacccgctgagcatccccgccaccctgttcgtctggtacttctggcagaagaagaagcagcggtccggggtgctctgggacacccccagcccgcccgaggtggagcgcgccgtcctggacgacggcatctaccggatcatgcagcgcggcctgctggggcggtcccaggtgggcgtgggggtcttccaggagaacgtgttccacaccatgtggcacgtgacgcgcggcgccgtcctcatgtaccaggggaagcggctggagcccagctgggcgtccgtgaagaaggacctgatcagctacggcggcgggtggcgcctccagggctcctggaacaccggggaggaggtgcaggtcatcgccgtggagcccggcaagaaccccaagaacgtgcagaccgcccccgggaccttcaagacgcccgagggcgaggtcggcgccatcgccctggacttcaagcccgggaccagcggctcccccatcgtgaaccgggaggggaagatcgtgggcctgtacggcaacggggtcgtgaccaccagcggcacgtacgtgagcgcgatcgcccaggccaaggcctcccaggaggggccgctccccgagatcgaggacgaggtcttccgcaagcggaacctgaccatcatggacctgcaccccggcagcgggaagacccgccggtacctcccggcgatcgtgcgcgaggccatcaagcgcaagctgcggaccctgatcctcgcccccacgcgcgtggtcgcctccgagatggccgaggcgctgaagggcatgcccatccggtaccagaccaccgccgtcaagagcgagcacaccggcaaggagatcgtggacctgatgtgccacgccacgttcaccatgcgcctcctgtcccccgtccgggtgccgaactacaacatgatcatcatggacgaggcccacttcaccgaccccagctccatcgccgcgcgcgggtacatcagcacccgggtgggcatgggggaggccgccgccatcttcatgacggccacgccgcccggctccgtcgaggcgttcccgcagagcaacgccgtgatccaggacgaggagcgcgacatccccgagcggtcctggaacagcgggtacgagtggatcaccgacttccccggcaagaccgtgtggttcgtcccctccatcaagagcggcaacgacatcgccaactgcctgcgcaagaacgggaagcgggtgatccagctctcccgcaagacgttcgacaccgagtaccagaagaccaagaacaacgactgggactacgtggtcaccacggacatcagcgagatgggcgccaacttccgggcggaccgcgtgatcgacccgcggcgctgcctgaagcccgtgatcctgaaggacgggcccgagcgggtcatcctcgccggccccatgccggtgaccgtcgcctccgccgcccagcgccgggggcgcatcggccgcaaccacaacaaggagggcgaccagtacatctacatggggcagcccctgaacaacgacgaggaccacgcgcactggaccgaggccaagatgctgctcgacaacatcaacacccccgagggcatcatccccgccctgttcgagccggagcgggagaagtccgccgccatcgacggggagtaccgcctgcggggcgaggcgcgcaagacgttcgtggagctcatgcggcgcggggacctgcccgtgtggctgtcctacaaggtcgccagcgagggcttccagtacagcgaccggcgctggtgcttcgacggcgagcggaacaaccaggtgctcgaggagaacatggacgtggagatctggaccaaggagggggagcgcaagaagctgcggccccgctggctggacgcccggacctactccgaccccctcgccctgcgcgagttcaaggagttcgccgcgggccggcgcagcgtctccggggacctgatcctcgagatcggcaagctgccgcagcacctgacccagcgggcccagaacgccctcgacaacctggtgatgctgcacaacagcgagcagggcgggcgcgcctaccggcacgcgatggaggagctccccgacacgatcgagaccctgatgctgctcgccctgatcgccgtgctgaccggcggggtcaccctcttcttcctgtccggccgcgggctgggcaagaccagcatcggcctcctgtgcgtgatggcctccagcgtgctgctctggatggcctccgtcgagccccactggatcgcggccagcatcatcctggagttcttcctgatggtgctcctgatccccgagccggaccggcagcgcacgccccaggacaaccagctggcctacgtggtcatcgggctcctgttcatgatcctgaccgtggccgccaacgagatgggcctcctggagaccaccaagaaggacctggggatcggccacgtggcggtcgagaaccaccaccacgccgccatgctcgacgtggacctgcaccccgcctccgcctggacgctgtacgcggtggccaccaccatcatcaccccgatgatgcgccacacgatcgagaacaccaccgccaacatcagcctcaccgccatcgccaaccaggcggccatcctgatggggctggacaagggctggcccatctccaagatggacatcggcgtccccctcctggccctggggtgctacagccaggtgaaccccctcacgctgaccgccgcggtgctgatgctcgtcgcccactacgccatcatcggcccggggctgcaggccaaggccacccgggaggcgcagaagcgcaccgccgccggcatcatgaagaaccccacggtggacgggatcgtggccatcgacctggaccccgtcgtgtacgacgccaagttcgagaagcagctcggccagatcatgctgctgatcctctgcacctcccagatcctgctgatgcggaccacctgggcgctctgcgagagcatcacgctggccaccggccccctgaccaccctctgggaggggtccccgggcaagttctggaacacgaccatcgccgtgagcatggccaacatcttccgcgggtcctacctggccggcgcgggcctggccttcagcctcatgaagtccctcgggggcgggcggcgcgggaccggggcccagggcgagaccctgggcgagaagtggaagcggcagctcaaccagctgtccaagagcgagttcaacacgtacaagcgctccgggatcatggaggtcgaccggagcgaggccaaggagggcctgaagcgcggggagaccaccaagcacgcggtgtcccggggcaccgccaagctccgctggttcgtggagcggaacctggtcaagcccgaggggaaggtgatcgacctgggctgcggccgcgggggctggagctactactgcgccgggctgaagaaggtgacggaggtcaagggctacaccaagggcgggcccggccacgaggagcccatcccgatggccacctacgggtggaacctcgtgaagctgcactccggcaaggacgtgttcttcatcccgcccgagaagtgcgacaccctgctctgcgacatcggggagagctcccccaacccgacgatcgaggagggccggaccctgcgcgtcctgaagatggtggagccctggctccgggggaaccagttctgcatcaagatcctgaacccctacatgcccagcgtggtcgagaccctggagcagatgcagcgcaagcacggcggcatgctcgtgcggaacccgctgtcccgcaacagcacccacgagatgtactgggtgtcctgcgggaccggcaacatcgtcagcgccgtgaacatgacgtcccgcatgctgctcaaccggttcaccatggcgcaccgcaagcccacctacgagcgggacgtggacctgggggccggcacccgccacgtcgccgtggagcccgaggtggccaacctggacatcatcggccagcggatcgagaacatcaagcacgagcacaagagcacgtggcactacgacgaggacaacccctacaagacctgggcctaccacgggtcctacgaggtcaagccgagcggctccgcgagcagcatggtgaacggggtcgtgaagctcctgaccaagccctgggacgtgatccccatggtcacccagatcgccatgacggacaccacccccttcggccagcagcgcgtgttcaaggagaaggtggacacccggacgccgaaggccaagcgcgggaccgcccagatcatggaggtcaccgccaagtggctgtggggcttcctctcccggaacaagaagccccgcatctgcacccgggaggagttcacgcgcaaggtgcggagcaacgcggccatcggcgccgtgttcgtcgacgagaaccagtggaactccgccaaggaggcggtggaggacgagcgcttctgggacctggtgcaccgggagcgcgagctgcacaagcaggggaagtgcgcgacctgcgtctacaacatgatgggcaagcgggagaagaagctcggggagttcggcaaggccaaggggagccgcgccatctggtacatgtggctgggcgcccggttcctggagttcgaggcgctcggcttcatgaacgaggaccactggttctcccgcgagaacagcctgtccggggtggagggcgaggggctgcacaagctcggctacatcctgcgggacatcagcaagatccccgggggcaacatgtacgccgacgacaccgccggctgggacacccgcatcacggaggacgacctgcagaacgaggcccgcatcaccgacatcatggagccggagcacgccctcctggcgaagtccatcttcaagctgacctaccagaacaaggtggtccgggtgcagcgccccgccaagaacgggaccgtgatggacgtcatcagccggcgcgaccagcggggctccggccaggtgggcacgtacggcctcaacaccttcaccaacatggaggcccagctgatccgccagatggagagcgaggggatcttctcccccagcgagctggagacccccaacctcgccgagcgggtgctggactggctggagaagtacggcgtcgagcgcctcaagcggatggccatctccggggacgactgcgtggtgaagccgatcgacgaccgcttcgcgacggccctgaccgccctgaacgacatgggcaaggtccggaaggacatcccccagtgggagcccagcaaggggtggaacgactggcagcaggtccccttctgctcccaccacttccaccagctcatcatgaaggacggccgcgagatcgtggtcccgtgccggaaccaggacgagctggtgggccgcgcccgggtgagccagggggccggctggagcctgcgcgagaccgcgtgcctcgggaagtcctacgcccagatgtggcagctgatgtacttccaccggcgcgacctgcggctcgccgccaacgcgatctgcagcgccgtccccgtggactggatccccacctcccgcacgacctggagcatccacgcccaccaccagtggatgaccaccgaggacatgctgtccgtgtggaaccgcgtctggatcgaggagaacccctggatggaggacaagacgcacatcagctcctggggcgacgtgccgtacctggggaagcgggaggaccagtggtgcggcagcctcatcggcctgaccgcccgcgccacctgggcgaccaacatccaggtggccatcaaccaggtccggcgcctgatcgggaacgagaactacctcgactacatgacctccatgaagcggttcaagaacgagagcgaccccgagggcgccctgtggtga

SEQ ID NO: 8338 - RNA, 9879 nt, synthetic construct
  misc_feature 1..9879: note = derived and/or modified CDS sequence (opt1) from DENV-1__FJ024449__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtcacctacgggacctgcagccagacgggcgagcaccggcgggacaagcggtccgtggccctcgcgccccacgtgggcctggggctggagacccgcaccgagacctggatgagctccgagggcgcctggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcatcatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtggggaagctggtccaccagatcttcggcaccgcctacggggtgctgttctccggcgtgagctggacgatgaagatcgggatcggcgtcctgctgacctggctcggcctgaactcccgcagcacctccctgagcatgacctgcatcgccgtggggctcgtgacgctgtacctgggcgtcatggtgcaggccgactccgggtgcgtgatcaactggaagggccgggagctcaagtgcgggagcggcatcttcgtcaccaacgaggtgcacacctggaccgagcagtacaagttccaggccgacagcccgaagcgcctgtccgcggccatcggcaaggcctgggaggagggggtgtgcggcatccggagcgccacccgcctggagaacatcatgtggaagcagatctccaacgagctcaaccacatcctgctggagaacgacatgaagttcacggtcgtggtgggggacgtcgccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctgaagctgcgggacagccacacccaggtctgcgaccaccgcctcatgtccgcggccatcaaggacagcaaggccgtgcacgccgacatgggctactggatcgagtccgagaagaacgagacctggaagctggcccgggcgagcttcatcgaggtgaagacgtgcatctggcccaagtcccacaccctgtggagcaacggcgtcctcgagtccgagatgatcatccccaagatctacgggggcccgatcagccagcacaactaccgccccgggtacttcacccagaccgccggcccctggcacctggggaagctggagctcgacttcgacctgtgcgagggcacgaccgtggtggtcgacgagcactgcggcaaccgggggccgtccctgcgcaccaccacggtgaccggcaagatcatccacgagtggtgctgccggagctgcaccctgccgcccctccgcttccgcggggaggacggctgctggtacgggatggagatccgccccgtgaaggagaaggaggagaacctggtcaagtccatggtgagcgccggcagcggcgaggtggactccttcagcctcgggctgctgtgcatctccatcatgatcgaggaggtcatgcggagccgctggtcccggaagatgctcatgaccggcacgctggccgtgttcttcctgctcatcatggggcagctgacctggaacgacctgatccgcctctgcatcatggtgggcgccaacgcgagcgaccgcatggggatgggcaccacctacctggccctgatggccacgttcaagatgcggccgatgttcgccgtcggcctcctgttccgccggctgacctcccgcgaggtgctcctgctgaccatcgggctcagcctggtggcctccgtcgagctgcccaacagcctcgaggagctgggcgacgggctggcgatgggcatcatgatcctcaagctgctgaccgacttccagtcccaccagctctgggccacgctgctgagcctcaccttcatcaagaccaccttctccctgcactacgcctggaagacgatggccatggtgctgagcatcgtctccctcttccccctgtgcctgagcaccacctcccagaagaccacgtggctccccgtgctgctgggcagcctcgggtgcaagccgctgaccatgttcctgatcgcggagaacaagatctggggccggcgctcctggcccctcaacgaggggatcatggccgtgggcatcgtcagcatcctgctgagctccctcctgaagaacgacgtgcccctggccgggcccctcatcgccggcggcatgctgatcgcctgctacgtgatcagcgggtccagcgcggacctgtccctcgagaaggccgccgaggtcagctgggaggaggaggccgagcactccggcgccagccacaacatcctggtggaggtgcaggacgacgggaccatgaagatcaaggacgaggagcgggacgacaccctgaccatcctcctgaaggcgacgctgctcgccgtctccggcgtgtacccgctgagcatccccgccaccctgttcgtgtggtacttctggcagaagaagaagcagcgctccggggtcctctgggacacccccagcccgcccgaggtggagcgggccgtgctggacgacggcatctaccgcatcatgcagcggggcctgctggggcgctcccaggtcggcgtgggggtgttccaggagaacgtcttccacaccatgtggcacgtgacgcggggcgccgtgctcatgtaccaggggaagcgcctggagcccagctgggcgtccgtcaagaaggacctgatcagctacggcggcgggtggcggctccagggctcctggaacaccggggaggaggtccaggtgatcgccgtcgagcccggcaagaaccccaagaacgtgcagaccgcccccgggaccttcaagacgcccgagggcgaggtgggcgccatcgccctggacttcaagcccgggaccagcggctcccccatcgtcaaccgcgaggggaagatcgtgggcctgtacggcaacggggtggtcaccaccagcggcacgtacgtgagcgcgatcgcccaggccaaggcctcccaggaggggccgctccccgagatcgaggacgaggtgttccggaagcgcaacctgaccatcatggacctgcaccccggcagcgggaagacccggcgctacctcccggcgatcgtccgggaggccatcaagcgcaagctgcgcaccctgatcctcgcccccacgcgggtggtggcctccgagatggccgaggcgctgaagggcatgcccatccgctaccagaccaccgccgtcaagagcgagcacaccggcaaggagatcgtggacctgatgtgccacgccacgttcaccatgcggctcctgtcccccgtgcgcgtcccgaactacaacatgatcatcatggacgaggcccacttcaccgaccccagctccatcgccgcgcgggggtacatcagcacccgcgtgggcatgggggaggccgccgccatcttcatgacggccacgccgcccggctccgtggaggcgttcccgcagagcaacgccgtcatccaggacgaggagcgggacatccccgagcgctcctggaacagcgggtacgagtggatcaccgacttccccggcaagaccgtgtggttcgtgccctccatcaagagcggcaacgacatcgccaactgcctgcggaagaacgggaagcgcgtcatccagctctcccggaagacgttcgacaccgagtaccagaagaccaagaacaacgactgggactacgtggtgaccacggacatcagcgagatgggcgccaacttccgcgcggaccgggtcatcgacccgcgccggtgcctgaagcccgtgatcctgaaggacgggcccgagcgcgtgatcctcgccggccccatgccggtcaccgtggcctccgccgcccagcggcgcgggcggatcggccgcaaccacaacaaggagggcgaccagtacatctacatggggcagcccctgaacaacgacgaggaccacgcgcactggaccgaggccaagatgctgctcgacaacatcaacacccccgagggcatcatccccgccctgttcgagccggagcgcgagaagtccgccgccatcgacggggagtaccggctgcgcggcgaggcgcggaagacgttcgtcgagctcatgcgccgcggggacctgcccgtgtggctgtcctacaaggtggccagcgagggcttccagtacagcgaccgccggtggtgcttcgacggcgagcgcaacaaccaggtcctcgaggagaacatggacgtggagatctggaccaaggagggggagcggaagaagctgcgcccccggtggctggacgcccgcacctactccgaccccctcgccctgcgggagttcaaggagttcgccgcgggccgccggagcgtgtccggggacctgatcctcgagatcggcaagctgccgcagcacctgacccagcgcgcccagaacgccctcgacaacctggtcatgctgcacaacagcgagcagggcgggcgggcctaccgccacgcgatggaggagctccccgacacgatcgagaccctgatgctgctcgccctgatcgccgtgctgaccggcggggtgaccctcttcttcctgtccggccgggggctgggcaagaccagcatcggcctcctgtgcgtcatggcctccagcgtgctgctctggatggcctccgtggagccccactggatcgcggccagcatcatcctggagttcttcctgatggtcctcctgatccccgagccggaccgccagcggacgccccaggacaaccagctggcctacgtggtgatcgggctcctgttcatgatcctgaccgtcgccgccaacgagatgggcctcctggagaccaccaagaaggacctggggatcggccacgtggcggtggagaaccaccaccacgccgccatgctcgacgtcgacctgcaccccgcctccgcctggacgctgtacgcggtggccaccaccatcatcaccccgatgatgcgccacacgatcgagaacaccaccgccaacatcagcctcaccgccatcgccaaccaggcggccatcctgatggggctggacaagggctggcccatctccaagatggacatcggcgtgcccctcctggccctggggtgctacagccaggtcaaccccctcacgctgaccgccgcggtgctgatgctcgtggcccactacgccatcatcggcccggggctgcaggccaaggccacccgcgaggcgcagaagcggaccgccgccggcatcatgaagaaccccacggtcgacgggatcgtggccatcgacctggaccccgtggtctacgacgccaagttcgagaagcagctcggccagatcatgctgctgatcctctgcacctcccagatcctgctgatgcgcaccacctgggcgctctgcgagagcatcacgctggccaccggccccctgaccaccctctgggaggggtccccgggcaagttctggaacacgaccatcgccgtgagcatggccaacatcttccgggggtcctacctggccggcgcgggcctggccttcagcctcatgaagtccctcgggggcgggcgccgggggaccggggcccagggcgagaccctgggcgagaagtggaagcgccagctcaaccagctgtccaagagcgagttcaacacgtacaagcggtccgggatcatggaggtggaccgcagcgaggccaaggagggcctgaagcgcggggagaccaccaagcacgcggtctcccgcggcaccgccaagctccggtggttcgtggagcgcaacctggtgaagcccgaggggaaggtcatcgacctgggctgcggccgcgggggctggagctactactgcgccgggctgaagaaggtgacggaggtgaagggctacaccaagggcggccccggccacgaggagcccatcccgatggccacctacgggtggaacctcgtcaagctgcactccggcaaggacgtgttcttcatcccgcccgagaagtgcgacaccctgctctgcgacatcggggagagctcccccaacccgacgatcgaggagggccgcaccctgcgggtgctgaagatggtcgagccctggctccgcgggaaccagttctgcatcaagatcctgaacccctacatgcccagcgtggtggagaccctggagcagatgcagcggaagcacggcggcatgctcgtccgcaacccgctgtcccggaacagcacccacgagatgtactgggtgtcctgcgggaccggcaacatcgtgagcgccgtcaacatgacgtcccgcatgctgctcaaccgcttcaccatggcgcaccggaagcccacctacgagcgcgacgtggacctgggggccggcacccggcacgtggccgtcgagcccgaggtggccaacctggacatcatcggccagcgcatcgagaacatcaagcacgagcacaagagcacgtggcactacgacgaggacaacccctacaagacctgggcctaccacgggtcctacgacgtgaagccgagcggctccgcgagcagcatggtcaacggggtggtcaagctcctgaccaagccctgggacgtgatccccatggtgacccagatcgccatgacggacaccacccccttcggccagcagcgggtcttcaaggagaaggtggacacccgcacgccgaaggccaagcgggggaccgcccagatcatggaggtgaccgccaagtggctgtggggcttcctctcccgcaacaagaagccccggatctgcacccgcgaggagttcacgcggaaggtccgcagcaacgcggccatcggcgccgtgttcgtggacgagaaccagtggaactccgccaaggaggcggtcgaggacgagcggttctgggacctggtgcaccgcgagcgggagctgcacaagcaggggaagtgcgcgacctgcgtgtacaacatgatgggcaagcgcgagaagaagctcggggagttcggcaaggccaaggggagccgggccatctggtacatgtggctgggcgcccgcttcctggagttcgaggcgctcggcttcatgaacgaggaccactggttctcccgggagaacagcctgtccggggtcgagggcgaggggctgcacaagctcggctacatcctgcgcgacatcagcaagatccccgggggcaacatgtacgccgacgacaccgccggctgggacacccggatcacggaggacgacctgcagaacgaggcccgcatcaccgacatcatggagccggagcacgccctcctggcgaagtccatcttcaagctgacctaccagaacaaggtggtgcgcgtccagcggcccgccaagaacgggaccgtgatggacgtgatcagccgccgggaccagcgcggctccgggcaggtcggcacgtacggcctcaacaccttcaccaacatggaggcccagctgatccggcagatggagagcgaggggatcttctcccccagcgagctggagacccccaacctcgccgagcgcgtgctggactggctgaagaagtacggcgtggagcggctcaagcgcatggccatctccggggacgactgcgtcgtgaagccgatcgacgaccggttcgcgacggccctgaccgccctgaacgacatgggcaaggtgcgcaaggacatcccccagtgggagcccagcaaggggtggaacgactggcagcaggtccccttctgctcccaccacttccaccagctcatcatgaaggacggccgggagatcgtggtgccgtgccgcaaccaggacgagctggtcggccgggcccgcgtgagccagggggccggctggagcctgcgggagaccgcgtgcctcgggaagtcctacgcccagatgtggcagctgatgtacttccaccgccgggacctgcgcctcgccgccaacgcgatctgcagcgccgtgcccgtcgactggatccccacctcccggacgacctggagcatccacgcccaccaccagtggatgaccaccgaggacatgctgtccgtgtggaaccgcgtgtggatcgaggagaacccctggatggaggacaagacgcacatcagctcctggggcgacgtcccgtacctggggaagcgcgaggaccagtggtgcggcagcctcatcggcctgaccgcccgggccacctgggcgaccaacatccaggtggccatcaaccaggtgcgccggctgatcgggaacgagaactacctcgactacatgacctccatgaagcgcttcaagaacgagggcgaccccgagggggccctgtggtga

SEQ ID NO: 8339 - RNA, 9879 nt, synthetic construct
  misc_feature 1..9879: note = derived and/or modified CDS sequence (opt1) from DENV-1__FJ390383__SS-prME
  source 1..9879: mol_type = other RNA
agcgtgaccatgctgctgatgctgatgcccaccgccctggccttccacctcaccacccggggcggggagccccacatgatcgtgagcaagcaggagcggggcaagagcctgctgttcaagacctccgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtcacctacgggacctgcagccagacgggcgagcaccggcgggacaagcggtccgtggccctcgcgccccacgtgggcctggggctggagacccgcaccgagacctggatgagctccgagggcgcgtggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcctgacgcaggacgagaagggggtgacccagaacggccggctgatcaccgccaacccgatcgtgaccgacaaggagaagcccgtcaacatcgaggccgagccgcccttcggggagagctacatcatcatcggcgccggcgagaaggcgctcaagctgtcctggttcaagaaggggagctccatcggcaagatgttcgaggccacggcccgcggggcccggcgcatggccatcctgggcgacaccgcgtgggacttcgggagcatcggcggcgtgttcacctccgtggggaagctcgtccaccagatcttcggcaccgcctacggggtgctgttcagcggcgtgtcctggacgatgaagatcgggatcggcgtcctgctcacctggctgggcctgaacagccgctccaccagcctctccatgacctgcatcgccgtggggctggtgacgctgtacctcggcgtcatggtgcaggccgacagcgggtgcgtgatcaactggaagggccgggagctgaagtgcgggtccggcatcttcgtcaccaacgaggtgcacacctggaccgagcagtacaagttccaggccgacagcccgaagcgcctgagcgcggccatcggcaaggcctgggaggagggggtgtgcggcatccggtccgccacccgcctcgagaacatcatgtggaagcagatcagcaacgagctgaaccacatcctgctcgagaacgacatgaagttcacggtcgtggtgggggacgtcgccggcatcctggcgcaggggaagaagatgatccggccccagcccatggagtacaagtactcctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctgaagctccgggactcctacacccaggtctgcgaccaccgcctgatgagcgcggccatcaaggactccaaggccgtgcacgccgacatgggctactggatcgagagcgagaagaacgagacctggaagctggcccgggcgtccttcatcgaggtgaagacgtgcatctggcccaagagccacaccctctggtccaacggcgtcctggagagcgagatgatcatccccaagatctacgggggcccgatctcccagcacaactaccgccccgggtacttcacccagaccgccggcccctggcacctggggaagctcgagctggacttcgacctgtgcgagggcacgaccgtggtggtcgacgagcactgcggcaaccgggggccgagcctccgcaccaccacggtgaccggcaagatcatccacgagtggtgctgccggtcctgcaccctgccgcccctgcgcttccgcggggaggacggctgctggtacgggatggagatccgccccgtgaaggagaaggaggagaacctcgtcaagagcatggtgtccgccggcagcggcgaggtggacagcttctccctggggctgctctgcatcagcatcatcatcgaggaggtcatgcggtcccgctggagccggaagatgctgatgaccggcacgctggccgtgttcttcctcctgatcatggggcagctgacctggaacgacctcatccgcctgtgcatcatggtgggcgccaacgcgtccgaccgcatggggatgggcaccacctacctggccctcatggccacgttcaagatgcggccgatgttcgccgtcggcctgctgttccgccggctcaccagccgcgaggtgctgctgctcaccatcgggctgtccctggtggccagcgtcgagctccccaactccctggaggagctgggcgacgggctcgcgatgggcatcatgatcctgaagctgctcaccgacttccagagccaccagctgtgggccacgctgctctccctgaccttcatcaagaccaccttcagcctgcactacgcctggaagacgatggccatggtgctctccatcgtcagcctgttccccctgtgcctctccaccaccagccagaagaccacgtggctgcccgtgctgctcggctccctggggtgcaagccgctgaccatgttcctcatcgcggagaacaagatctggggccggcgcagctggcccctgaacgaggggatcatggccgtgggcatcgtctccatcctgctcagcagcctgctgaagaacgacgagcccctcgccgggcccctgatcgccggcggcatgctgatcgcctgctacgtgatctccgggagctccgcggacctcagcctggagaaggccgccgaggtgtcctgggaggaggaggccgagcacagcggcgcctcccacaacatcctggtcgaggtgcaggacgacgggaccatgaagatcaaggacgaggagcgggacgacaccctcaccatcctgctgaaggcgacgctcctggccgtgagcggcgtctacccgctgtccatccccgccaccctcttcgtgtggtacttctggcagaagaagaagcagcgcagcggggtgctgtgggacacccccagcccgcccgaggtcgagcgggccgtgctggacgacggcatctaccgcatcatgcagcggggcctgctcgggcgcagccaggtgggcgtcggggtgttccaggagaacgtgttccacaccatgtggcacgtcacgcggggcgccgtgctgatgtaccaggggaagcgcctggagccctcctgggcgagcgtgaagaaggacctcatctcctacggcggcgggtggcggctgcagggcagctggaacaccggggaggaggtccaggtgatcgccgtggagcccggcaagaaccccaagaacgtccagaccgcccccgggaccttcaagacgcccgagggcgaggtgggcgccatcgccctggacttcaagcccgggacctccggcagccccatcgtgaaccgcgaggggaagatcgtcggcctctacggcaacggggtggtgaccacctccggcacgtacgtcagcgcgatcgcccaggccaaggccagccaggaggggccgctgcccgagatcgaggacgaggtgttccggaagcgcaacctgaccatcatggacctccaccccggctccgggaagacccggcgctacctgccggcgatcgtgcgggaggccatcaagcgcaagctgcgcaccctcatcctggcccccacgcgggtcgtggccagcgagatggccgaggcgctgaagggcatgcccatccgctaccagaccaccgccgtgaagtccgagcacaccggcaaggagatcgtcgacctcatgtgccacgccacgttcaccatgcggctgctgagccccgtgcgcgtgccgaactacaacatgatcatcatggacgaggcccacttcaccgacccctccagcatcgccgcgcgggggtacatctccacccgcgtcggcatgggggaggccgccgccatcttcatgacggccacgccgcccggcagcgtggaggcgttcccgcagtccaacgccgtgatccaggacgaggagcgggacatccccgagcgcagctggaactccgggtacgagtggatcaccgacttccccggcaagaccgtctggttcgtgcccagcatcaagtccggcaacgacatcgccaactgcctccggaagaacgggaagcgcgtgatccagctgagccggaagacgttcgacaccgagtaccagaagaccaagaacaacgactgggactacgtcgtgaccacggacatctccgagatgggcgccaacttccgcgcggaccgggtgatcgacccgcgccggtgcctgaagcccgtcatcctcaaggacgggcccgagcgcgtgatcctggccggccccatgccggtgaccgtcgccagcgccgcccagcggcgcgggcggatcggccgcaaccacaacaaggagggcgaccagtacatctacatggggcagcccctgaacaacgacgaggaccacgcgcactggaccgaggccaagatgctcctggacaacatcaacacccccgagggcatcatccccgccctgttcgagccggagcgcgagaagtccgccgccatcgacggggagtaccggctccgcggcgaggcgcggaagacgttcgtggagctgatgcgccgcggggacctgcccgtctggctcagctacaaggtggcctccgagggcttccagtacagcgaccgccggtggtgcttcgacggcgagcgcaacaaccaggtgctggaggagaacatggacgtcgagatctggaccaaggagggggagcggaagaagctgcgcccccggtggctcgacgcccgcacctacagcgaccccctggccctgcgggagttcaaggagttcgccgcgggccgccggtccgtgagcggggacctcatcctggagatcggcaagctgccgcagcacctcacccagcgcgcccagaacgccctggacaacctggtgatgctccacaactccgagcagggcgggcgggcctaccgccacgcgatggaggagctgcccgacacgatcgagaccctgatgctcctggccctgatcgccgtcctcaccggcggggtgaccctgttcttcctgagcggccgggggctcggcaagacctccatcggcctgctgtgcgtgatggccagctccgtcctcctgtggatggccagcgtggagccccactggatcgcggcctccatcatcctggagttcttcctcatggtgctgctgatccccgagccggaccgccagcggacgccccaggacaaccagctcgcctacgtcgtgatcgggctgctgttcatgatcctcaccgtggccgccaacgagatgggcctgctggagaccaccaagaaggacctcgggatcggccacgtcgcggtggagaaccaccaccacgccgccatgctggacgtggacctgcaccccgccagcgcctggacgctctacgcggtcgccaccaccatcatcaccccgatgatgcgccacacgatcgagaacaccaccgccaacatctccctgaccgccatcgccaaccaggcggccatcctgatggggctcgacaagggctggcccatcagcaagatggacatcggcgtgcccctgctggccctcgggtgctactcccaggtgaaccccctgacgctgaccgccgcggtcctcatgctggtggcccactacgccatcatcggcccggggctgcaggccaaggccacccgcgaggcgcagaagcggaccgccgccggcatcatgaagaaccccacggtggacgggatcgtcgccatcgacctcgaccccgtggtgtacgacgccaagttcgagaagcagctgggccagatcatgctgctcatcctgtgcaccagccagatcctgctcatgcgcaccacctgggcgctgtgcgagtccatcacgctggccaccggccccctcaccaccctgtgggaggggagcccgggcaagttctggaacacgaccatcgccgtctccatggccaacatcttccgggggagctacctggccggcgcgggcctcgccttctccctgatgaagtccctcgggggcgggcgccgggggaccggggcccagggcgagaccctcggcgagaagtggaagcgccagctgaaccagctgagcaagtccgagttcaacacgtacaagcggagcgggatcatggaggtggaccgctccgaggccaaggagggcctcaagcgcggggagaccaccaagcacgcggtgagccgcggcaccgccaagctgcggtggttcgtcgagcgcaacctggtgaagcccgaggggaaggtgatcgacctgggctgcggccgcggcgggtggtcctactactgcgccgggctcaagaaggtcacggaggtgaaggggtacaccaagggcggccccggccacgaggagcccatcccgatggccacctacgggtggaacctggtgaagctgcacagcggcaaggacgtcttcttcatcccgcccgagaagtgcgacaccctcctgtgcgacatcggggagtccagccccaacccgacgatcgaggagggccgcaccctgcgggtgctcaagatggtggagccctggctgcgcgggaaccagttctgcatcaagatcctgaacccctacatgccctccgtcgtggagaccctcgagcagatgcagcggaagcacggcggcatgctggtgcgcaacccgctgagccggaactccacccacgagatgtactgggtcagctgcgggaccggcaacatcgtgtccgccgtgaacatgacgagccgcatgctcctgaaccgcttcaccatggcgcaccggaagcccacctacgagcgcgacgtcgacctgggggccggcacccggcacgtggccgtggagcccgaggtcgccaacctcgacatcatcggccagcgcatcgagaacatcaagcacgagcacaagtccacgtggcactacgacgaggacaacccctacaagacctgggcctaccacgggagctacgaggtgaagccgtccggcagcgcgtccagcatggtgaacggggtcgtgaagctgctgaccaagccctgggacgtcatccccatggtgacccagatcgccatgacggacaccacccccttcggccagcagcgggtgttcaaggagaaggtcgacacccgcacgccgaaggccaagcgggggaccgcccagatcatggaggtgaccgccaagtggctctggggcttcctgagccgcaacaagaagccccggatctgcacccgcgaggagttcacgcggaaggtgcgctccaacgcggccatcggcgccgtcttcgtggacgagaaccagtggaacagcgccaaggaggcggtggaggacgagcggttctgggacctggtccaccgcgagcgggagctccacaagcaggggaagtgcgcgacctgcgtgtacaacatgatgggcaagcgcgagaagaagctgggggagttcggcaaggccaaggggtcccgggccatctggtacatgtggctgggcgcccgcttcctcgagttcgaggcgctgggcttcatgaacgaggaccactggttcagccgggagaactccctgagcggggtggagggcgaggggctccacaagctgggctacatcctgcgcgacatctccaagatccccgggggcaacatgtacgccgacgacaccgccggctgggacacccggatcacggaggacgacctccagaacgaggcccgcatcaccgacatcatggagccggagcacgccctgctggccaagagcatcttcaagctcacctaccagaacaaggtcgtgcgcgtgcagcggcccgccaagaacgggaccgtcatggacgtgatctcccgccgggaccagcgcggcagcggccaggtggggacgtacggcctgaacaccttcaccaacatggaggcccagctgatccggcagatggagtccgaggggatcttcagcccctccgagctcgagatccccaacctggccgagcgcgtcctggactggctcgagaagtacggcgtggagcggctgaagcgcatggccatcagcggggacgactgcgtggtcaagccgatcgacgaccggttcgcgaccgccctgacggccctcaacgacatgggcaaggtgcgcaaggacatcccccagtgggagccctccaaggggtggaacgactggcagcaggtccccttctgcagccaccacttccaccagctgatcatgaaggacggccgggagatcgtcgtgccgtgccgcaaccaggacgagctggtgggccgggcccgcgtctcccagggggccggctggagcctccgggagaccgcgtgcctgggcaagagctacgcccagatgtggcagctgatgtacttccaccgccgggacctccgcctggccgccaacgcgatctgctccgccgtgcccgtggactggatccccaccagccggaccacgtggtccatccacgcccaccaccagtggatgaccaccgaggacatgctgagcgtctggaaccgcgtgtggatcgaggagaacccctggatggaggacaagacccacatctccagctggggcgacgtgccgtacctcgggaagcgcgaggaccagtggtgcggctccctgatcggcctgacggcccgggccacctgggcgaccaacatccaggtcgccatcaaccaggtgcgccggctcatcgggaacgagaactacctggactacatgaccagcatgaagcgcttcaagaacgagggcgaccccgagggggccctgtggtga

SEQ ID NO: 8340 - RNA, 9879 nt, synthetic construct
  misc_feature 1..9879: note = derived and/or modified CDS sequence (opt1) from DENV-1__FJ182033__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgaggtggagcccgacgacgtggactgctggtgcaacaccacggacacctgggtgacctacgggacctgcagccagacgggcgagcaccggcgcgacaagcggagcgtggccctcgcgccccacgtgggcctggggctggagacccgggccgagacctggatgagctccgagggcgcgtggaagcagatccagaaggtggagacctgggccctccggcaccccgggttcacggtgatcgccctgttcctggcccacgcgatcggcaccagcatcacccagaaggggatcatcttcatcctcctgatgctggtcaccccctccatggccatgcgctgcgtgggcatcggcagccgggacttcgtggaggggctctccggcgccacgtgggtcgacgtggtgctggagcacgggagctgcgtcaccaccatggccaaggacaagcccaccctggacatcgagctcctgaagacggaggtgaccaaccccgccgtgctgcgcaagctctgcatcgaggcgaagatctccaacaccaccacggacagccggtgcccgacccagggcgaggccaccctggtcgaggagcaggacgccaacttcgtgtgccgccggaccttcgtggaccgcggctgggggaacggctgcgggctgttcggcaaggggtccctcatcacgtgcgccaagttcaagtgcgtcaccaagctggagggcaagatcgtgcagtacgagaacctgaagtacagcgtgatcgtcaccgtgcacaccggcgaccagcaccaggtcgggaacgagtccacggagcacggcaccaccgccaccatcacgccccaggcgcccacgagcgagatccagctcaccgactacggggccctgaccctggactgcagcccccggaccggcctcgacttcaacgagatggtgctgctgacgatgaaggagaagtcctggctcgtgcacaagcagtggttcctggacctgccgctcccctggaccagcggggcctccaccagccaggagacctggaaccgccaggacctgctggtcacgttcaagaccgcccacgccaagaagcaggaggtggtggtcctcggctcccaggagggcgcgatgcacaccgccctgaccggggccacggagatccagaccagcggcaccaccacgatcttcgccgggcacctgaagtgccggctcaagatggacaagctgaccctgaagggcatgtcctacgtgatgtgcaccgggagcttcaagctcgagaaggaggtggccgagacccagcacggcacggtcctggtgcagatcaagtacgagggcaccgacgcgccctgcaagatccccttctccacccaggacgagaagggggtgacccagaacggccgcctgatcacggccaacccgatcgtcaccgacaaggagaagcccgtgaacatcgaggccgagccgcccttcggggagagctacatcgtgatcggcgccggcgagaaggcgctgaagctctcctggttcaagaaggggagctccatcggcaagatgttcgaggccaccgcccgcggggcccgccggatggccatcctgggcgacaccgcgtgggacttcgggagcatcggcggcgtcttcacgtccatcgggaagctggtgcaccagatcttcggcaccgcctacggggtgctgttcagcggcgtctcctggaccatgaagatcgggatcggcgtgctgctgacctggctcggcctgaacagccgctccacgagcctgtccatgacctgcatcgccgtggggctcgtcaccctgtacctgggcgtgatggtgcaggccgacagcgggtgcgtcatcaactggaagggccgcgagctcaagtgcgggagcggcatcttcgtgaccaacgaggtgcacacgtggaccgagcagtacaagttccaggccgactccccgaagcggctgagcgcggccatcggcaaggcctgggaggagggggtctgcggcatccgctccgccacccggctggagaacatcatgtggcgccagatcagcaacgagctcaaccacatcctgctggagaacgacatgaagttcaccgtggtggtcggggacgtggtgggcatcctcgcccaggggaagaagatgatccggccccagcccatggagcacaagtactcctggaagtcctggggcaaggcgaagatcatcggcgccgacgtccagaacaccacgttcatcatcgacgggcccaacaccccggagtgccccgacgaccagcgcgcctggaacatctgggaggtggaggactacggcttcgggatcttcaccaccaacatctggctgaagctgcgggactcctacacccaggtgtgcgaccaccgcctcatgagcgccgcgatcaaggactccaaggccgtccacgccgacatgggctactggatcgagagcgagaagaacgagacctggaagctggcccgggcctccttcatcgaggtgaagacctgcatctggcccaagagccacaccctgtggtccaacggcgtgctcgagagcgagatgatcatccccaagatctacgggggcccgatctcccagcacaactaccgccccgggtacttcacgcagaccgcgggcccctggcacctggggaagctggagctcgacttcgacctgtgcgagggcaccaccgtcgtggtggacgagcactgcggcaaccgggggccgagcctgcgcacgaccaccgtcaccggcaagatcatccacgagtggtgctgccggtcctgcacgctgccgcccctccgcttcaagggggaggacggctgctggtacgggatggagatccggcccgtgaaggagaaggaggagaacctggtcaagagcatggtcagcgccggctccggcgaggtggacagcttctccctcgggctgctgtgcatcagcatcatgatcgaggaggtgatgcgctcccggtggagccgcaagatgctcatgaccggcaccctggccgtcttcttcctgctcatcatggggcagctgacctggaacgacctgatccggtcctgcatcatggtgggcgccaacgccagcgaccgcatggggatgggcacgacctacctcgcgctgatggccaccttcaagatgcgcccgatgttcgccgtgggcctcctgttccggcgcctgacctcccgggaggtcctgctcctgacgatcgggctgagcctcgtggcctccgtcgagctgcccaacagcctggaggagctcggcgacgggctggccatgggcatcatgatcctgaagctcctgaccgacttccagtcctaccagctgtgggcgaccctcctgagcctgaccttcatcaagacgaccttctccctccactacgcctggaagaccatggccatggtgctgagcatcgtgtccctgctccccctgtgcctgagcaccacgtcccagaagaccacctggctccccgtcctgctgggcagcctcgggtgcaagccgctgaccatgttcctgatcgccgagaacaagatctggggccgcaagagctggcccctcaacgaggggatcatggcggtgggcatcgtgtccatcctgctgagctccctcctgaagaacgacgtccccctggccgggcccctcatcgccggcggcatgctgatcgcctgctacgtgatcagcgggtccagcgccgacctgtccctcgagaaggcggccgaggtgagctgggaggaggaggccgagcactccggcgccagccacaacatcctggtcgaggtgcaggacgacgggacgatgaagatcaaggacgaggagcgggacgacaccctgaccatcctcctgaaggccaccctgctcgcggtgtccggcgtctacccgctgagcatccccgccaccctgttcgtgtggtacttctggcagaagaagaagcagcgctccggggtgctctgggacacgcccagcccgcccgaggtcgagcgggccgtgctggacgacggcatctaccgcatcatgcagcggggcctgctggggcgctcccaggtgggcgtcggggtgttccaggagaacgtgttccacaccatgtggcacgtcacccggggcgccgtgctcatgtaccaggggaagcgcctggagcccagctgggcctccgtgaagaaggacctgatcagctacggcggcgggtggcggctccagggctcctggaacaccggggaggaggtccaggtgatcgcggtggagcccggcaagaaccccaagaacgtccagacggcccccgggaccttcaagacccccgagggcgaggtgggcgccatcgccctggacttcaagcccgggaccagcggcagccccatcgtgaaccgcgaggggaagatcgtcggcctgtacggcaacggggtggtgacgacctccggcacctacgtcagcgccatcgcgcaggccaaggcctcccaggaggggccgctccccgagatcgaggacgaggtgttccggaagcgcaacctgaccatcatggacctgcaccccggcagcgggaagacgcggcgctacctcccggccatcgtgcgggaggcgatcaagcgcaagctgcggaccctgatcctcgcccccacccgcgtcgtggcctccgagatggccgaggccctgaagggcatgcccatccgctaccagaccacggcggtcaagagcgagcacaccggccgggagatcgtcgacctgatgtgccacgccaccttcaccatgcgcctcctgtcccccgtgcgggtgccgaactacaacatgatcatcatggacgaggcccacttcacggaccccagctccatcgccgcccgcgggtacatcagcacccgggtcggcatgggggaggcggccgccatcttcatgaccgccacgccgcccggctccgtggaggccttcccgcagagcaacgcggtgatccaggacgaggagcgcgacatccccgagcggtcctggaacagcgggtacgagtggatcacggacttccccggcaagaccgtctggttcgtgccctccatcaagagcggcaacgacatcgccaactgcctgcgcaagaacgggaagcgggtgatccagctctcccgcaagaccttcgacaccgagtaccagaagacgaagaacaacgactgggactacgtcgtgaccaccgacatcagcgagatgggcgccaacttccgggccgaccgcgtgatcgacccgcggcgctgcctgaagcccgtcatcctgaaggacgggcccgagcgggtgatcctcgcgggccccatgccggtcaccgtggcctccgccgcccagcgccgggggcgcatcggccggaaccacaacaaggagggcgaccagtacatctacatggggcagcccctgaacaacgacgaggaccacgcccactggacggaggcgaagatgctgctcgacaacatcaacacccccgagggcatcatccccgccctgttcgagccggagcgcgagaagtccgccgccatcgacggggagtaccgcctgcggggcgaggcccgcaagaccttcgtggagctcatgcggcgcggggacctgcccgtctggctgagctacaaggtggcgtccgagggcttccagtacagcgaccggcgctggtgcttcgacggcgagcggaacaaccaggtgctcgaggagaacatggacgtcgagatctggaccaaggagggggagcgcaagaagctgcggccccgctggctggacgcccggacgtactccgaccccctcgccctgcgcgagttcaaggagttcgccgccggccggcgcagcgtgtccggggacctgatcctcgagatcggcaagctgccgcagcacctgacccagcgggcgcagaacgccctcgacaacctggtgatgctgcacaacagcgagcagggcgggcgcgcctaccggcacgccatggaggagctccccgacaccatcgagaccctgatgctgctcgcgctgatcgccgtcctgacgggcggggtgaccctcttcttcctgtccggccgcgggctgggcaagaccagcatcggcctcctgtgcgtgatggcctccagcgccctgctctggatggcctccgtcgagccccactggatcgcggccagcatcatcctggagttcttcctgatggtgctcctgatccccgagccggaccggcagcgcacgccccaggacaaccagctggcctacgtggtcatcgggctcctgttcatgatcctgaccgtggccgccaacgagatgggcctcctggagacgaccaagaaggacctggggatcggccacgtggcggtcgagaaccaccaccacgccaccatgctcgacgtggacctgcaccccgcctccgcctggaccctgtacgccgtggcgacgaccatcatcaccccgatgatgcggcacaccatcgagaacacgaccgccaacatcagcctcaccgccatcgccaaccaggccgcgatcctgatggggctggacaagggctggcccatctccaagatggacatcggcgtccccctcctggccctggggtgctacagccaggtgaaccccctcaccctgacggccgccgtgctgatgctcgtcgcgcactacgccatcatcggcccggggctgcaggccaaggccacccgcgaggcccagaagcgcaccgcggccggcatcatgaagaaccccaccgtggacgggatcgtggccatcgacctggaccccgtcgtgtacgacgccaagttcgagaagcagctcggccagatcatgctgctgatcctctgcacgtcccagatcctgctgatgcggaccacctgggccctctgcgagagcatcaccctggcgacgggccccctgaccaccctctgggaggggtccccgggcaagttctggaacaccacgatcgccgtgagcatggccaacatcttccgcgggagctacctggccggcgccggcctggcgttctccctcatgaagtccctcgggggcgggcggcgcgggaccggggcccagggcgagaccctgggcgagaagtggaagcggcagctcaaccagctgtccaagagcgagttcaacacctacaagcgctccgggatcatggaggtcgaccggagcgaggccaaggagggcctgcgccgcggggagacgaccaagcacgccgtgtcccgcggcaccgcgaagctccggtggttcgtggagcgcaacctggtcaagcccgaggggaaggtgatcgacctgggctgcggccgcggcgggtggagctactactgcgccgggctgaagaaggtgaccgaggtcaaggggtacacgaagggcgggctcggccacgaggagcccatccccatggccacctacgggtggaacctggtgaagctgcactccggcaaggacgtgttcttcatcccgcccgagaagtgcgacaccctcctgtgcgacatcggggagagctcccccaaccccaccatcgaggagggccgcacgctgcgggtcctcaagatggtggagccgtggctgcgcgggaaccagttctgcatcaagatcctgaacccctacatgcccagcgtggtcgagaccctcgagcagatgcagcggaagcacggcggcatgctggtgcgcaaccccctgtcccggaacagcacccacgagatgtactgggtgtcctgcgggaccggcaacatcgtcagcgccgtgaacatgacctcccgcatgctcctgaaccgcttcacgatggcccaccggaagccgacctacgagcgcgacgtggacctgggggcgggcacccggcacgtcgccgtggagcccgaggtggccaacctcgacatcatcggccagcgcatcgagaacatcaagcacgagcacaagagcacctggcactacgacgaggacaacccctacaagacgtgggcctaccacgggtcctacgaggtcaagcccagcggcagcgcctccagcatggtgaacggggtcgtgaagctgctgaccaagccgtgggacgtgatccccatggtcacccagatcgcgatgaccgacacgacccccttcggccagcagcgggtgttcaaggagaaggtggacacccgcacccccaaggccaagcgggggacggcccagatcatggaggtcaccgcccgctggctctggggcttcctgtcccggaacaagaagccgcgcatctgcacccgggaggagttcacccgcaaggtgcggagcaacgccgcgatcggcgccgtgttcgtcgacgagaaccagtggaactccgccaaggaggccgtggaggacgagcgcttctgggacctggtgcaccgggagcgcgagctccacaagcaggggaagtgcgcgacgtgcgtctacaacatgatgggcaagcgggagaagaagctgggggagttcggcaaggccaaggggagccgcgccatctggtacatgtggctgggcgcccggttcctcgagttcgaggccctgggcttcatgaacgaggaccactggttctcccgcgagaacagcctgtccggggtggagggcgaggggctccacaagctgggctacatcctgcgggacatcagcaagatccccgggggcaacatgtacgcggacgacaccgccggctgggacacccgcatcaccgaggacgacctccagaacgaggccaagatcacggacatcatggagcccgagcacgccctgctggccacctccatcttcaagctcacctaccagaacaaggtggtccgcgtgcagcggccggcgcgcaacgggaccgtgatggacgtcatcagccggcgcgaccagcggggctccggccaggtgggcacgtacggcctgaacaccttcaccaacatggaggcccagctgatccgccagatggagagcgaggggatcttcctcccctccgagctggagacccccaacctggccgagcgggtgctcgactggctggagaagcacggcgtcgagcgcctgaagcggatggccatcagcggggacgactgcgtggtgaagcccatcgacgaccgcttcgccacggcgctcaccgccctgaacgacatgggcaaggtccggaaggacatcccgcagtgggagccctccaaggggtggaacgactggcagcaggtccccttctgcagccaccacttccaccagctgatcatgaaggacggccgcgagatcgtggtcccctgccggaaccaggacgagctcgtgggccgcgcccgggtgagccagggggccggctggtccctgcgcgagaccgcctgcctgggcaagagctacgcgcagatgtggcagctcatgtacttccaccggcgcgacctgcggctggccgccaacgccatctgctccgcggtcccggtggactgggtgcccaccagccgcacgacctggtccatccacgcccaccaccagtggatgaccaccgaggacatgctcagcgtctggaaccgcgtgtggatcgaggagaacccctggatggaggacaagacgcacatctccagctggggcgacgtgccctacctggggaagcgggaggaccagtggtgcggctccctgatcggcctcaccgcccgcgccacctgggccaccaacatccaggtcgcgatcaaccaggtgcggcgcctgatcgggaacgagaactacctggactacatgaccagcatgaagcggttcaagaacgagtccgacccggagggcgccctctggtga

SEQ ID NO: 8341 - RNA, 9879 nt, synthetic construct
  misc_feature 1..9879: note = derived and/or modified CDS sequence (opt1) from DENV-1__FJ182034__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctcgcgccccacgtgggcctggggctggagacgcgcaccgagacctggatgagctccgagggcgcctggaagcagatccagcgggtggagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctcaccgactacggggccctgaccctggactgcagcccccggaccggcctcgacttcaacgagatggtcctgctgacgatgaaggagaagtcctggctcgtgcacaagcagtggttcctggacctgccgctcccctggaccagcggggcctccaccagccaggagacctggaaccggcaggacctgctggtgacgttcaagaccgcccacgcgaagaagcaggaggtcgtggtgctcggctcccaggagggcgccatgcacaccgccctgaccggggccacggagatccagaccagcggcaccaccacgatcttcgccgggcacctgaagtgccgcctcaagatggacaagctgaccctgaagggcatgtcctacgtcatgtgcaccgggagcttcaagctcgagaaggaggtggcggagacccagcacggcacggtgctggtccagatcaagtacgagggcaccgacgccccctgcaagatccccttctccacccaggacgagaagggggtgacccagaacggccggctgatcacggccaacccgatcgtgaccgacaaggagaagcccgtcaacatcgaggccgagccgcccttcggggagagctacatcgtgatcggcgcgggcgagaaggccctgaagctctcctggttcaagaaggggagctccatcggcaagatgttcgaggccaccgcccgcggggcccggcgcatggcgatcctgggcgacaccgcctgggacttcgggagcatcggcggcgtgttcacgtccgtcgggaagctggtgcaccagatcttcggcaccgcctacggggtgctgttcagcggcgtctcctggaccatgaagatcgggatcggcgtgctgctgacctggctcggcctgaacagccgctccacgagcctgtccatgacctgcatcgccgtggggctcgtcaccctgtacctgggcgtgatggtgcaggccgacagcgggtgcgtcatcaactggaagggccgggagctcaagtgcgggagcggcatcttcgtgaccaacgaggtgcacacgtggaccgagcagtacaagttccaggcggactccccgaagcgcctgagcgccgccatcggcaaggcctgggaggagggggtctgcggcatccggtccgccacccgcctggagaacatcatgtggaagcagatcagcaacgagctcaaccacatcctgctggagaacgacatgaagttcaccgtggtggtcggggacgtggcgggcatcctcgcccaggggaagaagatgatccggccccagcccatggagtacaagtactcctggaagtcctggggcaaggccaagatcatcggcgccgacgtgcagaacaccacgttcatcatcgacgggcccaacaccccggagtgccccgacgaccagcgcgcgtggaacatctgggaggtcgaggactacggcttcgggatcttcaccaccaacatctggctgaagctgcgggactcctacacccaggtgtgcgaccaccgcctcatgagcgccgccatcaaggactccaaggccgtgcacgccgacatgggctactggatcgagagcgagaagaacgagacctggaagctggcgcgggcctccttcatcgaggtcaagacctgcatctggcccaagagccacaccctgtggtccaacggcgtgctcgagagcgagatgatcatccccaagatctacgggggcccgatctcccagcacaactaccgccccgggtacttcacgcagaccgccggcccctggcacctggggaagctggagctcgacttcaacctgtgcgagggcaccaccgtggtcgtggacgagcactgcggcaaccgggggccgagcctgcgcacgaccaccgtgaccggcaagatcatccacgagtggtgctgccggtcctgcacgctgccgcccctccgcttcaagggggaggacggctgctggtacgggatggagatccggcccgtcaaggagaaggaggagaacctggtcaagagcatggtgagcgccggctccggcgaggtcgacagcttctccctcgggctgctgtgcatcagcatcatgatcgaggaggtgatgcgctcccggtggagccgcaagatgctcatgaccggcaccctggccgtgttcttcctgctcatcatggggcagctgacctggaacgacctgatccggctctgcatcatggtcggcgcgaacgcctccgaccgcatggggatgggcatgacgtacctggccctgatggccaccttcaagatgcgcccgatgctcgccgtgggcctgctgttccggcgcctcaccagccgggaggtgctgctgctcaccatcgggctgtccctggtcgcgagcgtggagctccccaactccctggaggagctgggcgacgggctcgccatgggcatcatgatcctgaagctgctcacggacttccagagccaccagctgtgggccaccctgctctccctgaccttcatcaagaccacgtacagcctgcactacgcctggaagaccatggcgatggtcctctccatcgtgagcctgttccccctgtgcctctccaccaccagccagaagacgacctggctgcccgtgctgctcggctccctggggtgcaagccgctgaccatgttcctcatcgccgagaacaagatctggggccgcaagagctggcccctgaacgaggggatcatggccgtcggcatcgtgagcatcctgctctccagcctgctgaagaacgacgtgcccctcgccgggcccctgatcgccggcggcatgctgatcgcgtgctacgtcatctccgggagctccgccgacctcagcctggagaaggccgccgaggtgtcctgggaggaggaggccgagcacagcggcgcgtcccacaacatcctggtggaggtccaggacgacgggaccatgaagatcaaggacgaggagcgggacgacacgctcaccatcctgctgaaggccaccctcctggccgtgagcggcgtgtacccgctgtccatccccgccaccctcttcgtctggtacttctggcagaagaagaagcagcgcagcggggtgctgtgggacacccccagcccgcccgaggtggagcgggccgtcctggacgacggcatctaccgcatcatgcagcggggcctgctcgggcgcagccaggtgggcgtgggggtcttccaggagaacgtgttccacacgatgtggcacgtgacccggggcgcggtcctgatgtaccaggggaagcgcctggagccctcctgggccagcgtgaagaaggacctcatctcctacggcggcgggtggcggctgcagggcagctggaacaccggggaggaggtgcaggtcatcgccgtggagcccggcaagaaccccaagaacgtgcagaccgcccccgggacgttcaagacctccgagggcgaggtcggcgccatcgcgctggacttcaagcccgggaccagcggcagccccatcgtgaaccgcgaggggaagatcgtgggcctctacggcaacggggtcgtgaccacgtccggcacctacgtgagcgccatcgcccaggccaaggcgtcccaggaggggcccctgccggagatcgagaacgaggtcttccggaagcgcaacctgaccatcatggacctccaccccggcagcgggaagacccggcgctacctgcccgccatcgtgcgggaggccatcaagcgcaagctgcggacgctcatcctggccccgacccgcgtggtcgcctccgagatggcggaggccctgaagggcatgcccatccgctaccagaccaccgccgtcaagagcgagcacacgggcaaggagatcgtggacctcatgtgccacgccaccttcaccatgcggctgctgtcccccgtccgcgtgcccaactacaacatgatcatcatggacgaggcccacttcaccgacccgagctccatcgcggcccgggggtacatcagcacgcgcgtgggcatgggggaggccgccgccatcttcatgaccgcgacgccgcccggctccgtcgaggccttcccccagagcaacgccgtgatccaggacgaggagcgggacatcccggagcgctcctggaacagcgggtacgagtggatcaccgacttccccggcaagacggtgtggttcgtcccctccatcaagagcggcaacgacatcgccaactgcctccggaagaacgggaagcgcgtgatccagctgtcccggaagaccttcgacaccgagtaccagaagaccaagaacaacgactgggactacgtggtcacgaccgacatcagcgagatgggcgcgaacttccgcgccgaccgggtgatcgacccccgccggtgcctgaagccggtgatcctcaaggacgggcccgagcgcgtcatcctggccggccccatgcccgtgaccgtcgcctccgccgcgcagcggcgcgggcggatcggccgcaaccacaacaaggagggcgaccagtacatctacatggggcagccgctgaacaacgacgaggaccacgcccactggaccgaggccaagatgctcctggacaacatcaacacgcccgagggcatcatccccgccctgttcgagcccgagcgggagaagtccgccgcgatcgacggggagtaccgcctccgcggcgaggcccggaagaccttcgtggagctgatgcgccgcggggacctgccggtgtggctcagctacaaggtcgcctccgagggcttccagtacagcgaccgccggtggtgcttcgacggcgagcgcaacaaccaggtgctggaggagaacatggacgtggagatctggaccaaggagggggagcggaagaagctgcgcccccggtggctcgacgcccgcacctactccgaccccctggccctgcgggagttcaaggagttcgcggccggccgccggagcgtctccggggacctcatcctggagatcggcaagctgccccagcacctcacgcagcgcgcccagaacgccctggacaacctggtgatgctccacaacagcgagcagggcgggcgggcgtaccgccacgccatggaggagctgccggacaccatcgagaccctgatgctcctggccctgatcgccgtgctcaccggcggggtcacgctgttcttcctgtccggccgggggctcggcaagaccagcatcggcctgctgtgcgtgatggcctccagcgtgctcctgtggatggcgtccgtcgagccccactggatcgccgccagcatcatcctggagttcttcctcatggtgctgctgatccccgagcccgaccgccagcggaccccgcaggacaaccagctcgcctacgtggtcatcgggctgctgttcatgatcctcaccgtggccgcgaacgagatgggcctgctggagaccacgaagaaggacctcgggatcggccacgtggccgtcgagaaccaccaccacgccgccatgctggacgtggacctgcaccccgcctccgcgtggaccctctacgccgtggccaccaccatcatcacgcccatgatgcgccacaccatcgagaacaccaccgccaacatcagcctgacggccatcgcgaaccaggccgccatcctgatggggctcgacaagggctggccgatctccaagatggacatcggcgtccccctgctggccctcgggtgctacagccaggtgaaccccctgaccctgaccgcggccgtgctcatgctggtcgcccactacgccatcatcggccccgggctgcaggccaaggcgacccgggaggcccagaagcgcacggccgccggcatcatgaagaacccgaccgtggacgggatcgtggccatcgacctcgaccccgtcgtgtacgacgcgaagttcgagaagcagctgggccagatcatgctgctcatcctgtgcacctcccagatcctgctcatgcgcaccacgtgggccctgtgcgagagcatcaccctggccaccggccccctcaccacgctgtgggaggggtcccccggcaagttctggaacaccaccatcgccgtgagcatggccaacatcttccgggggagctacctggcgggcgccggcctcgccttctccctgatgaagtccctcgggggcgggcgccgggggaccggggcccagggcgagacgctcggcgagaagtggaagcgccagctgaaccagctgtccaagagcgagttcaacacctacaagcggtccgggatcatggaggtcgaccgcagcgaggcgaaggagggcctcaagcgcggggagaccaccaagcacgccgtgtcccgcggcacggccaagctgcggtggttcgtggagcgcaacctggtcaagccggaggggaaggtgatcgacctgggctgcggccgcggcgggtggagctactactgcgccgggctcaagaaggtgaccgaggtcaaggggtacaccaagggcgggcccggccacgaggagcccatccccatggccacctacgggtggaacctggtgaagctgcactccggcaaggacgtgttcttcatcccgcccgagaagtgcgacacgctcctgtgcgacatcggggagagctcccccaaccccaccatcgaggagggccgcaccctgcgggtcctcaagatggtggagccgtggctgcgcgggaaccagttctgcatcaagatcctgaacccctacatgcccagcgtggtcgagaccctcgagcagatgcagcggaagcacggcggcatgctggtgcgcaaccccctgtcccggaacagcacgcacgagatgtactgggtgtcctgcgggaccggcaacatcgtcagcgcggtgaacatgacctcccgcatgctcctgaaccggttcaccatggcccaccgcaagccgacctacgagcgcgacgtggacctgggggccggcacgcggcacgtcgccgtggagcccgaggtggccaacctcgacatcatcggccagcgcatcgagaacatcaagcacgagcacaagagcacctggcactacgacgaggacaacccctacaagacctgggcgtaccacgggtcctacgaggtcaagcccagcggcagcgcctccagcatggtgaacggggtcgtgaagctgctgaccaagccgtgggacgtgatccccatggtcacgcagatcgccatgaccgacaccacccccttcggccagcagcgggtgttcaaggagaaggtggacacgcgcacccccaaggccaagcgggggaccgcccagatcatggaggtcaccgcgaagtggctctggggcttcctgtcccgcaacaagaagccgcggatctgcacgcgcgaggagttcacccggaaggtgcgcagcaacgccgccatcggcgccgtgttcgtcgacgagaaccagtggaactccgcgaaggaggccgtggaggacgagcggttctgggacctggtgcaccgcgagcgggagctccacaagcaggggaagtgcgcgacctgcgtctacaacatgatgggcaagcgcgagaagaagctgggggagttcggcaaggccaaggggagccgggccatctggtacatgtggctgggcgcgcgcttcctcgagttcgaggccctgggcttcatgaacgaggaccactggttctcccgggagaacagcctgtccggggtggagggcgaggggctccacaagctgggctacatcctgcgcgacatcagcaagatccccgggggcaacatgtacgccgacgacaccgccggctgggacacgcggatcaccgaggacgacctccagaacgaggccaagatcaccgacatcatggagcccgagcacgcgctgctggccaagtccatcttcaagctcacctaccagaacaaggtggtccgcgtgcagcggccggccaagaacgggacggtgatggacgtcatcagccgccgcgaccagcggggctccggccaggtgggcacctacggcctgaacaccttcaccaacatggaggcccagctgatccgccagatggagagcgaggggatcttctcccccagcgagctcgagacgcccaacctggccggccgggtgctggactggctcgagaagcacggggtcgagcgcctgaagcggatggcgatctccggcgacgactgcgtggtgaagcccatcgacgaccgcttcgccaccgccctgaccgccctcaacgacatggggaaggtccggaaggacatcccgcagtgggagcccagcaagggctggaacgactggcagcaggtccccttctgcagccaccacttccaccagctgatcatgaaggacggccgcgagatcgtggtcccctgccggaaccaggacgagctggtggggcgcgcccgggtgtcccagggcgcggggtggagcctccgcgagaccgcctgcctgggcaagtcctacgcccagatgtggcagctgatgtacttccaccggcgcgacctccggctggccgcgaacgccatctgcagcgccgtcccggtggactgggtgcccacgtcccgcaccacctggagcatccacgcccaccaccagtggatgaccacggaggacatgctgtccgtctggaaccgggtgtggatcgaggagaacccctggatggaggacaagacccacatcagctcctggggcgacgtgccctacctcggcaagcgcgaggaccagtggtgcggcagcctgatcgggctgaccgcccgggcgacctgggccacgaacatccaggtcgccatcaaccaggtgcgccgcctcatcggcaacgagaactacctggactacatgacctccatgaagcggttcaagaacgagagcgacccggagggggccctgtggtga

SEQ ID NO: 8342 - RNA, 9879 nt, synthetic construct
  misc_feature 1..9879: note = derived and/or modified CDS sequence (opt1) from DENV-1__FJ182036__SS-prME
  source 1..9879: mol_type = other RNA
agcgtgaccatgctgctgatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgggacaagcggtccgtggccctcgcgccccacgtgggcctggggctggagacccgcaccgagacctggatgagctccgagggcgcctggaagcagatccagcgggtcgagacgtgggccctccggcaccccgggttcaccgtgatcgccctgttcctggcccacgcgatcggcaccagcatcacccagaaggggatcatcttcatcctcctgatgctggccacgccctccatggccatgcggtgcgtgggcatcggcagccgcgacttcgtcgaggggctctccggcgccacctgggtggacgtggtcctggagcacgggagctgcgtgaccaccatggccaaggacaagcccacgctggacatcgagctcctgaagaccgaggtgaccaaccccgcggtcctgcggaagctctgcatcgaggccaagatctccaacaccacgaccgacagccgctgcccgacccagggcgaggccaccctggtggaggagcaggacgccaacttcgtgtgccggcgcacgttcgtcgaccggggctgggggaacggctgcgggctgttcggcaaggggtccctcatcacgtgcgccaagttcaagtgcgtgaccaagctggagggcaagatcgtgcagtacgagaacctgaagtacagcgtcatcgtgaccgtgcacacgggcgaccagcaccaggtcgggaacgagtccaccgagcacggcaccaccgcgaccatcacgccccaggcccccaccaccgagatccagctcaccgactacggggccctgacgctggactgcagcccccgcaccggcctcgacttcaacgagatggtgctgctgaccatgaaggagaagtcctggctcgtccacaagcagtggttcctggacctgcccctcccctggaccagcggggccagcacgtcccaggagacctggaaccggcaggacctgctggtgaccttcaagaccgcccacgcgaagaagcaggaggtggtcgtgctcggcagccaggagggcgccatgcacacggccctgaccggggccaccgagatccagacctccggcacgaccaccatcttcgccgggcacctgaagtgccgcctcaagatggacaagctgaccctgaagggcatgagctacgtgatgtgcacggggtccttcaagctcgagaaggagctggcggagacccagcacggcaccgtcctggtgcagatcaagtacgagggcaccgacgccccctgcaagatccccttcagcacgcaggacgagaagggggtgacccagaacggccggctgatcaccgccaacccgatcgtcaccgacaaggagaagcccgtgaacatcgaggccgagccgcccttcggggagtcctacatcgtgatcggcgcgggcgagaaggccctcaagctgagctggttcaagaaggggtccagcatcggcaagatgttcgaggccacggcccgcggggcccggcgcatggcgatcctgggcgacaccgcctgggacttcgggtccatcggcggcgtcttcaccagcgtggggaagctcgtgcaccagatcttcggcaccgcctacggggtcctgttctccggcgtgagctggacgatgaagatcgggatcggcgtgctgctcacctggctgggcctgaactcccgcagcacctccctcagcatgacctgcatcgccgtcgggctggtgacgctgtacctcggcgtgatggtccaggccgactccgggtgcgtgatcaactggaagggccgggagctgaagtgcgggagcggcatcttcgtgaccaacgaggtccacacctggaccgagcagtacaagttccaggcggacagcccgaagcgcctgtccgccgccatcggcaaggcctgggaggagggggtgtgcggcatccggagcgccacccgcctcgagaacatcatgtggaagcagatctccaacgagctgaaccacatcctgctcgagaacgacatgaagttcacggtggtcgtgggggacgtggcgggcatcctggcccaggggaagaagatgatccggccccagcccatggagtacaagtacagctggaagtcctggggcaaggccaagatcatcggcgccgacgtccagaacaccaccttcatcatcgacgggcccaacaccccggagtgccccgacgaccagcgcgcgtggaacatctgggaggtggaggactacggcttcgggatcttcacgaccaacatctggctgaagctccgggacagctacacccaggtgtgcgaccaccgcctgatgtccgccgccatcaaggacagcaaggccgtccacgccgacatgggctactggatcgagtccgagaagaacgagacctggaagctggcgcgggccagcttcatcgaggtgaagacgtgcatctggcccaagtcccacaccctctggagcaacggcgtgctggagtccgagatgatcatccccaagatctacgggggcccgatgagccagcacaactaccgccccgggtacttcacccagaccgccggcccctggcacctggggaagctcgagctggacttcgacctgtgcgagggcacgaccgtcgtggtggacgagcactgcggcaaccgggggccgtccctccgcaccaccacggtcaccggcaagatcatccacgagtggtgctgccggagctgcaccctgccgcccctgcgcttccgcggggaggacggctgctggtacgggatggagatccgccccgtgaaggagaaggaggagaacctcgtgaagtccatggtcagcgccggcagcggcgaggtggactccttcagcctggggctgctctgcatctccatcatgatcgaggaggtgatgcggagccgctggtcccggaagatgctgatgaccggcacgctggccgtcttcttcctcctgatcatggggcagctgacctggaacgacctcatccgcctgtgcatcatggtgggcgcgaacgccagcgaccgcatggggatgggcaccacctacctggccctcatggccacgttcaagatgcggccgatgttcgccgtgggcctgctgttccgccggctcacctcccgcgaggtcctgctgctcaccatcgggctgagcctggtggcgtccgtggagctccccaacagcctggaggagctgggcgacgggctcgccatgggcatcatgatcctgaagctgctcaccgacttccagtcccaccagctgtgggccacgctgctcagcctgaccttcatcaagaccaccttctccctgcactacgcctggaagacgatggcgatggtcctcagcatcgtgtccctgttccccctgtgcctcagcaccacctcccagaagaccacgtggctgcccgtcctgctcggcagcctggggtgcaagccgctgaccatgttcctcatcgccgagaacaagatctggggccggcgctcctggcccctgaacgaggggatcatggccgtgggcatcgtgagcatcctgctcagctccctgctgaagaacgacgtccccctcgccgggcccctgatcgccggcggcatgctgatcgcgtgctacgtgatcagcgggtccagcgccgacctctccctggagaaggccgccgaggtgagctgggaggaggaggccgagcactccggcgcgagccacaacatcctggtcgaggtgcaggacgacgggaccatgaagatcaaggacgaggagcgggacgacaccctcaccatcctgctgaaggccacgctcctggccgtgtccggcgtctacccgctgagcatccccgccaccctcttcgtgtggtacttctggcagaagaagaagcagcgctccggggtgctgtgggacacccccagcccgcccgaggtcgagcgggccgtgctggacgacggcatctaccgcatcatgcagcggggcctgctcgggcgctcccaggtgggcgtcggggtgttccaggagaacgtgttccacaccatgtggcacgtcacgcggggcgcggtgctgatgtaccaggggaagcgcctggagcccagctgggcctccgtgaagaaggacctcatcagctacggcggcgggtggcggctgcagggctcctggaacaccggggaggaggtccaggtgatcgccgtggagcccggcaagaaccccaagaacgtccagaccgcccccgggaccttcaagacgcccgagggcgaggtgggcgccatcgcgctggacttcaagcccgggaccagcggctcccccatcgtgaaccgcgaggggaagatcgtcggcctctacggcaacggggtggtgaccaccagcggcacgtacgtcagcgccatcgcccaggccaaggcgtcccaggaggggccgctgcccgagatcgaggacgaggtgttccggaagcgcaacctgaccatcatggacctccaccccggcagcgggaagacccggcgctacctgccggccatcgtgcgggaggccatcaagcgcaagctgcgcaccctcatcctggcccccacgcgggtcgtggcctccgagatggcggaggccctgaagggcatgcccatccgctaccagaccaccgccgtcaagagcgagcacaccggcaaggagatcgtcgacctcatgtgccacgccacgttcaccatgcggctgctgtcccccgtgcgcgtgccgaactacaacatgatcatcatggacgaggcccacttcaccgaccccagctccatcgcggcccgggggtacatcagcacccgcgtcggcatgggggaggccgccgccatcttcatgacggcgacgccgcccggctccgtggaggccttcccgcagagcaacgccgtgatccaggacgaggagcgggacatccccgagcgctcctggaacagcgggtacgagtggatcaccgacttccccggcaagaccgtctggttcgtgccctccatcaagagcggcaacgacatcgccaactgcctccggaagaacgggaagcgcgtgatccagctgtcccggaagacgttcgacaccgagtaccagaagaccaagaacaacgactgggactacgtcgtgaccacggacatcagcgagatgggcgcgaacttccgcgccgaccgggtgatcgacccgcgccggtgcctgaagcccgtcatcctcaaggacgggcccgagcgcgtgatcctggccggccccatgccggtgaccgtcgcctccgccgcgcagcggcgcgggcggatcggccgcaaccacaacaaggagggcgaccagtacatctacatggggcagcccctgaacaacgacgaggaccacgcccactggaccgaggccaagatgctcctggacaacatcaacacccccgagggcatcatccccgccctgttcgagccggagcgcgagaagtccgccgcgatcgacggggagtaccggctccgcggcgaggcccggaagacgttcgtggagctgatgcgccgcggggacctgcccgtctggctctcctacaaggtggccagcgagggcttccagtacagcgaccgccggtggtgcttcgacggcgagcgcaacaaccaggtgctggaggagaacatggacgtcgagatctggaccaaggagggggagcggaagaagctgcgcccccggtggctcgacgcccgcacctactccgaccccctggccctgcgggagttcaaggagttcgcggccggccgccggagcgtgtccggggacctcatcctggagatcggcaagctgccgcagcacctcacccagcgcgcccagaacgccctggacaacctggtgatgctccacaacagcgagcagggcgggcgggcgtaccgccacgccatggaggagctgcccgacacgatcgagaccctgatgctcctggccctgatcgccgtcctcaccggcggggtgaccctgttcttcctgtccggccgggggctcggcaagaccagcatcggcctgctgtgcgtgatggcctccagcgtcctcctgtggatggcgtccgtggagccccactggatcgccgccagcatcatcctggagttcttcctcatggtgctgctgatccccgagccggaccgccagcggacgccccaggacaaccagctcgcctacgtcgtgatcgggctgctgttcatgatcctcaccgtggccgcgaacgagatgggcctgctggagaccaccaagaaggacctcgggatcggccacgtcgccgtggagaaccaccaccacgccgccatgctggacgtggacctgcaccccgcctccgcgtggacgctctacgccgtcgccaccaccatcatcaccccgatgatgcgccacacgatcgagaacaccaccgccaacatcagcctgaccgccatcgcgaaccaggccgccatcctgatggggctcgacaagggctggcccatctccaagatggacatcggcgtgcccctgctggccctcgggtgctacagccaggtgaaccccctgacgctgaccgcggccgtcctcatgctggtggcccactacgccatcatcggcccggggctgcaggccaaggcgacccgcgaggcccagaagcggaccgccgccggcatcatgaagaaccccacggtggacgggatcgtcgccatcgacctcgaccccgtggtgtacgacgcgaagttcgagaagcagctgggccagatcatgctgctcatcctgtgcacctcccagatcctgctcatgcgcaccacctgggccctgtgcgagagcatcacgctggccaccggccccctcaccaccctgtgggaggggtccccgggcaagttctggaacacgaccatcgccgtcagcatggccaacatcttccgggggtcctacctggcgggcgccggcctcgccttcagcctgatgaagtccctcgggggcgggcgccgggggaccggggcccagggcgagaccctcggcgagaagtggaagcgccagctgaaccagctgtccaagagcgagttcaacacgtacaagcggtccgggatcatggaggtggaccgcagcgaggcgaaggagggcctcaagcgcggggagaccaccaagcacgccgtgtcccgcggcaccgccaagctgcggtggttcgtcgagcgcaacctggtgaagcccgaggggaaggtgatcgacctgggctgcggccgcgggggctggagctactactgcgccgggctcaagaaggtcacggaggtgaagggctacaccaagggcggccccggccacgaggagcccatcccgatggccacctacgggtggaacctggtgaagctgcactccggcaaggacgtcttcttcatcccgcccgagaagtgcgacaccctcctgtgcgacatcggggagagctcccccaacccgacgatcgaggagggccgcaccctgcgggtgctcaagatggtggagccctggctgcgcgggaaccagttctgcatcaagatcctgaacccctacatgcccagcgtcgtggagaccctcgagcagatgcagcggaagcacggcggcatgctggtgcgcaacccgctgtcccggaacagcacccacgagatgtactgggtctcctgcgggaccggcaacatcgtgagcgcggtgaacatgacgtcccgcatgctcctgaaccgcttcaccatggcccaccggaagcccacctacgagcgcgacgtcgacctgggggccggcacccggcacgtggccgtggagcccgaggtcgccaacctcgacatcatcggccagcgcatcgagaacatcaagcacgagcacaagagcacgtggcactacgacgaggacaacccctacaagacctgggcgtaccacgggtcctacgaggtgaagccgagcggctccgccagcagcatggtgaacggggtcgtgaagctgctgaccaagccctgggacgtcatccccatggtgacccagatcgccatgacggacaccacccccttcggccagcagcgggtgttcaaggagaaggtcgacacccgcacgccgaaggccaagcgggggaccgcccagatcatggaggtgaccgcgaagtggctctggggcttcctgtcccgcaacaagaagccccggatctgcacccgcgaggagttcacgcggaaggtgcgcagcaacgccgccatcggcgccgtcttcgtggacgagaaccagtggaactccgcgaaggaggccgtggaggacgagcggttctgggacctggtccaccgcgagcgggagctccacaagcaggggaagtgcgcgacctgcgtgtacaacatgatgggcaagcgcgagaagaagctgggggagttcggcaaggccaaggggagccgggccatctggtacatgtggctgggcgcgcgcttcctcgagttcgaggccctgggcttcatgaacgaggaccactggttctcccgggagaacagcctgtccggggtggagggcgaggggctccacaagctgggctacatcctgcgcgacatcagcaagatccccgggggcaacatgtacgccgacgacaccgccggctgggacacccggatcacggaggacgacctccagaacgaggcccgcatcaccgacatcatggagccggagcacgcgctgctggccaagtccatcttcaagctcacctaccagaacaaggtcgtgcgcgtgcagcggcccgccaagaacgggaccgtcatggacgtgatcagccgccgggaccagcgcggctccggccaggtggggacgtacggcctgaacaccttcaccaacatggaggcccagctgatccggcagatggagagcgaggggatcttctcccccagcgagctcgagacccccaacctggccaagcgcgtcctggactggctcgagaagtacggcgtggagcggctgaagcgcatggcgatctccggggacgactgcgtggtcaagccgatcgacgaccggttcgccacggccctgaccgccctcaacgacatgggcaaggtgcgcaaggacatcccccagtgggagcccagcaaggggtggaacgactggcagcaggtccccttctgctcccaccacttccaccagctgatcatgaaggacggccgggagatcgtcgtgccgtgccgcaaccaggacgagctggtgggccgggcccgcgtcagccagggggcgggctggagcctccgggagaccgcctgcctggggaagtcctacgcccagatgtggcagctgatgtacttccaccgccgggacctccgcctggccgcgaacgccatctgcagcgccgtgcccgtggactggatccccacctcccggacgacctggagcatccacgcccaccaccagtggatgaccaccgaggacatgctgtccgtctggaaccgcgtgtggatcgaggagaacccctggatggaggacaagacgcacatcagctcctggggcgacgtgccgtacctcgggaagcgcgaggaccagtggtgcggcagcctgatcggcctgaccgcccgggcgacctgggccaccaacatccaggtcgccatcaaccaggtgcgccggctcatcgggaacgagaactacctggactacatgacctccatgaagcgcttcaagaacgagagcgaccccgagggcgccctgtggtga

SEQ ID NO: 8343 - RNA, 9879 nt, synthetic construct
  misc_feature 1..9879: note = derived and/or modified CDS sequence (opt1) from DENV-1__FJ205876__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgggacaagcggtccgtggccctcgcgccccacgtgggcctggggctggagacccgcaccgagacctggatgagctccgagggcgcctggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtcgggaagctggtgcaccagatcttcggcaccgcctacggggtgctgttctccggcgtcagctggacgatgaagatcgggatcggcgtgctgctgacctggctcggcctgaactcccgcagcacctccctgagcatgacctgcatcgccgtggggctcgtcacgctgtacctgggcgtgatggtgcaggccgactccgggtgcgtcatcaactggaagggccgggagctcaagtgcgggagcggcatcttcgtgaccaacgaggtgcacacctggaccgagcagtacaagttccaggccgacagcccgaagcgcctgtccgcggccatcggcaaggcctgggaggagggggtctgcggcatccggagcgccacccgcctggagaacatcatgtggaagcagatctccaacgagctcaaccacatcctgctggagaacgacatgaagttcacggtggtggtcggggacgtggccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtcgaggactacggcttcgggatcttcacgaccaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacgtgcatctggcccaagtcccacaccctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcacgaccgtggtcgtggacgagcactgcggcaaccgggggccgtccctgcgcaccaccacggtgaccggcaagatcatccacgagtggtgctgccggagctgcaccctgccgcccctccgcttccgcggggaggacggctgctggtacgggatggagatccgccccgtcaaggagaaggaggagaacctggtgaagtccatggtgagcgccggcagcggcgaggtcgactccttcagcctcgggctgctgtgcatctccatcatgatcgaggaggtgatgcggagccgctggtcccggaagatgctcatgaccggcacgctggccgtgttcttcctgctcatcatggggcagctgacctggaacgacctgatccgcctctgcatcatggtcggcgccaacgcgagcgaccgcatggggatgggcaccacctacctggccctgatggccacgttcaagatgcggccgatgttcgccgtgggcctcctgttccgccggctgacctcccgcgaggtgctcctgctgaccatcgggctcagcctggtcgcctccgtggagctgcccaacagcctcgaggagctgggcgacgggctggcgatgggcatcatgatcctcaagctgctgaccgacttccagtcccaccagctctgggccacgctgctgagcctcaccttcatcaagaccaccttctccctgcactacgcctggaagacgatggccatggtcctgagcatcgtgtccctcttccccctgtgcctgagcaccacctcccagaagaccacgtggctccccgtgctgctgggcagcctcgggtgcaagccgctgaccatgttcctgatcgcggagaacaagatctggggccggcgctcctggcccctcaacgaggggatcatggccgtcggcatcgtgagcatcctgctgagctccctcctgaagaacgacgtgcccctggccgggcccctcatcgccggcggcatgctgatcgcctgctacgtcatcagcgggtccagcgcggacctgtccctcgagaaggccgccgaggtgagctgggaggaggaggccgagcactccggcgccagccacaacatcctggtggaggtccaggacgacgggaccatgaagatcaaggacgaggagcgggacgacaccctgaccatcctcctgaaggcgacgctgctcgccgtgtccggcgtgtacccgctgagcatccccgccaccctgttcgtctggtacttctggcagaagaagaagcagcgctccggggtgctctgggacacccccagcccgcccgaggtggagcgggccgtcctggacgacggcatctaccgcatcatgcagcggggcctgctggggcgctcccaggtgggcgtgggggtcttccaggagaacgtgttccacaccatgtggcacgtgacgcggggcgccgtcctcatgtaccaggggaagcgcctggagcccagctgggcgtccgtgaagaaggacctgatcagctacggcggcgggtggcggctccagggctcctggaacaccggggaggaggtgcaggtcatcgccgtggagcccggcaagaaccccaagaacgtgcagaccgcccccgggaccttcaagacgcccgagggcgaggtcggcgccatcgccctggacttcaagcccgggaccagcggctcccccatcgtgaaccgcgaggggaagatcgtgggcctgtacggcaacggggtcgtgaccaccagcggcacgtacgtgagcgcgatcgcccaggccaaggcctcccaggaggggccgctccccgagatcgaggacgaggtcttccggaagcgcaacctgaccatcatggacctgcaccccggcagcgggaagacccggcgctacctcccggcgatcgtgcgggaggccatcaagcgcaagctgcgcaccctgatcctcgcccccacgcgggtggtcgcctccgagatggccgaggcgctgaagggcatgcccatccgctaccagaccaccgccgtcaagagcgagcacaccggcaaggagatcgtggacctgatgtgccacgccacgttcaccatgcggctcctgtcccccgtccgcgtgccgaactacaacatgatcatcatggacgaggcccacttcaccgaccccagctccatcgccgcgcgggggtacatcagcacccgcgtgggcatgggggaggccgccgccatcttcatgacggccacgccgcccggctccgtcgaggcgttcccgcagagcaacgccgtgatccaggacgaggagcgggacatccccgagcgctcctggaacagcgggtacgagtggatcaccgacttccccggcaagaccgtgtggttcgtcccctccatcaagagcggcaacgacatcgccaactgcctgcggaagaacgggaagcgcgtgatccagctctcccggaagacgttcgacaccgagtaccagaagaccaagaacaacgactgggactacgtggtcaccacggacatcagcgagatgggcgccaacttccgcgcggaccgggtgatcgacccgcgccggtgcctgaagcccgtgatcctgaaggacgggcccgagcgcgtcatcctcgccggccccatgccggtgaccgtcgcctccgccgcccagcggcgcgggcggatcggccgcaaccacaacaaggagggcgaccagtacatctacatggggcagcccctgaacaacgacgaggaccacgcgcactggaccgaggccaagatgctgctcgacaacatcaacacccccgagggcatcatccccgccctgttcgagccggagcgcgagaagtccgccgccatcgacggggagtaccggctgcgcggcgaggcgcggaagacgttcgtggagctcatgcgccgcggggacctgcccgtgtggctgtcctacaaggtcgccagcgagggcttccagtacagcgaccgccggtggtgcttcgacggcgagcgcaacaaccaggtgctcgaggagaacatggacgtggagatctggaccaaggagggggagcggaagaagctgcgcccccggtggctggacgcccgcacctactccgaccccctcgccctgcgggagttcaaggagttcgccgcgggccgccggagcgtctccggggacctgatcctcgagatcggcaagctgccgcagcacctgacccagcgcgcccagaacgccctcgacaacctggtgatgctgcacaacagcgagcagggcgggcgggcctaccgccacgcgatggaggagctccccgacacgatcgagaccctgatgctgctcgccctgatcgccgtgctgaccggcggggtcaccctcttcttcctgtccggccgggggctgggcaagaccagcatcggcctcctgtgcgtgatggcctccagcgtgctgctctggatggcctccgtcgagccccactggatcgcggccagcatcatcctggagttcttcctgatggtgctcctgatccccgagccggaccgccagcggacgccccaggacaaccagctggcctacgtggtcatcgggctcctgttcatgatcctgaccgtggccgccaacgagatgggcctcctggagaccaccaagaaggacctggggatcggccacgtggcggtcgagaaccaccaccacgccgccatgctcgacgtggacctgcaccccgcctccgcctggacgctgtacgcggtggccaccaccatcatcaccccgatgatgcgccacacgatcgagaacaccaccgccaacatcagcctcaccgccatcgccaaccaggcggccatcctgatggggctggacaagggctggcccatctccaagatggacatcggcgtccccctcctggccctggggtgctacagccaggtgaaccccctcacgctgaccgccgcggtgctgatgctcgtcgcccactacgccatcatcggcccggggctgcaggccaaggccacccgcgaggcgcagaagcggaccgccgccggcatcatgaagaaccccacggtggacgggatcgtggccatcgacctggaccccgtcgtgtacgacgccaagttcgagaagcagctcggccagatcatgctgctgatcctctgcacctcccagatcctgctgatgcgcaccacctgggcgctctgcgagagcatcacgctggccaccggccccctgaccaccctctgggaggggtccccgggcaagttctggaacacgaccatcgccgtgagcatggccaacatcttccgggggtcctacctggccggcgcgggcctggccttcagcctcatgaagtccctcgggggcgggcgccgggggaccggggcccagggcgagaccctgggcgagaagtggaagcgccagctcaaccagctgtccaagagcgagttcaacacgtacaagcggtccgggatcatggaggtcgaccgcagcgaggccaaggagggcctgaagcgcggggagaccaccaagcacgcggtgtcccgcggcaccgccaagctccggtggttcgtggagcgcaacctggtcaagcccgaggggaaggtgatcgacctgggctgcggccgcggcgggtggagctactactgcgccgggctgaagaaggtgacggaggtcaaggggtacaccaagggcggccccggccacgaggagcccatcccgatggccacctacgggtggaacctcgtgaagctgcactccggcaaggacgtgttcttcatcccgcccgagaagtgcgacaccctgctctgcgacatcggggagagctcccccaacccgacgatcgaggagggccgcaccctgcgggtcctgaagatggtggagccctggctccgcgggaaccagttctgcatcaagatcctgaacccctacatgcccagcgtggtcgagaccctggagcagatgcagcggaagcacggcggcatgctcgtgcgcaacccgctgtcccggaacagcacccacgagatgtactgggtgtcctgcgggaccggcaacatcgtcagcgccgtgaacatgacgtcccgcatgctgctcaaccgcttcaccatggcgcaccggaagcccacctacgagcgcgacgtggacctgggggccggcacccggcacgtcgccgtggagcccgaggtggccaacctggacatcatcggccagcgcatcgagaacatcaagcacgagcacaagagcacgtggcactacgacgaggacaacccctacaagacctgggcctaccacgggtcctacgaggtcaagccgagcggctccgcgagcagcatggtgaacggggtcgtgaagctcctgaccaagccctgggacgtgatccccatggtcacccagatcgccatgacggacaccacccccttcggccagcagcgggtgttcaaggagaaggtggacacccgcacgccgaaggccaagcgggggaccgcccagatcatggaggtcaccgccaagtggctgtggggcttcctctcccgcaacaagaagccccggatctgcacccgcgaggagttcacgcggaaggtgcgcagcaacgcggccatcggcgccgtgttcgtcgacgagaaccagtggaactccgccaaggaggcggtggaggacgagcggttctgggacctggtgcaccgcgagcgggagctgcacaagcaggggaagtgcgcgacctgcgtctacaacatgatgggcaagcgcgagaagaagctcggggagttcggcaaggccaaggggagccgggccatctggtacatgtggctgggcgcccgcttcctggagttcgaggcgctcggcttcatgaacgaggaccactggttcaaccgggagaactccctgagcggggtggagggcgaggggctgcacaagctcggctacatcctgcgcgacatctccaagatccccgggggcaacatgtacgccgacgacaccgccggctgggacacccggatcacggaggacgacctgcagaacgaggcccgcatcaccgacatcatggagccggagcacgccctcctggcgcgcagcatcttcaagctgacctaccagaacaaggtggtccgggtgcagcgccccgccaagaacgggaccgtgatggacgtcatctcccggcgcgaccagcggggcagcggccaggtggggacgtacggcctcaacaccttcaccaacatggaggcccagctgatccgccagatggagtccgaggggatcttcagcccctccgagctggagacccccaacctcgccgagcgggtgctggactggctggagaagtacggcgtcgagcgcctcaagcggatggccatcagcggggacgactgcgtggtgaagccgatcgacgaccgcttcgcgacggccctgaccgccctgaacgacatgggcaaggtccggaaggacatcccccagtgggagccctccaaggggtggaacgactggcagcaggtccccttctgcagccaccacttccaccagctcatcatgaaggacggccgcgagatcgtggtcccgtgccggaaccaggacgagctggtgggccgcgcccgggtgtcccagggggccggctggagcctgcgcgagaccgcgtgcctcggcaagagctacgcccagatgtggcagctgatgtacttccaccggcgcgacctgcggctcgccgccaacgcgatctgctccgccgtccccgtggactggatccccaccagccgcacgacctggtccatccacgcccaccaccagtggatgaccaccgaggacatgctgagcgtgtggaaccgcgtctggatcgaggagaacccctggatggaggacaagacgcacatctccagctggggcgacgtgccgtacctggggaagcgggaggaccagtggtgcggctccctcatcggcctgaccgcccgcgccacctgggcgaccaacatccaggtggccatcaaccaggtccggcgcctgatcgggaacgagaactacctcgactacatgaccagcatgaagcggttcaagaacgagtccgaccccgagggcgccctgtggtga

SEQ ID NO: 8344 - RNA, 9879 nt, synthetic construct
  misc_feature 1..9879: note = derived and/or modified CDS sequence (opt1) from DENV-1__FJ024455__SS-prME
  source 1..9879: mol_type = other RNA
agcgtgaccatgctgctgatgctgatgcccaccgccctggccttccacctcaccacccggggcggggagccgcacatgatcgtgagcaagcaggagcggggcaagagcctgctgttcaagaccagcgtgggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgggacaagcggtccgtggccctcgcgccccacgtcggcctggggctggagacccgcaccgagacctggatgagctccgagggcgcctggaagcagatccagcgggtggagacgtgggcgctccggcaccccgggttcaccgtgatcgccctgttcctggcccacgccatcggcaccagcatcacccagaaggggatcatcttcatcctcctgatgctggtcacgccctccatggcgatgcggtgcgtgggcatcggcagccgcgacttcgtggaggggctctccggcgccacctgggtcgacgtggtgctggagcacgggagctgcgtcaccaccatggccaaggacaagcccacgctggacatcgagctcctgaagaccgaggtgaccaaccccgccgtgctgcggaagctctgcatcgaggccaagatctccaacaccacgaccgacagccgctgcccgacccagggcgaggcgaccctggtcgaggagcaggacgccaacttcgtgtgccggcgcacgttcgtggaccggggctgggggaacggctgcgggctgttcggcaaggggtccctcatcacgtgcgccaagttcaagtgcgtcaccaagctggagggcaagatcgtgcagtacgagaacctgaagtacagcgtgatcgtcaccgtgcacacgggcgaccagcaccaggtcgggaacgagtccaccgagcacggcaccaccgccaccatcacgccccaggcccccaccaccgagatccagctcaccgactacggggcgctgacgctggactgcagcccccgcaccggcctcgacttcaacgagatggtgctgctgaccatgaaggagaagtcctggctcgtgcacaagcagtggttcctggacctgccgctcccctggaccagcggggccagcacgtcccaggagacctggaaccggcaggacctgctggtcaccttcaagaccgcccacgccaagaagcaggaggtggtggtcctcggcagccaggagggcgccatgcacacggcgctgaccggggccaccgagatccagacctccggcacgaccaccatcttcgccgggcacctgaagtgccgcctcaagatggacaagctgaccctgaagggcatgagctacgtgatgtgcacggggtccttcaagctcgagaaggagctggccgagacccagcacggcaccgtgctggtccagatcaagtacgagggcaccgacgccccctgcaagatccccttcagcacgcaggacgagaagggggtgacccagaacggccggctgatcaccgcgaacccgatcgtgaccgacaaggagaagcccgtcaacatcgaggccgagccgcccttcggggagtcctacatcgtgatcggcgccggcgagaaggccctcaagctgagctggttcaagaaggggtccagcatcggcaagatgttcgaggcgacggcccgcggggcccggcgcatggccatcctgggcgacaccgcctgggacttcgggtccatcggcggcgtgttcaccagcgtcgggaagctcgtgcaccagatcttcggcaccgcgtacggggtgctgttctccggcgtcagctggacgatgaagatcgggatcggcgtgctgctcacctggctgggcctgaactcccgcagcacctccctcagcatgacctgcatcgccgtggggctggtcacgctgtacctcggcgtgatggtgcaggccgactccgggtgcgtcatcaactggaagggccgggagctgaagtgcgggagcggcatcttcgtgaccaacgaggtgcacacctggaccgagcagtacaagttccaggccgacagcccgaagcgcctgtccgccgcgatcggcaaggcctgggaggagggggtctgcggcatccggagcgccacccgcctcgagaacatcatgtggaagcagatctccaacgagctgaaccacatcctgctcgagaacgacatgaagttcacggtggtggtcggggacgtggccggcatcctggcccaggggaagaagatgatccggccccagcccatggagtacaagtacagctggaagtcctggggcaaggcgaagatcatcggcgccgacgtgcagaacaccaccttcatcatcgacgggcccaacaccccggagtgccccgacgaccagcgcgcctggaacatctgggaggtcgaggactacggcttcgggatcttcacgaccaacatctggctgaagctccgggacagctacacccaggtgtgcgaccaccgcctgatgtccgccgcgatcaaggacagcaaggccgtgcacgccgacatgggctactggatcgagtccgagaagaacgagacctggaagctggcccgggccagcttcatcgaggtcaagacgtgcatctggcccaagtcccacaccctctggagcaacggcgtgctggagtccgagatgatcatccccaagatctacgggggcccgatcagccagcacaactaccgccccgggtacttcacccagaccgcgggcccctggcacctggggaagctcgagctggacttcgacctgtgcgagggcacgaccgtggtcgtggacgagcactgcggcaaccgggggccgtccctccgcaccaccacggtgaccggcaagatcatccacgagtggtgctgccggagctgcaccctgccgcccctgcgcttccgcggggaggacggctgctggtacgggatggagatccgccccgtcaaggagaaggaggagaacctcgtgaagtccatggtgagcgccggcagcggcgaggtcgactccttcagcctggggctgctctgcatctccatcatgatcgaggaggtgatgcggagccgctggtcccggaagatgctgatgaccggcacgctggccgtgttcttcctcctgatcatggggcagctgacctggaacgacctcatccgcctgtgcatcatggtcggcgccaacgccagcgaccgcatggggatgggcaccacctacctggcgctcatggccacgttcaagatgcggccgatgttcgccgtgggcctgctgttccgccggctcacctcccgcgaggtgctgctgctcaccatcgggctgagcctggtcgcctccgtggagctccccaacagcctggaggagctgggcgacgggctcgccatgggcatcatgatcctgaagctgctcaccgacttccagtcccaccagctgtgggcgacgctgctcagcctgaccttcatcaagaccaccttctccctgcactacgcctggaagacgatggccatggtcctcagcatcgtgtccctgttccccctgtgcctcagcaccacctcccagaagaccacgtggctgcccgtgctgctcggcagcctggggtgcaagccgctgaccatgttcctcatcgccgagaacaagatctggggccggcgctcctggcccctgaacgaggggatcatggcggtcggcatcgtgagcatcctgctcagctccctgctgaagaacgacgtgcccctcgccgggcccctgatcgccggcggcatgctgatcgcctgctacgtcatcagcgggtccagcgccgacctctccctggagaaggcggccgaggtgagctgggaggaggaggccgagcactccggcgccagccacaacatcctggtggaggtccaggacgacgggaccatgaagatcaaggacgaggagcgggacgacaccctcaccatcctgctgaaggccacgctcctggcggtgtccggcgtgtacccgctgagcatccccgccaccctcttcgtctggtacttctggcagaagaagaagcagcgctccggggtgctgtgggacacccccagcccgcccgaggtggagcgggccgtcctggacgacggcatctaccgcatcatgcagcggggcctgctcgggcgctcccaggtgggcgtgggggtcttccaggagaacgtgttccacaccatgtggcacgtgacgcggggcgccgtcctgatgtaccaggggaagcgcctggagcccagctgggcctccgtgaagaaggacctcatcagctacggcggcgggtggcggctgcagggctcctggaacaccggggaggaggtgcaggtcatcgcggtggagcccggcaagaaccccaagaacgtgcagaccgcccccgggaccttcaagacgcccgagggcgaggtcggcgccatcgccctggacttcaagcccgggaccagcggctcccccatcgtgaaccgcgaggggaagatcgtgggcctctacggcaacggggtcgtgaccaccagcggcacgtacgtgagcgccatcgcgcaggccaaggcctcccaggaggggccgccgcccgagatcgaggacgaggtcttccggaagcgcaacctgaccatcatggacctgcacccgggcagcgggaagacccggcgctacctccccgccatcgtgcgggaggcgatcaagcgcaagctgcgcaccctgatcctcgcccccacgcgggtggtcgcctccgagatggccgaggccctgaagggcatgcccatccgctaccagaccaccgcggtcaagagcgagcacaccggcaaggagatcgtggacctgatgtgccacgccacgttcaccatgcggctcctgtccccggtccgcgtgcccaactacaacatgatcatcatggacgaggcccacttcaccgaccccagctccatcgccgcccgggggtacatcagcacccgcgtgggcatgggggaggcggccgccatcttcatgacggccacgccgcccggctccgtcgaggccttcccccagagcaacgcggtgatccaggacgaggagcgggacatccccgagcgctcctggaacagcgggtacgagtggatcaccgacttccccggcaagaccgtgtggttcgtcccctccatcaagagcggcaacgacatcgccaactgcctgcggaagaacgggaagcgcgtgatccagctctcccggaagacgttcgacaccgagtaccagaagaccaagaacaacgactgggactacgtggtcaccacggacatcagcgagatgggcgccaacttccgcgccgaccgggtgatcgacccccgccggtgcctgaagcccgtgatcctgaaggacgggcccgagcgcgtcatcctcgcgggcccgatgcccgtgaccgtcgcctccgccgcccagcggcgcgggcggatcggccgcaaccacaacaaggagggcgaccagtacatctacatggggcagcccctgaacaacgacgaggaccacgcccactggaccgaggcgaagatgctgctcgacaacatcaacacccccgagggcatcatcccggccctgttcgagcccgagcgcgagaagtccgccgccatcgacggggagtaccggctgcgcggcgaggcccggaagacgttcgtggagctcatgcgccgcggggacctgcccgtgtggctgtcctacaaggtcgcgagcgagggcttccagtacagcgaccgccggtggtgcttcgacggcgagcgcaacaaccaggtgctcgaggagaacatggacgtggagatctggaccaaggagggggagcggaagaagctgcgcccccggtggctggacgcccgcacctactccgacccgctcgccctgcgggagttcaaggagttcgccgccggccgccggagcgtctccggggacctgatcctcgagatcggcaagctgccccagcacctgacccagcgcgcgcagaacgccctcgacaacctggtgatgctgcacaacagcgagcagggcgggcgggcctaccgccacgccatggaggagctccccgacacgatcgagaccctgatgctgctcgcgctgatcgccgtgctgaccggcggggtcaccctcttcttcctgtccggccgggggctgggcaagaccagcatcggcctcctgtgcgtgatggcctccagcgtgctgctctggatggcctccgtcgagccccactggatcgccgcgagcatcatcctggagttcttcctgatggtgctcctgatcccggagcccgaccgccagcggacgccccaggacaaccagctggcctacgtggtcatcgggctcctgttcatgatcctgaccgtggccgccaacgagatgggcctcctggagaccaccaagaaggacctggggatcggccacgtggccgtcgagaaccaccaccacgcggccatgctcgacgtggacctgcacccggcctccgcctggacgctgtacgccgtggcgaccaccatcatcacccccatgatgcgccacacgatcgagaacaccaccgccaacatcagcctcaccgccatcgccaaccaggccgcgatcctgatggggctggacaagggctggcccatctccaagatggacatcggcgtccccctcctggccctggggtgctacagccaggtgaacccgctcacgctgaccgccgccgtgctgatgctcgtcgcgcactacgccatcatcggccccgggctgcaggccaaggccacccgcgaggcccagaagcggaccgcggccggcatcatgaagaaccccacggtggacgggatcgtggccatcgacctggaccccgtcgtgtacgacgccaagttcgagaagcagctcggccagatcatgctgctgatcctctgcacctcccagatcctgctgatgcgcaccacctgggccctctgcgagagcatcacgctggcgaccggcccgctgaccaccctctgggaggggtcccccggcaagttctggaacacgaccatcgccgtgagcatggccaacatcttccgggggtcctacctggccggcgccggcctggcgttcagcctcatgaagtccctcgggggcgggcgccgggggaccggggcccagggcgagaccctgggcgagaagtggaagcgccagctcaaccagctgtccaagagcgagttcaacacgtacaagcggtccgggatcatggaggtcgaccgcagcgaggccaaggagggcctgaagcgcggggagaccaccaagcacgccgtgtcccgcggcaccgcgaagctccggtggttcgtggagcgcaacctggtcaagcccgaggggaaggtgatcgacctgggctgcggccgcgggggctggagctactactgcgccgggctgaagaaggtgacggaggtcaagggctacaccaagggcggccccggccacgaggagccgatccccatggccacctacgggtggaacctcgtgaagctgcactccggcaaggacgtgttcttcatcccgcccgagaagtgcgacaccctgctctgcgacatcggggagagctccccgaaccccacgatcgaggagggccgcaccctgcgggtcctgaagatggtggagccctggctccgcgggaaccagttctgcatcaagatcctgaacccctacatgccgagcgtggtcgagaccctggagcagatgcagcggaagcacggcggcatgctcgtgcgcaaccccctgtcccggaacagcacccacgagatgtactgggtgtcctgcgggaccggcaacatcgtcagcgccgtgaacatgacgtcccgcatgctgctcaaccgcttcaccatggcccaccggaagcccacctacgagcgcgacgtggacctgggggcgggcacccggcacgtcgccgtggagcccgaggtggccaacctggacatcatcggccagcgcatcgagaacatcaagcacgagcacaagagcacgtggcactacgacgaggacaacccgtacaagacctgggcctaccacgggtcctacgaggtcaagcccagcggctccgccagcagcatggtgaacggggtcgtgaagctcctgaccaagccctgggacgtgatccccatggtcacccagatcgcgatgacggacaccaccccgttcggccagcagcgggtgttcaaggagaaggtggacacccgcacgcccaaggccaagcgggggaccgcccagatcatggaggtcaccgccaagtggctgtggggcttcctctcccgcaacaagaagccccggatctgcacccgcgaggagttcacgcggaaggtgcgcagcaacgccgcgatcggcgccgtgttcgtcgacgagaaccagtggaactccgccaaggaggccgtggaggacgagcggttctgggacctggtgcaccgcgagcgggagctgcacaagcaggggaagtgcgcgacctgcgtctacaacatgatgggcaagcgcgagaagaagctcggggagttcggcaaggccaaggggagccgggccatctggtacatgtggctgggcgcccgcttcctggagttcgaggccctcggcttcatgaacgaggaccactggttctcccgggagaacagcctgtccggggtggagggcgaggggctgcacaagctcggctacatcctgcgcgacatcagcaagatccccgggggcaacatgtacgcggacgacaccgccggctgggacacccggatcacggaggacgacctgcagaacgaggcccgcatcaccgacatcatggagcccgagcacgccctcctggccaagtccatcttcaagctgacctaccagaacaaggtggtccgcgtgcagcggcccgcgaagaacgggaccgtgatggacgtcatcagccgccgggaccagcgcggctccggccaggtggggacgtacggcctcaacaccttcaccaacatggaggcccagctgatccggcagatggagagcgaggggatcttctcccccagcgagctggagaccccgaacctcgccgagcgcgtgctggactggctggagaagtacggcgtcgagcggctcaagcgcatggccatctccggggacgactgcgtggtgaagcccatcgacgaccggttcgccacggcgctgaccgccctgaacgacatgggcaaggtccgcaaggacatcccccagtgggagcccagcaaggggtggaacgactggcagcaggtcccgttctgctcccaccacttccaccagctcatcatgaaggacggccgggagatcgtggtcccctgccgcaaccaggacgagctggtgggccgggcccgcgtgagccagggggccggctggagcctgcgggagaccgcctgcctcgggaagtcctacgcgcagatgtggcagctgatgtacttccaccgccgggacctgcgcctcgccgccaacgccatctgcagcgcggtccccgtggactggatccccacctcccggacgacctggagcatccacgcccaccaccagtggatgaccaccgaggacatgctgtccgtgtggaaccgcgtctggatcgaggagaacccgtggatggaggacaagacgcacatcagctcctggggcgacgtgccctacctggggaagcgcgaggaccagtggtgcggcagcctcatcggcctgaccgcccgggccacctgggccaccaacatccaggtggcgatcaaccaggtccgccggctgatcgggaacgagaactacctcgactacatgacctccatgaagcgcttcaagaacgagagcgaccccgagggcgccctgtggtga

SEQ ID NO: 8345 - RNA, 9879 nt, synthetic construct
  misc_feature 1..9879: note = derived and/or modified CDS sequence (opt1) from DENV-1__FJ024456__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgcgggggtgaacatgtgcatcctcatcgccatggacctgggcgagctgtgcgaggacaccatgacctacaagtgcccccggatcaccgaggccgagcccgacgacgtggactgctggtgcaacgccaccgacacctgggtgacctacgggacctgcagccagaccggcgagcaccggcgcgacaagcggagcgtggccctcgcgccccacgtgggcctggggctggagacgcgcaccgagacctggatgtccagcgagggcgcctggaagcagatccagcgggtcgagacctgggccctccgccaccccgggttcacggtgatcgccctgttcctggcgcacgccatcggcacctccatcacccagaaggggatcatcttcatcctcctgatgctggtgacccccagcatggccatgcggtgcgtcggcatcggctcccgcgacttcgtggaggggctcagcggcgccacgtgggtggacgtcgtgctggagcacgggtcctgcgtgaccaccatggccaaggacaagcccaccctggacatcgagctcctgaagacggaggtcaccaaccccgcggtgctgcggaagctctgcatcgaggccaagatcagcaacaccaccacggactcccgctgccccacccagggcgaggccaccctgatggaggagcaggacgccaacttcgtgtgccggcgcaccttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacaccggcgaccagcaccaggtcgggaacgagagcacggagcacggcaccaccgcgaccatcacgccccaggcccccacgtccgagatccagctcaccgactacggggccctgaccctggactgcagcccccgcaccggcctcgacttcaacgagatggtgctgctgacgatgaaggagaagtcctggctcgtccacaagcagtggttcctggacctgccgctcccctggaccagcggggccagcacctcccaggagacctggaaccggcaggacctgctggtgacgttcaagaccgcccacgcgaagaagcaggaggtggtcgtgctcggcagccaggagggcgccatgcacaccgccctgaccggggccacggagatccagacctccggcaccaccacgatcttcgccgggcacctgaagtgccgcctcaagatggacaagctgaccctgaagggcatgagctacgtgatgtgcaccgggtccttcaagctcgagaaggaggtcgcggagacccagcacggcacggtgctggtgcagatcaagtacgagggcaccgacgccccctgcaagatccccttcagcacccaggacgagaagggggtcatccagaacggccggctgatcaccgccaacccgatcgtgacggacaaggagaagcccgtgaacatcgaggccgagccgcccttcggggagtcctacatcgtcatcggcgtgggcgagaaggcgctgaagctcagctggttcaagaaggggtccagcatcggcaagatgttcgaggccaccgcccgcggggcccggcgcatggccatcctgggcgacaccgcgtgggacttcgggtccatcggcggcgtgttcaccagcgtcgggaagctggtgcaccagatcttcggcacggcctacggggtcctgttctccggcgtcagctggaccatgaagatcgggatcggcgtgctgctgacctggctcggcctgaactcccgcagcacctccctgagcatgacgtgcatcgccgtggggctcgtcaccctgtacctgggcgtgatggtgcaggccgactccgggtgcgtcatcaactggaagggccgggagctcaagtgcgggagcggcatcttcgtgaccaacgaggtgcacacctggacggagcagtacaagttccaggccgacagcccgaagcgcctgtccgcggccatcggcaaggcctgggaggagggggtctgcggcatccggagcgccacccgcctggagaacatcatgtggaagcagatctccaacgagctcaaccacatcctgctggagaacgacatgaagttcaccgtggtggtcggggacgtggtgggcatcctcgcccaggggaagaagatgatccggccccagcccatggagcacaagtacagctggaagtcctggggcaaggcgaagatcatcggcgccgacgtccagaacaccaccttcatcatcgacgggcccaacacgccggagtgccccgacgaccagcgcgcctggaacatctgggaggtggaggactacggcttcgggatcttcaccaccaacatctggctgaagctgcgggacagctacacccaggcctgcgaccaccgcctcatgtccgcggccatcaaggacagcaaggccgtgcacgccgacatgggctactggatcgagtccgagaagaacgagacgtggaagctggcccgggcgagcttcatcgaggtcaagacctgcatctggcccaagtcccacaccctgtggagcaacggcgtgctcgagtccgagatggtgatccccaagatctacgggggcccgatcagccagcacaactaccgccccgggtacttcacccagacggccggcccctggcacctggggaagctggagctcgacttcgacctgtgcgagggcaccaccgtcgtggtggacgagcactgcggcaaccgggggccgtccctgcgcaccacgaccgtcaccggcaagatcatccacgagtggtgctgccggagctgcaccctgccgcccctccgcttcaagggggaggacggctgctggtacgggatggagatccggcccgtgaaggagaaggaggagaacctggtgaagtccatggtcagcgccggcagcggcgaggtggactccttcagcctcgggctgctgtgcatctccatcatgatcgaggaggtgatgcgcagccggtggtcccgcaagatgctcatgacgggcaccctggccgtcttcctgctcctgatcatggggcagctgacctggaacgacctcatccggctgtgcatcatggtgggcgccaacgcgagcgaccgcatggggatgggcaccacgtacctggccctcatggccaccttcaagatgcgcccgatgttcgccgtggggctgctgttccggcgcctcacctcccgggaggtcctgctgctcaccatcgggctgagcctggtggcctccgtcgagctccccaacagcctggaggagctgggcgacgggctcgcgatgggcatcatgatcctgaagctgctcacggacttccagtcccaccagctgtgggccaccctgctcagcctgaccttcatcaagaccacgctgtccctccactacgcctggaagaccatggccatggtgctgagcatcgtgtccctgttccccctctgcctgagcaccacctcccagaagacgacctggctgcccgtcctcctgggcagcctggggtgcaagccgctcaccatgttcctgatcgcggagaacaagatctggggccgcaagtcctggcccctgaacgaggggatcatggccgtgggcgtggtcagcatcctcctgagctccctgctcaagaacgacgtgcccctggccgggcccctgatcgccggcggcatgctcatcgcctgctacgtgatcagcgggtccagcgcggacctgtccctggagaaggccgccgaggtcagctgggaggaggaggccgagcactccggcgccagccacaacatcctcgtggaggtgcaggacgacgggaccatgaagatcaaggacgaggagcgggacgacacgctgaccatcctgctcaaggcgaccctgctggccgtctccggcgtgtacccgctcagcatccccgccaccctgttcgtgtggtacttctggcagaagaagaagcagcgctccggggtcctgtgggacacccccagcccgcccgaggtggagcgggccgtgctggacgacggcatctaccgcatcatgcagcggggcctcctggggcgctcccaggtcggcgtgggggtgttccaggagaacgtcttccacacgatgtggcacgtgacccggggcgccgtgctgatgtaccaggggaagcgcctcgagcccagctgggcgtccgtcaagaaggacctgatcagctacggcggcgggtggcggctgcagggctcctggaacaccggggaggaggtccaggtgatcgccgtcgagcccggcaagaaccccaagaacgtgcagaccgcccccgggacgttcaagacccccgagggcgaggtgggcgccatcgccctcgacttcaagcccgggaccagcggctcccccatcgtcaaccgcgaggggaagatcgtgggcctgtacggcaacggggtggtcaccacgagcggcacctacgtgagcgcgatcgcccaggccaaggcctcccaggaggggccgctgcccgagatcgaggacgaggtgttccggaagcgcaacctcaccatcatggacctgcaccccggcagcgggaagacccggcgctacctgccggcgatcgtccgggaggccatcaagcgcaagctccggacgctgatcctggcccccacccgcgtggtggcctccgagatggccgaggcgctcaagggcatgcccatccgctaccagaccaccgccgtcaagagcgagcacacgggcaaggagatcgtggacctgatgtgccacgccaccttcaccatgcggctgctctcccccgtgcgcgtcccgaactacaacatgatcatcatggacgaggcccacttcaccgaccccagctccatcgccgcgcgggggtacatcagcacgcgcgtgggcatgggggaggccgccgccatcttcatgaccgccacgccgcccggctccgtggaggcgttcccgcagagcaacgccgtcatccaggacgaggagcgggacatccccgagcgctcctggaacagcgggtacgagtggatcaccgacttccccggcaagacggtgtggttcgtgccctccatcaagagcggcaacgacatcgccaactgcctgcggaagaacgggaagcgcgtcatccagctgtcccggaagaccttcgacaccgagtaccagaagaccaagaacaacgactgggactacgtggtgacgaccgacatcagcgagatgggcgccaacttccgcgcggaccgggtcatcgacccgcgccggtgcctcaagcccgtgatcctgaaggacgggcccgagcgcgtcatcctggccggccccatgccggtgaccgtggcctccgccgcccagcggcgcgggcggatcggccgcaaccacaacaaggagggcgaccagtacatctacatggggcagcccctcaacaacgacgaggaccacgcgcactggaccgaggccaagatgctgctggacaacatcaacacgcccgagggcatcatccccgccctcttcgagccggagcgggagaagtccgccgccatcgacggggagtaccgcctgcgcggcgaggcgcggaagaccttcgtcgagctgatgcgccgcggggacctccccgtgtggctgtcctacaaggtggccagcgagggcttccagtacagcgaccgccggtggtgcttcgacggcgagcgcaacaaccaggtcctggaggagaacatggacgtggagatctggaccaaggagggggagcggaagaagctccgcccccggtggctggacgcccgcacctactccgaccccctggccctccgggagttcaaggagttcgccgcgggccgccggagcgtgtccggggacctgatcctggagatcggcaagctcccgcagcacctgacgcagcgcgcccagaacgccctggacaacctcgtcatgctgcacaacagcgagcagggcgggcgggcctaccgccacgcgatggaggagctgcccgacaccatcgagaccctcatgctgctggccctcatcgccgtgctgaccggcggggtgacgctgttcttcctctccggccgggggctgggcaagaccagcatcggcctgctctgcgtcatggcctccagcgtgctgctgtggatggcctccgtggagccccactggatcgcggccagcatcatcctcgagttcttcctgatggtcctgctcatccccgagccggaccgccagcggacgccccaggacaaccagctggcctacgtggtgatcgggctcctcttcatgatcctgaccgtcgccgccaacgagatgggcctgctcgagaccacgaagaaggacctggggatcggccacgtggcggtggagaaccaccaccacgccaccatgctggacgtcgacctccaccccgcctccgcctggaccctgtacgccgtggcgaccacgatcatcaccccgatgatgcgccacaccatcgagaacaccacggccaacatcagcctgaccgccatcgccaaccaggccgcgatcctcatggggctggacaagggctggcccatctccaagatggacatcggcgtgcccctgctcgccctggggtgctacagccaggtcaaccccctgaccctcaccgccgccgtgctgatgctggtggcgcactacgccatcatcggcccggggctccaggccaaggccacgcgggaggcccagaagcgcaccgcggccggcatcatgaagaaccccaccgtcgacgggatcgtggccatcgacctggaccccgtggtctacgacgccaagttcgagaagcagctgggccagatcatgctcctgatcctgtgcacctcccagatcctcctgatgcgcacgacctgggccctgtgcgagagcatcaccctcgcgaccggccccctgacgaccctgtgggaggggtccccgggcaagttctggaacaccaccatcgccgtgagcatggccaacatcttccgggggtcctacctcgccggcgccggcctggcgttcagcctgatgaagtccctcgggggcgggcgccggggcacgggggcccagggcgagaccctgggcgagaagtggaagcgccagctgaaccagctctccaagagcgagttcaacatctacaagcggtccgggatcatggaggtggaccgcagcgaggccaaggagggcctgaagcgcggggagaccacccgccacgccgtctcccggggcacggcgaagctgcgctggttcgtggagcggaacctggtgaagcccgaggggaaggtcatcgacctcggctgcggccgcgggggctggagctactactgcgccgggctgaagaaggtgaccgaggtgaagggctacaccaagggcgggcccggcatggaggagcccatcccgatggccaccaacgggtggaacctggtcaagctccactccggcaaggacgtgttcttcacgccgcccgagaagtgcgacaccctgctgtgcgacatcggggagagctcccccaacccgaccatcgaggagggccggaccctccgcgtgctgaagatggtcgagccctggctgcgggggaaccagttctgcatcaagatcctcaacccctacatgcccagcgtggtggagacgctggagcagatgcagcgcaagcacggcggcatgctggtccggaacccgctctcccgcaacagcacccacgagatgtactgggtgtcctgcgggaccggcaacatcgtgagcgccgtcaacatgacctcccggatgctgctgaaccgcttcaccatggcccaccgcaagcccacgtacgagcgggacgtggacctcggggcgggcacccgccacgtggccgtcgagcccgaggtggccaacctggacatcatcggccagcggatcgagaacatcaagcacgagcacaagagcacctggcactacgacgaggacaacccctacaagacctgggcctaccacgggtcctacgaggtcaagccgagcggctccgccagcagcatggtgaacggggtggtcaagctgctcacgaagccctgggacgtgatccccatggtgacccagatcgcgatgaccgacaccacgcccttcggccagcagcgcgtcttcaaggagaaggtggacacccggaccccgaaggccaagcgcgggaccgcccagatcatggaggtgacggcccggtggctgtggggcttcctgtcccgcaacaagaagccccggatctgcacccgcgaggagttcacccggaaggtccgcagcaacgccgcgatcggcgccgtgttcgtggacgagaaccagtggaactccgccaaggaggccgtcgaggacgagcggttctgggacctcgtgcagaaggagcgcgagctgcacaagcaggggaagtgcgcgacctgcgtgtacaacatgatgggcaagcgggagaagaagctgggggagttcggcaaggccaaggggagccgcgccatctggtacatgtggctcggcgcccggttcctggagttcgaggccctgggcttcatgaacgaggaccactggttctcccgcgagaacagcctctccggggtcgagggcgaggggctgcacaagctgggctacatcctccgggacatcagcaagatccccgggggcaacatgtacgcggacgacacggccggctgggacacccgcatcaccgaggacgacctgcagaacgaggccaagatcaccgacatcatggagccggagcacgccctgctcgccacgtccatcttcaagctgacctaccagaacaaggtggtgcgggtccagcgccccgcgaagaacgggaccgtgatggacgtgatcagccgccgggaccagcgcggctccgggcaggtcggcacctacggcctgaacacgttcaccaacatggaggcccagctcatccggcagatggagagcgaggggatcttcctgccctccgagctggagacccccaacctcgccgagcgcgtgctggactggctggagaagcacggcgtggagcggctcaagcgcatggccatcagcggggacgactgcgtcgtgaagccgatcgacgaccggttcgccaccgcgctgacggccctgaacgacatgggcaaggtgcgcaaggacatcccccagtgggagccctccaaggggtggaacgactggcagcaggtccccttctgcagccaccacttccaccagctcatcatgaaggacggccgggagatcgtggtgccgtgccgcaaccaggacgagctggtcggccgggcccgcgtgtcccagggggccggctggagcctgcgggagaccgcctgcctcggcaagagctacgcgcagatgtggcagctgatgtacttccaccgccgggacctgcgcctcgccgccaacgccatctgctccgcggtgcccgtcgactgggtgcccaccagccggaccacgtggtccatccacgcccaccaccagtggatgaccaccgaggacatgctgagcgtgtggaaccgcgtctggatcgaggagaacccctggatggaggacaagacccacgtgtccagctggggcgacgtgccgtacctggggaagcgggaggaccagtggtgcggctccctcatcggcctgacggcccgcgccacctgggccagcaacatccaggtcgcgatcaaccaggtgcgccggctgatcgggaacgagaactacctcgactacatgacctccatgaagcgcttcaagaacgagggcgaccccgagggggccctgtggtga

SEQ ID NO: 8346 - RNA, 9879 nt, synthetic construct
  misc_feature 1..9879: note = derived and/or modified CDS sequence (opt1) from DENV-1__FJ024457__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgggacaagcggtccgtggccctcgcgccccacgtgggcctggggctggagacccgcaccgagacctggatgagctccgagggcgcctggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtcgggaagctggtgcaccagatcttcggcaccgcctacggggtgctgttctccggcgtcagctggacgatgaagatcgggatcggcgtgctgctgacctggctcggcctgaactcccgcagcacctccctgagcatgacctgcatcgccgtggggctcgtcacgctgtacctgggcgtgatggtgcaggccgactccgggtgcgtcatcaactggaagggccgggagctcaagtgcgggagcggcatcttcgtgaccaacgaggtgcacacctggaccgagcagtacaagttccaggccgacagcccgaagcgcctgtccgcggccatcggcaaggcctgggaggagggggtctgcggcatccggagcgccacccgcctggagaacatcatgtggaagcagatctccaacgagctcaaccacatcctgctggagaacgacatgaagttcacggtggtggtcggggacgtggccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtcgaggactacggcttcgggatcttcacgaccaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacgtgcatctggcccaagtcccacaccctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcacgaccgtggtcgtggacgagcactgcggcaaccgggggccgtccctgcgcaccaccacggtgaccggcaagatcatccacgagtggtgctgccggagctgcaccctgccgcccctccgcttccgcggggaggacggctgctggtacgggatggagatccgccccgtcaaggagaaggaggagaacctggtgaagtccatggtgagcgccggcagcggcgaggtcgactccttcagcctcgggctgctgtgcatctccatcatgatcgaggaggtgatgcggagccgctggtcccggaagatgctcatgaccggcacgctggccgtgttcttcctgctcatcatggggcagctgacctggaacgacctgatccgcctctgcatcatggtcggcgccaacgcgagcgaccgcatggggatgggcaccacctacctggccctgatggccacgttcaagatgcggccgatgttcgccgtgggcctcctgttccgccggctgacctcccgcgaggtgctcctgctgaccatcgggctcagcctggtcgcctccgtggagctgcccaacagcctcgaggagctgggcgacgggctggcgatgggcatcatgatcctcaagctgctgaccgacttccagtcccaccagctctgggccacgctgctgagcctcaccttcatcaagaccaccttctccctgcactacgcctggaagacgatggccatggtcctgagcatcgtgtccctcttccccctgtgcctgagcaccacctcccagaagaccacgtggctccccgtgctgctgggcagcctcgggtgcaagccgctgaccatgttcctgatcgcggagaacaagatctggggccggcgctcctggcccctcaacgaggggatcatggccgtcggcatcgtgagcatcctgctgagctccctcctgaagaacgacgtgcccctggccgggcccctcatcgccggcggcatgctgatcgcctgctacgtcatcagcgggtccagcgcggacctgtccctcgagaaggccgccgaggtgagctgggaggaggaggccgagcactccggcgccagccacaacatcctggtggaggtccaggacgacgggaccatgaagatcaaggacgaggagcgggacgacaccctgaccatcctcctgaaggcgacgctgctcgccgtgtccggcgtgtacccgctgagcatccccgccaccctgttcgtctggtacttctggcagaagaagaagcagcgctccggggtgctctgggacacccccagcccgcccgaggtggagcgggccgtcctggacgacggcatctaccgcatcatgcagcggggcctgctggggcgctcccaggtgggcgtgggggtcttccaggagaacgtgttccacaccatgtggcacgtgacgcggggcgccgtcctcatgtaccaggggaagcgcctggagcccagctgggcgtccgtgaagaaggacctgatcagctacggcggcgggtggcggctccagggctcctggaacaccggggaggaggtgcaggtcatcgccgtggagcccggcaagaaccccaagaacgtgcagaccgcccccgggaccttcaagacgcccgagggcgaggtcggcgccatcgccctggacttcaagcccgggaccagcggctcccccatcgtgaaccgcgaggggaagatcgtgggcctgtacggcaacggggtcgtgaccaccagcggcacgtacgtgagcgcgatcgcccaggccaaggcctcccaggaggggccgctccccgagatcgaggacgaggtcttccggaagcgcaacctgaccatcatggacctgcaccccggcagcgggaagacccggcgctacctcccggcgatcgtgcgggaggccatcaagcgcaagctgcgcaccctgatcctcgcccccacgcgggtggtcgcctccgagatggccgaggcgctgaagggcatgcccatccgctaccagaccaccgccgtcaagagcgagcacaccggcaaggagatcgtggacctgatgtgccacgccacgttcaccatgcggctcctgtcccccgtccgcgtgccgaactacaacatgatcatcatggacgaggcccacttcaccgaccccagctccatcgccgcgcgggggtacatcagcacccgcgtgggcatgggggaggccgccgccatcttcatgacggccacgccgcccggctccgtcgaggcgttcccgcagagcaacgccgtgatccaggacgaggagcgggacatccccgagcgctcctggaacagcgggtacgagtggatcaccgacttccccggcaagaccgtgtggttcgtcccctccatcaagagcggcaacgacatcgccaactgcctgcggaagaacgggaagcgcgtgatccagctctcccggaagacgttcgacaccgagtaccagaagaccaagaacaacgactgggactacgtggtcaccacggacatcagcgagatgggcgccaacttccgcgcggaccgggtgatcgacccgcgccggtgcctgaagcccgtgatcctgaaggacgggcccgagcgcgtcatcctcgccggccccatgccggtgaccgtcgcctccgccgcccagcggcgcgggcggatcggccgcaaccacaacaaggagggcgaccagtacatctacatggggcagcccctgaacaacgacgaggaccacgcgcactggaccgaggccaagatgctgctcgacaacatcaacacccccgagggcatcatccccgccctgttcgagccggagcgcgagaagtccgccgccatcgacggggagtaccggctgcgcggcgaggcgcggaagacgttcgtggagctcatgcgccgcggggacctgcccgtgtggctgtcctacaaggtcgccagcgagggcttccagtacagcgaccgccggtggtgcttcgacggcgagcgcaacaaccaggtgctcgaggagaacatggacgtggagatctggaccaaggagggggagcggaagaagctgcgcccccggtggctggacgcccgcacctactccgaccccctcgccctgcgggagttcaaggagttcgccgcgggccgccggagcgtctccggggacctgatcctcgagatcggcaagctgccgcagcacctgacccagcgcgcccagaacgccctcgacaacctggtgatgctgcacaacagcgagcagggcgggcgggcctaccgccacgcgatggaggagctccccgacacgatcgagaccctgatgctgctcgccctgatcgccgtgctgaccggcggggtcaccctcttcttcctgtccggccgggggctgggcaagaccagcatcggcctcctgtgcgtgatggcctccagcgtgctgctctggatggcctccgtcgagccccactggatcgcggccagcatcatcctggagttcttcctgatggtgctcctgatccccgagccggaccgccagcggacgccccaggacaaccagctggcctacgtggtcatcgggctcctgttcatgatcctgaccgtggccgccaacgagatgggcctcctggagaccaccaagaaggacctggggatcggccacgtggcggtcgagaaccaccaccacgccgccatgctcgacgtggacctgcaccccgcctccgcctggacgctgtacgcggtggccaccaccatcatcaccccgatgatgcgccacacgatcgagaacaccaccgccaacatcagcctcaccgccatcgccaaccaggcggccatcctgatggggctggacaagggctggcccatctccaagatggacatcggcgtccccctcctggccctggggtgctacagccaggtgaaccccctcacgctgaccgccgcggtgctgatgctcgtcgcccactacgccatcatcggcccggggctgcaggccaaggccacccgcgaggcgcagaagcggaccgccgccggcatcatgaagaaccccacggtggacgggatcgtggccatcgacctggaccccgtcgtgtacgacgccaagttcgagaagcagctcggccagatcatgctgctgatcctctgcacctcccagatcctgctgatgcgcaccacctgggcgctctgcgagagcatcacgctggccaccggccccctgaccaccctctgggaggggtccccgggcaagttctggaacacgaccatcgccgtgagcatggccaacatcttccgggggtcctacctggccggcgcgggcctggccttcagcctcatgaagtccctcgggggcgggcgccgggggaccggggcccagggcgagaccctgggcgagaagtggaagcgccagctcaaccagctgtccaagagcgagttcaacacgtacaagcggtccgggatcatggaggtcgaccgcagcgaggccaaggagggcctgaagcgcggggagaccaccaagcacgcggtgtcccgcggcaccgccaagctccggtggttcgtggagcgcaacctggtcaagcccgaggggaaggtgatcgacctgggctgcggccgcgggggctggagctactactgcgccgggctgaagaaggtgacggaggtcaagggctacaccaagggcggccccggccacgaggagcccatcccgatggccacctacgggtggaacctcgtgaagctgcactccggcaaggacgtgttcttcatcccgcccgagaagtgcgacaccctgctctgcgacatcggggagagctcccccaacccgacgatcgaggagggccgcaccctgcgggtcctgaagatggtggagccctggctccgcgggaaccagttctgcatcaagatcctgaacccctacatgcccagcgtggtcgagaccctggagcagatgcagcggaagcacggcggcatgctcgtgcgcaacccgctgtcccggaacagcacccacgagatgtactgggtgtcctgcgggaccggcaacatcgtcagcgccgtgaacatgacgtcccgcatgctgctcaaccgcttcaccatggcgcaccggaagcccacctacgagcgcgacgtggacctgggggccggcacccggcacgtcgccgtggagcccgaggtggccaacctggacatcatcggccagcgcatcgagaacatcaagcacgagcacaagagcacgtggcactacgacgaggacaacccctacaagacctgggcctaccacgggtcctacgaggtcaagccgagcggctccgcgagcagcatggtgaacggggtcgtgaagctcctgaccaagccctgggacgtgatccccatggtcacccagatcgccatgacggacaccacccccttcggccagcagcgggtgttcaaggagaaggtggacacccgcacgccgaaggccaagcgggggaccgcccagatcatggaggtcaccgccaagtggctgtggggcttcctctcccgcaacaagaagccccggatctgcacccgcgaggagttcacgcggaaggtgcgcagcaacgcggccatcggcgccgtgttcgtcgacgagaaccagtggaactccgccaaggaggcggtggaggacgagcggttctgggacctggtgcaccgcgagcgggagctgcacaagcaggggaagtgcgcgacctgcgtctacaacatgatgggcaagcgcgagaagaagctcggggagttcggcaaggccaaggggagccgggccatctggtacatgtggctgggcgcccgcttcctggagttcgaggcgctcggcttcatgaacgaggaccactggttctcccgggagaacagcctgtccggggtggagggcgaggggctgcacaagctcggctacatcctgcgcgacatcagcaagatccccgggggcaacatgtacgccgacgacaccgccggctgggacacccggatcacggaggacgacctgcagaacgaggcccgcatcaccgacatcatggagccggagcacgccctcctggcgcgctccatcttcaagctgacctaccagaacaaggtggtccgggtgcagcgccccgccaagaacgggaccgtgatggacgtcatcagccggcgcgaccagcggggctccggccaggtggggacgtacggcctcaacaccttcaccaacatggaggcccagctgatccgccagatggagagcgaggggatcttctcccccagcgagctggagacccccatcctcgccgagcgggtgctggactggctggagaagtacggcgtcgagcgcctcaagcggatggccatctccggggacgactgcgtggtgaagccgatcgacgaccgcttcgcgacggccctgaccgccctgaacgacatgggcaaggtccggaaggacatcccccagtgggagcccagcaaggggtggaacgactggcagcaggtccccttctgctcccaccacttccaccagctcatcatgaaggacggccgcgagatcgtggtcccgtgccggaaccaggacgagctggtgggccgcgcccgggtgagccagggggccggctggagcctgcgcgagaccgcgtgcctcgggaagtcctacgcccagatgtggcagctgatgtacttccaccggcgcgacctgcggctcgccgccaacgcgatctgcagcgccgtccccgtggactggatccccacctcccgcacgacctggagcatccacgcccaccaccagtggatgaccaccgaggacatgctgtccgtgtggaaccgcgtctggatcgaggagaacccctggatggaggacaagacgcacatcagctcctggggcgacgtgccgtacctggggaagcgggaggaccagtggtgcggcagcctcatcggcctgaccgcccgcgccacctgggcgaccaacatccaggtggccatcaaccaggtccggcgcctgatcgggaacgagaactacctcgactacatgacctccatgaagcggttcaagaacgagagcgaccccgagggcgccctgtggtga

SEQ ID NO: 8347 - RNA, 9879 nt, synthetic construct
  misc_feature 1..9879: note = derived and/or modified CDS sequence (opt1) from DENV-1__FJ205881__SS-prME
  source 1..9879: mol_type = other RNA
agcgtgaccatgctgctcctgctgatgcccaccgccctcgccttccacctgaccacccggggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccggatcaccgagaccgagcccgacgacgtggactgctggtgcaacgccaccgacacctgggtcacctacgggacctgcagccagacgggcgagcaccggcgggacaagcggtccgtggccctggcgccccacgtgggcctggggctcgagacccgcaccgagacctggatgagctccgagggcgcctggaagcagatccagcgggtcgagacgtgggccctgcggcaccccgggttcaccgtgatcgccctgttcctcgcccacgcgatcggcaccagcatcacccagaaggggatcatcttcatcctgctgatgctcgtgacgccctccatggccatgcggtgcgtcggcatcggcagccgcgacttcgtggaggggctgtccggcgccacctgggtggacgtcgtgctggagcacgggagctgcgtgaccaccatggccaaggacaagcccacgctcgacatcgagctgctgaagaccgaggtcaccaaccccgccgtgctccggaagctgtgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcggcctgttcggcaaggggtccctgatcacgtgcgccaagttcaagtgcgtgaccaagctggagggcaagatcgtccagtacgagaacctcaagtacagcgtgatcgtgaccgtccacacgggcgaccagcaccaggtggggaacgagtccaccgagcacggcaccaccgccaccatcacgccccaggcgcccaccaccgagatccagctgaccgactacggggccctgacgctcgactgcagcccccgcaccggcctggacttcaacgagatggtcctgctcaccatgaaggagaagtcctggctggtgcacaagcagtggttcctggacctccccctgccctggaccagcggggccagcacgtcccaggagacctggaaccggcaggacctgctcgtgaccttcaagaccgcccacgccaagaagcaggaggtcgtggtgctgggcagccaggagggcgcgatgcacacggccctgaccggggccaccgagatccagacctccggcacgaccaccatcttcgccgggcacctcaagtgccgcctgaagatggacaagctgaccctcaagggcatgagctacgtcatgtgcacggggtccttcaagctggagaaggagctggccgagacccagcacggcaccgtgctggtgcagatcaagtacgagggcaccgacgcgccctgcaagatccccttcagcacgcaggacgagaagggggtcacccagaacggccggctcatcaccgccaacccgatcgtgaccgacaaggagaagcccgtgaacatcgaggccgagccgcccttcggggagtcctacatcgtcatcggcgccggcgagaaggcgctgaagctgagctggttcaagaaggggtccagcatcggcaagatgttcgaggccacggcccgcggggcccggcgcatggccatcctcggcgacaccgcgtgggacttcgggtccatcggcggcgtgttcaccagcgtggggaagctggtccaccagatcttcggcaccgcctacggggtgctgttctccggcgtgagctggacgatgaagatcgggatcggcgtcctcctgacctggctgggcctcaactcccgcagcacctccctgagcatgacctgcatcgccgtggggctggtgacgctctacctgggcgtcatggtgcaggccgactccgggtgcgtgatcaactggaagggccgggagctgaagtgcgggagcggcatcttcgtcaccaacgaggtgcacacctggaccgagcagtacaagttccaggccgacagcccgaagcgcctctccgcggccatcggcaaggcctgggaggagggggtgtgcggcatccggagcgccacccgcctggagaacatcatgtggaagcagatctccaacgagctgaaccacatcctcctggagaacgacatgaagttcacggtcgtggtgggggacgtcgccggcatcctggcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctcaagctgcgggacagctacacccaggtctgcgaccaccgcctgatgtccgcggccatcaaggacagcaaggccgtgcacgccgacatgggctactggatcgagtccgagaagaacgagacctggaagctcgcccgggcgagcttcatcgaggtgaagacgtgcatctggcccaagtcccacaccctgtggagcaacggcgtcctggagtccgagatgatcatccccaagatctacgggggcccgatcagccagcacaactaccgccccgggtacttcacccagaccgccggcccctggcacctcgggaagctggagctggacttcgacctctgcgagggcacgaccgtggtggtcgacgagcactgcggcaaccgggggccgtccctgcgcaccaccacggtgaccggcaagatcatccacgagtggtgctgccggagctgcaccctgccgcccctgcgcttccgcggggaggacggctgctggtacgggatggagatccgccccgtgaaggagaaggaggagaacctggtcaagtccatggtgagcgccggcagcggcgaggtggactccttcagcctggggctcctgtgcatctccatcatgatcgaggaggtcatgcggagccgctggtcccggaagatgctgatgaccggcacgctcgccgtgttcttcctgctgatcatggggcagctcacctggaacgacctgatccgcctgtgcatcatggtgggcgccaacgcgagcgaccgcatggggatgggcaccacctacctcgccctgatggccacgttcaagatgcggccgatgttcgccgtcggcctcctcttccgccggctgacctcccgcgaggtgctgctcctgaccatcgggctgagcctcgtggcctccgtcgagctgcccaacagcctggaggagctcggcgacgggctggcgatgggcatcatgatcctgaagctcctgaccgacttccagtcccaccagctgtgggccacgctcctgagcctgaccttcatcaagaccaccttctccctccactacgcctggaagacgatggccatggtgctgagcatcgtctccctgttccccctctgcctgagcaccacctcccagaagaccacgtggctgcccgtgctcctgggcagcctggggtgcaagccgctcaccatgttcctgatcgcggagaacaagatctggggccggcgctcctggcccctgaacgaggggatcatggccgtgggcatcgtcagcatcctcctgagctccctgctcaagaacgacgtgcccctggccgggcccctgatcgccggcggcatgctcatcgcctgctacgtgatcagcgggtccagcgcggacctgtccctggagaaggccgccgaggtcagctgggaggaggaggccgagcactccggcgccagccacaacatcctcgtggaggtgcaggacgacgggaccatgaagatcaaggacgaggagcgggacgacaccctgaccatcctgctcaaggcgacgctgctggccgtctccggcgtgtacccgctcagcatccccgccaccctgttcgtgtggtacttctggcagaagaagaagcagcgctccggggtcctgtgggacacccccagcccgcccgaggtggagcgggccgtgctggacgacggcatctaccgcatcatgcagcggggcctcctggggcgctcccaggtcggcgtgggggtgttccaggagaacgtcttccacaccatgtggcacgtgacgcggggcgccgtgctgatgtaccaggggaagcgcctcgagcccagctgggcgtccgtcaagaaggacctgatcagctacggcggcgggtggcggctgcagggctcctggaacaccggggaggaggtccaggtgatcgccgtcgagcccggcaagaaccccaagaacgtgcagaccgcccccgggaccttcaagacgcccgagggcgaggtgggcgccatcgccctcgacttcaagcccgggaccagcggctcccccatcgtcaaccgcgaggggaagatcgtgggcctgtacggcaacggggtggtcaccaccagcggcacgtacgtgagcgcgatcgcccaggccaagacctcccaggaggggccgctgcccgagatcgaggacgaggtgttccggaagcgcaacctcaccatcatggacctgcaccccggcagcgggaagacccggcgctacctgccggccatcgtccgggaggcgatcaagcgcaagctccgcacgctgatcctggcccccacccgggtggtggcctccgagatggccgaggccctcaagggcatgcccatccgctaccagaccaccgcggtcaagagcgagcacacgggcaaggagatcgtggacctgatgtgccacgccaccttcaccatgcggctgctctcccccgtgcgcgtcccgaactacaacatgatcatcatggacgaggcccacttcaccgaccccagctccatcgccgcccgggggtacatcagcacgcgcgtgggcatgggggaggcggccgccatcttcatgaccgccacgccgcccggctccgtggaggccttcccgcagagcaacgcggtcatccaggacgaggagcgggacatccccgagcgctcctggaacagcgggtacgagtggatcaccgacttccccggcaagacggtgtggttcgtgccctccatcaagagcggcaacgacatcgccaactgcctgcggaagaacgggaagcgcgtcatccagctgtcccggaagaccttcgacaccgagtaccagaagaccaagaacaacgactgggactacgtggtgacgaccgacatcagcgagatgggcgccaacttccgcgccgaccgggtcatcgacccgcgccggtgcctcaagcccgtgatcctgaaggacgggcccgagcgcgtgatcctggcgggccccatgccggtcaccgtggcctccgccgcccagcggcgcgggcggatcggccgcaaccacaacaaggagggcgaccagtacatctacatggggcagcccctcaacaacgacgaggaccacgcccactggaccgaggcgaagatgctgctggacaacatcaacacgcccgagggcatcatccccgccctcttcgagccggagcgcgagaagtccgccgccatcgacggggagtaccggctgcgcggcgaggcccggaagaccttcgtcgagctgatgcgccgcggggacctccccgtgtggctgtcctacaaggtggcgagcgagggcttccagtacagcgaccgccggtggtgcttcgacggcgagcgcaacaaccaggtcctggaggagaacatggacgtggagatctggaccaaggagggggagcggaagaagctccgcccccggtggctggacgcccgcacctactccgaccccctggccctccgggagttcaaggagttcgccgccggccgccggagcgtgtccggggacctgatcctggagatcggcaagctcccgcagcacctgacgcagcgcgcgcagaacgccctggacaacctcgtcatgctgcacaacagcgagcagggcgggcgggcctaccgccacgccatggaggagctgcccgacaccatcgagaccctcatgctgctggcgctcatcgccgtgctgaccggcggggtgaccctgttcttcctctccggccgggggctgggcaagacgagcatcggcctgctctgcgtcatggcctccagcgtgctgctgtggatggcctccgtggagccccactggatcgccgcgagcatcatcctcgagttcttcctgatggtcctgctcatccccgagccggaccgccagcggacgccccaggacaaccagctggcctacgtggtgatcgggctcctcttcatgatcctgaccgtcgccgccaacgagatgggcctgctcgagaccacgaagaaggacctggggatcggccacgtggccgtggagaaccaccaccacgcggccatgctggacgtcgacctccaccccgcctccgcctggaccctgtacgccgtggcgaccaccatcatcacgccgatgatgcgccacaccatcgagaacaccaccgccaacatcagcctgacggccatcgccaaccaggccgcgatcctcatggggctggacaagggctggcccatctccaagatggacatcggcgtgcccctgctcgccctggggtgctacagccaggtcaaccccctgaccctcaccgccgccgtgctgatgctggtggcgcactacgccatcatcggcccggggctccaggccaaggccacccgcgaggcccagaagcggacggcggccggcatcatgaagaaccccaccgtcgacgggatcgtggccatcgacctggaccccgtggtctacgacgccaagttcgagaagcagctgggccagatcatgctcctgatcctgtgcacctcccagatcctcctgatgcgcaccacgtgggccctgtgcgagagcatcaccctcgcgaccggccccctgaccacgctgtgggaggggtccccgggcaagttctggaacaccaccatcgccgtgagcatggccaacatcttccgggggtcctacctcgccggcgccggcctggcgttcagcctgatgaagtccctcgggggcgggcgccggggcaccggggcccagggcgagacgctgggcgagaagtggaagcgccagctgaaccagctctccaagagcgagttcaacacctacaagcggtccgggatcatggaggtggaccgcagcgaggccaaggagggcctgaagcgcggggagaccaccaagcacgccgtctcccgcggcacggcgaagctgcggtggttcgtggagcgcaacctggtgaagcccgaggggaaggtcatcgacctcggctgcggccgcggcgggtggagctactactgcgccgggctgaagaaggtgaccgaggtgaaggggtacaccaagggcgggcccggccacgaggagcccatcccgatggccacctacgggtggaacctggtcaagctccactccggcaaggacgtgttcttcatcccgcccgagaagtgcgacacgctgctgtgcgacatcggggagagctcccccaacccgaccatcgaggagggccgcaccctccgggtgctgaagatggtcgagccctggctgcgcgggaaccagttctgcatcaagatcctcaacccctacatgcccagcgtggtggagaccctggagcagatgcagcggaagcacggcggcatgctggtccgcaacccgctctcccggaacagcacccacgagatgtactgggtgtcctgcgggacgggcaacatcgtgagcgccgtcaacatgacctcccgcatgctgctgaaccgcttcaccatggcccaccggaagcccacctacgagcgcgacgtggacctcggggcgggcacgcggcacgtggccgtcgagcccgaggtggccaacctggacatcatcggccagcgcatcgagaacatcaagcacgagcacaagagcacctggcactacgacgaggacaacccctacaagacctgggcctaccacgggtcctacgaggtgaagccgagcggctccgccagcagcatggtcaacggggtggtcaagctgctcaccaagccctgggacgtgatccccatggtgacgcagatcgcgatgaccgacaccacccccttcggccagcagcgggtcttcaaggagaaggtggacacgcgcaccccgaaggccaagcgggggaccgcccagatcatggaggtgaccgccaagtggctgtggggcttcctgtcccgcaacaagaagccccggatctgcacgcgcgaggagttcacccggaaggtccgcagcaacgccgcgatcggcgccgtgttcgtggacgagaaccagtggaactccgccaaggaggccgtcgaggacgagcggttctgggacctcgtgcaccgcgagcgggagctgcacaagcaggggaagtgcgcgacctgcgtgtacaacatgatgggcaagcgcgagaagaagctgggggagttcggcaaggccaaggggagccgggccatctggtacatgtggctcggcgcccgcttcctggagttcgaggccctgggcttcatgaacgaggaccactggttctcccgggagaacagcctctccggggtcgagggcgaggggctgcacaagctgggctacatcctccgcgacatcagcaagatccccgggggcaacatgtacgcggacgacaccgccggctgggacacgcggatcaccgaggacgacctgcagaacgaggcccgcatcaccgacatcatggagccggagcacgccctgctcgccaagtccatcttcaagctgacctaccagaacaaggtggtgcgcgtccagcggcccgcgaagaacgggacggtgatggacgtgatcagccgccgggaccagcgcggctccgggcaggtcggcacctacggcctgaacaccttcaccaacatggaggcccagctcatccggcagatggagagcgaggggatcttctcccccagcgagctggagacgcccaacctggccgagcgcgtgctcgactggctggagaagtacggcgtggagcggctgaagcgcatggccatctccggggacgactgcgtcgtgaagccgatcgacgaccggttcgccaccgcgctcaccgccctgaacgacatgggcaaggtgcgcaaggacatcccccagtgggagcccagcaaggggtggaacgactggcagcaggtccccttctgctcccaccacttccaccagctgatcatgaaggacggccgggagatcgtggtgccgtgccgcaaccaggacgagctcgtcggccgggcccgcgtgagccagggggccggctggagcctgcgggagaccgcctgcctggggaagtcctacgcgcagatgtggcagctcatgtacttccaccgccgggacctgcgcctggccgccaacgccatctgcagcgcggtgcccgtcgactggatccccacgtcccggaccacctggagcatccacgcccaccaccagtggatgaccacggaggacatgctctccgtgtggaaccgcgtgtggatcgaggagaacccctggatggaggacaagacccacatcagctcctggggcgacgtcccgtacctggggaagcgcgaggaccagtggtgcggcagcctgatcggcctcaccgcccgggccacctgggccaccaacatccaggtggcgatcaaccaggtgcgccggctgatcgggaacgagaactacctggactacatgacgtccatgaagcgcttcaagaacgagagcgaccccgagggcgccctctggtga

SEQ ID NO: 8348 - RNA, 9879 nt, synthetic construct
  misc_feature 1..9879: note = derived and/or modified CDS sequence (opt1) from DENV-1__FJ205882__SS-prME
  source 1..9879: mol_type = other RNA
agcgtgaccatgctgctcatgctgatgcccaccgccctggccttccacctcaccacccgcggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgaggccgagcccgacgacgtggactgctggtgcaacgccaccgacacctgggtgacctacgggacctgcagccagaccggcgagcaccggcgcgacaagcggagcgtggccctcgcgccccacgtgggcctggggctggagacgcgcaccgagacctggatgagctccgagggcgcctggaagcagatccagcgggtggagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgccccacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctcaccgactacggggccctgaccctggactgcagcccccggaccggcctcgacttcaacgagatggtcctgctgacgatgaaggagaagtcctggctcgtgcacaagcagtggttcctggacctgccgctcccctggaccagcggggcctccaccagccaggagacctggaaccggcaggacctgctggtgacgttcaagaccgcccacgcgaagaagcaggaggtcgtggtgctcggctcccaggagggcgccatgcacaccgccctgaccggggccacggagatccagaccagcggcaccaccacgatcttcgccgggcacctgaagtgccgcctcaagatggacaagctgaccctgaagggcatgtcctacgtcatgtgcaccgggagcttcaagctcgagaaggaggtggcggagacccagcacggcacggtgctggtccagatcaagtacgagggcaccgacgccccctgcaagatccccttctccacccaggacgagaagggggtgacccagaacggccggctgatcacggccaaccccatcgtgaccgacaaggagaagcccgtcaacatcgaggccgagccgcccttcggggagagctacatcgtgatcggcgcgggcgagaaggccctgaagctctcctggttcaagaaggggagctccatcggcaagatgttcgaggccaccgcccgcggggcccggcgcatggcgatcctgggcgacaccgcctgggacttcgggagcatcggcggcgtgttcacgtccgtcgggaagctggtgcaccagatcttcggcaccgcctacggggtgctgttcagcggcgtctcctggaccatgaagatcgggatcggcgtgctgctgacctggctcggcctgaacagccgctccacgagcctgtccatgacctgcatcgccgtggggctcgtcaccctgtacctgggcgtgatggtgcaggccgacagcgggtgcgtcatcaactggaagggccgggagctcaagtgcgggagcggcatcttcgtgaccaacgaggtgcacacgtggaccgagcagtacaagttccaggcggactccccgaagcgcctgagcgccgccatcggcaaggcctgggacgagggggtctgcggcatccggtccgccacccgcctggagaacatcatgtggaagcagatcagcaacgagctcaaccacatcctgctggagaacgacatgaagttcaccgtggtggtcggggacgtggcgggcatcctcgcccaggggaagaagatgatccggccccagcccatggagtacaagtactcctggaagtcctggggcaaggccaagatcatcggcgccgacgtgcagaacaccacgttcatcatcgacgggcccaacaccccggagtgccccgacgaccagcgcgcgtggaacatctggaaggtcgaggaccacggcttcgggatcttccccaccaacatctggctgaagctgcgggactcctacacccaggtgtgcgaccaccgcctcatgagcgccgccatcaaggactccaaggccgtgcacgccgacatgggctactggatcgagagcgagaagaacgagacgtggaagctggcgcgggcctccttcatcgaggtcaagacctgcatctggcccaagagccacaccctgtggtccaacggcgtgctcgagagcgagatgatcatcccgaagatctacgggggccccatctcccagcacaactaccgccccgggtacttcacccagacggccggcccgtggcacctggggaagctggagctcgacttcaacctgtgcgagggcaccaccgtggtcgtggacgagcactgcggcaaccgggggcccagcctgcgcaccacgaccgtgaccggcaagatcatccacgagtggtgctgccggtcctgcaccctgccgcccctccgcttcaagggggaggacggctgctggtacgggatggagatccggccggtcaaggagaaggaggagaacctggtcaagagcatggtgagcgccggctccggcgaggtcgacagcttctccctcgggctgctgtgcatcagcatcatgatcgaggaggtgatgcgctcccggtggagccgcaagatgctcatgacgggcaccctggccgtgttcttcctgctcatcatggggcagctgacctggaacgacctgatccggctctgcatcatggtcggcgcgaacgcctccgaccgcatggggatgggcaccacgtacctggccctgatggccaccttcaagatgcgccccatgctcgccgtggggctgctgttccggcgcctcaccagccgggaggtgctgctgctcaccatcgggctgtccctggtcgcgagcgtggagctccccaactccctggaggagctgggcgacgggctcgccatgggcatcatgatcctgaagctgctcacggacttccagagccaccagctgtgggccaccctgctctccctgaccttcatcaagaccacgtacagcctgcactacgcctggaagaccatggcgatggtcctctccatcgtgagcctgttccccctgtgcctctccaccaccagccagaagacgacctggctgccggtgctgctcggctccctggggtgcaagcccctgaccatgttcctcatcgccgagaacaagatctggggccgcaagagctggcccctgaacgaggggatcatggccgtcggcatcgtgagcatcctgctctccagcctgctgaagaacgacgtgcccctcgccgggccgctgatcgccggcggcatgctgatcgcgtgctacgtcatctccgggagctccgccgacctcagcctggagaaggccgccgaggtgtcctgggaggaggaggccgagcacagcggcgcgtcccacaacatcctggtggaggtccaggacgacgggaccatgaagatcaaggacgaggagcgggacgacacgctcaccatcctgctgaaggccaccctcctggccgtgagcggcgtgtaccccctgtccatccccgccaccctcttcgtctggtacttctggcagaagaagaagcagcgcagcggggtgctgtgggacaccccctccccgcccgaggtggagcgggccgtcctggacgacggcatctaccgcatcatgcagcggggcctgctcgggcgcagccaggtgggcgtgggggtcttccaggagaacgtgttccacacgatgtggcacgtgacccggggcgcggtcctgatgtaccaggggaagcgcctggagccctcctgggccagcgtgaagaaggacctcatctcctacggcggcgggtggcggctgcagggcagctggaacaccggggaggaggtgcaggtcatcgccgtggagcccggcaagaacccgaagaacgtgcagaccgcccccgggacgttcaagacctccgagggcgaggtcggcgccatcgcgctggacttcaagcccgggaccagcggcagccccatcgtgaaccgcgaggggaagatcgtgggcctctacggcaacggggtcgtgaccacgtccggcacctacgtgagcgccatcgcccaggccaaggcgtcccaggaggggccgctgcccgagatcgagaacgaggtcttccggaagcgcaacctgaccatcatggacctccaccccggcagcgggaagacccggcgctacctgccggccatcgtgcgggaggccatcaagcgcaagctgcggacgctcatcctggcccccacccgcgtggtcgcctccgagatggcggaggccctgaagggcatgcccatccgctaccagaccaccgccgtcaagagcgagcacacgggcaaggagatcgtggacctcatgtgccacgccaccttcaccatgcggctgctgtcccccgtccgcgtgccgaactacaacatgatcatcatggacgaggcccacttcaccgaccccagctccatcgcggcccgggggtacatcagcacgcgcgtgggcatgggggaggccgccgccatcttcatgaccgcgacgccgcccggctccgtcgaggccttcccgcagagcaacgccgtgatccaggacgaggagcgggacatccccgagcgctcctggaacagcgggtacgagtggatcaccgacttccccggcaagacggtgtggttcgtcccctccatcaagagcggcaacgacatcgccaactgcctccggaagaacgggaagcgcgtgatccagctgtcccggaagaccttcgacaccgagtaccagaagaccaagaacaacgactgggactacgtggtcacgaccgacatcagcgagatgggcgcgaacttccgcgccgaccgggtgatcgacccgcgccggtgcctgaagcccgtgatcctcaaggacgggcccgagcgcgtcatcctggccggccccatgccggtgaccgtcgcctccgccgcgcagcggcgcgggcggatcggccgcaaccacaacaaggagggcgaccagtacatctacatggggcagcccctgaacaacgacgaggaccacgcccactggaccgaggccaagatgctcctggacaacatcaacacgcccgagggcatcatccccgccctgttcgagccggagcgggagaagtccgccgcgatcgacggggagtaccgcctccgcggcgaggcccggaagaccttcgtggagctgatgcgccgcggggacctgcccgtgtggctcagctacaaggtcgcctccgagggcttccagtacagcgaccgccggtggtgcttcgacggcgagcgcaacaaccaggtgctggaggagaacatggacgtggagatctggaccaaggagggggagcggaagaagctgcgcccccggtggctcgacgcccgcacctactccgaccccctggccctgcgggagttcaaggagttcgcggccggccgcaagagcgtctccggggacctcatcctggagatcggcaagctgccgcagcacctcacgcagcgggcccagaacgccctggacaacctggtgatgctccacaacagcgagcagggcgggcgcgcgtaccggcacgccatggaggagctgcccgacaccatcgagaccctgatgctcctggccctgatcgccgtgctcaccggcggggtcacgctgttcttcctgtccggccgcgggctcggcaagaccagcatcggcctgctgtgcgtgatggcctccagcgtgctcctgtggatggcgtccgtcgagccccactggatcgccgccagcatcatcctggagttcttcctcatggtgctgctgatccccgagccggaccggcagcgcacgccccaggacaaccagctcgcctacgtggtcatcgggctgctgttcatgatcctcaccgtggccgcgaacgagatgggcctgctggagaccacgaagaaggacctcgggatcggccacgtggccgtcgagaaccaccaccacgccgccatgctggacgtggacctgcaccccgcctccgcgtggaccctctacgccgtggccaccaccatcatcacgccgatgatgcggcacaccatcgagaacaccaccgccaacatcagcctgacggccatcgcgaaccaggccgccatcctgatggggctcgacaagggctggcccatctccaagatggacatcggcgtccccctgctggccctcgggtgctacagccaggtgaaccccctgaccctgaccgcggccgtgctcatgctggtcgcccactacgccatcatcggcccggggctgcaggccaaggcgacccgcgaggcccagaagcggacggccgccggcatcatgaagaaccccaccgtggacgggatcgtggccatcgacctcgaccccgtcgtgtacgacgcgaagttcgagaagcagctgggccagatcatgctgctcatcctgtgcacctcccagatcctgctcatgcgcaccacgtgggccctgtgcgagagcatcaccctggccaccggccccctcaccacgctgtgggaggggtccccgggcaagttctggaacaccaccatcgccgtgagcatggccaacatcttccgcgggagctacctggcgggcgccggcctcgccttctccctgatgaagtccctcgggggcgggcggcgcgggaccggggcccagggcgagacgctcggcgagaagtggaagcggcagctgaaccagctgtccaagagcgagttcaacacctacaagcgctccgggatcatggaggtcgaccggagcgaggcgaaggagggcctcaagcgcggggagaccaccaagcacgccgtgtcccggggcacggccaagctgcgctggttcgtggagcggaacctggtcaagcccgaggggaaggtgatcgacctgggctgcggccgcgggggctggagctactactgcgccgggctcaagaaggtgaccgaggtcaagggctacaccaagggcgggcccggccacgaggagcccatcccgatggccacctacgggtggaacctggtgaagctgcactccggcaaggacgtgttcttcatcccgcccgagaagtgcgacacgctcctgtgcgacatcggggagagctcccccaacccgaccatcgaggagggccggaccctgcgcgtcctcaagatggtggagccctggctgcgggggaaccagttctgcatcaagatcctgaacccctacatgcccagcgtggtcgagaccctcgagcagatgcagcgcaagcacggcggcatgctggtgcggaacccgctgtcccgcaacagcacgcacgagatgtactgggtgtcctgcgggaccggcaacatcgtcagcgcggtgaacatgacctcccggatgctcctgaaccgcttcaccatggcccaccggaagcccacctacgagcgcgacgtggacctgggggccggcacgcgccacgtcgccgtggagcccgaggtggccaacctcgacatcatcggccagcggatcgagaacatcaagcacgagcacaagagcacctggcactacgacgaggacaacccctacaagacctgggcgtaccacgggtcctacgaggtcaagccgagcggcagcgcctccagcatggtgaacggggtcgtgaagctgctgaccaagccctgggacgtgatccccatggtcacgcagatcgccatgaccgacaccacccccttcggccagcagcgcgtgttcaaggagaaggtggacacgcggaccccgaaggccaagcgcgggaccgcccagatcatggaggtcaccgcgaagtggctctggggcttcctgtcccggaacaagaagccccgcatctgcacgcgggaggagttcacccgcaaggtgcggagcaacgccgccatcggcgccgtgttcgtcgacgagaaccagtggaactccgcgaaggaggccgtggaggacgagcgcttctgggacctggtgcaccgggagcgcgagctccacaagcaggggaagtgcgcgacctgcgtctacaacatgatgggcaagcgggagaagaagctgggggagttcggcaaggccaaggggagccgcgccatctggtacatgtggctgggcgcgcggttcctcgagttcgaggccctgggcttcatgaacgaggaccactggttctcccgcgagaacagcctgtccggggtggagggcgaggggctccacaagctgggctacatcctgcgggacatcagcaagatccccgggggcaacatgtacgccgacgacaccgccggctgggacacgcgcatcaccgaggacgacctccagaacgaggccaagatcaccgacatcatggagccggagcacgcgctgctggccaagtccatcttcaagctcacctaccagaacaaggtggtccgggtgcagcgccccgccaagaacgggacggtgatggacgtcatcagccggcgcgaccagcgcggctccggccaggtgggcacctacggcctgaacaccttcaccaacatggaggcccagctgatccggcagatggagagcgaggggatcttctcccccagcgagctcgagacgcccaacctggccggccgcgtgctggactggctcgagaagcacggggtcgagcggctgaagcgcatggcgatctccggcgacgactgcgtggtgaagccgatcgacgaccggttcgccaccgccctgaccgccctcaacgacatggggaaggtccgcaaggacatcccccagtgggagcccagcaagggctggaacgactggcagcaggtccccttctgcagccaccacttccaccagctgatcatgaaggacggccgggagatcgtggtcccgtgccgcaaccaggacgagctggtggggcgggcccgcgtgtcccagggcgcggggtggagcctccgggagaccgcctgcctgggcaagtcctacgcccagatgtggcagctgatgtacttccaccgccgggacctccgcctggccgcgaacgccatctgcagcgccgtccccgtggactgggtgcccacgtcccggaccacctggagcatccacgcccaccaccagtggatgaccacggaggacatgctgtccgtctggaaccgcgtgtggatcgaggagaacccctggatggaggacaagacccacatcagctcctggggcgacgtgccgtacctcggcaagcgggaggaccagtggtgcggcagcctgatcgggctgaccgcccgcgcgacctgggccacgaacatccaggtcgccatcaaccaggtgcggcgcctcatcggcaacgagaactacctggactacatgacctccatgaagcgcttcaagaacgagagcgaccccgagggggccctgtggtga

SEQ ID NO: 8349 - RNA, 9879 nt, synthetic construct
  misc_feature 1..9879: note = derived and/or modified CDS sequence (opt1) from DENV-1__FJ390388__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgcgacaagcggtccgtggccctcgcgccccacgtgggcctggggctggagacccgcaccgagacctggatgagctccgagggcgcctggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggagctggccgagacccagcacggcaccgtgctggtgcagatcaagtacgagggcaccgacgcgccctgcaagatccccttcagcacgcaggacgagaagggggtcacccagaacggccggctgatcaccgccaacccgatcgtgaccgacaaggagaagcccgtgaacatcgaggccgagccgcccttcggggagtcctacatcgtcatcggcgccggcgagaaggcgctcaagctgagctggttcaagaaggggtccagcatcggcaagatgttcgaggccacggcccgcggggcccggcgcatggccatcctgggcgacaccgcgtgggacttcgggtccatcggcggcgtgttcaccagcgtggggaagctcgtccaccagatcttcggcaccgcctacggggtgctgttctccggcgtgagctggacgatgaagatcgggatcggcgtcctgatgacctggctcggcctgaactcccgcagcacctccctgagcatgacctgcatcgccgtggggctcgtgacgctgtacctgggcgtcatggtgcaggccgactccgggtgcgtgatcaactggaagggccgggagctcaagtgcgggagcggcatcttcgtcaccaacgaggtgcacacctggaccgagcagtacaagttccaggccgacagcccgaagcgcctgtccgcggccatcggcaaggcctgggaggagggggtgtgcggcatccggagcgccacccgcctggagaacatcatgtggaagcagatctccaacgagctcaaccacatcctgctggagaacgacatgaagttcacggtcgtggtgggggacgtcgccggcatcctcgcgcaggggaagaagatgatccggccccagcccatggagcacaagtacagctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctgaagctgcgggacagctacacccaggtctgcgaccaccgcctcatgtccgcggccatcaaggacagcaaggccgtgcacgccgacatgggctactggatcgagtccgagaagaacgagacctggaagctggcccgggcgagcttcatcgaggtgaagacgtgcatctggcccaagtcccacaccctgtggagcaacggcgtcctcgagtccgagatgatcatccccaagatctacgggggcccgatcagccagcacaactaccgccccgggtacttcacccagaccgccggcccctggcacctggggaagctggagctcgacttcgacctgtgcgagggcacgaccgtggtggtcgacgagcactgcggcaaccgggggccgtccctgcgcaccaccacggtgaccggcaagatcatccacgagtggtgctgccggagctgcaccctgccgcccctccgcttccgcggggaggacggctgctggtacgggatggagatccgccccgtgaaggagaaggaggagaacctggtcaagtccatggtgagcgccggcagcggcgaggtggactccttcagcctcgggctgctgtgcatctccatcatgatcgaggaggtcatgcggagccgctggtcccggaagatgctcatgaccggcacgctggccgtgttcttcctgctcatcgtggggcagctgacctggaacgacctgatccgcctctgcatcatggtcggcgccaacgcgagcgaccgcatggggatgggcaccacctacctggccctgatggccacgttcaagatgcggccgatgttcgccgtggggctcctgttccgccggctgacctcccgcgaggtgctcctgctgaccatcgggctcagcctggtcgcctccgtggagctgcccaacagcctcgaggagctgggcgacgggctggcgatgggcatcatgatcctcaagctgctgaccgacttccagtcccaccagctctgggccacgctgctgagcctcaccttcatcaagaccaccttctccctgcactacgcctggaagacgatggccatggtcctgagcgtggtgtccctcttccccctgtgcctgagcaccacctcccagaagaccacgtggctccccgtcctgctgggcagcctcgggtgcaagccgctgaccatgttcctgatcgcggagaacaagatctggggccggcgctcctggcccctcaacgaggggatcatggccgtgggcatcgtgagcatcctgctgagctccctcctgaagaacgacgtccccctggccgggcccctcatcgccggcggcatgctgatcgcctgctacgtgatcagcgggtccagcgcggacctgtccctcgagaaggccgccgaggtgagctgggaggaggaggccgagcactccggcgccagccacaacatcctggtcgaggtgcaggacgacgggaccatgaagatcaaggacgaggagcgggacgacaccctgaccatcctcctgaaggcgacgctgctcgccgtgtccggcgtctacccgctgagcatccccgccaccctgttcgtgtggtacttctggcagaagaagaagcagcgctccggggtgctctgggacacccccagcccgcccgaggtcgagcgggccgtgctggacgacggcatctaccgcatcatgcagcggggcctgctggggcgctcccaggtgggcgtcggggtgttccaggagaacgtgttccacaccatgtggcacgtcacgcggggcgccgtgctcatgtaccaggggaagcgcctggagcccagctgggcgtccgtgaagaaggacctgatcagctacggcggcgggtggcggctccagggctcctggaacaccggggaggaggtccaggtgatcgccgtggagcccggcaagaaccccaagaacgtccagaccgcccccgggaccttcaagacgcccgagggcgaggtgggcgccatcgccctggacttcaagcccgggaccagcggctcccccatcgtgaaccgcgagcggaagatcgtcgggctgtacggcaacggcgtggtgaccaccagcgggacgtacgtcagcgcgatcgcccaggccaaggcctcccaggagggcccgctccccgagatcgaggacgaggtgttccgcaagcggaacctgaccatcatggacctgcaccccgggagcggcaagacccgccggtacctcccggcgatcgtgcgcgaggccatcaagcgcaagctgcggaccctgatcctcgcccccacgcgcgtcgtggcctccgagatggccgaggcgctgaaggggatgcccatccggtaccagaccaccgccgtcaagagcgagcacaccggcaaggagatcgtcgacctgatgtgccacgccacgttcaccatgcgcctcctgtcccccgtgcgggtgccgaactacaacatgatcatcatggacgaggcccacttcaccgaccccagctccatcgccgcgcgcggctacatcagcacccgggtcgggatgggcgaggccgccgccatcttcatgacggccacgccgcccgggtccgtggaggcgttcccgcagagcaacgccgtgatccaggacgaggagcgcgacatccccgagcggtcctggaacagcggctacgagtggatcaccgacttccccgggaagaccgtctggttcgtgccctccatcaagagcggcaacgacatcgccaactgcctgcgcaagaacggcaagcgggtgatccagctctcccgcaagacgttcgacaccgagtaccagaagaccaagaacaacgactgggactacgtcgtgaccacggacatcagcgagatgggggccaacttccgggcggaccgcgtgatcgacccgcggcgctgcctgaagcccgtcatcctgaaggacggccccgagcgggtgatcctcgccgggcccatgccggtcaccgtggcctccgccgcccagcgccggggccgcatcgggcgcaaccacaacaaggagggcgaccagtacatctacatgggccagcccctgaacaacgacgaggaccacgcgcactggaccgaggccaagatgctgctcgacaacatcaacacccccgaggggatcatccccgccctgttcgagccggagcgggagaagtccgccgccatcgacggcgagtaccgcctgcgcggggaggcgcgcaagacgttcgtggagctcatgcggcgcggcgacctgcccgtctggctgtcctacaaggtggccagcgaggggttccagtacagcgaccggcgctggtgcttcgacggcgagcggaacaaccaggtgctcgaggagaacatggacgtcgagatctggaccaaggagggcgagcgcaagaagctgcggccccgctggctggacgcccggacctactccgaccccctcgccctgcgcgagttcaaggagttcgccgcggggcggcgcagcgtgtccggcgacctgatcctcgagatcgggaagctgccgcagcacctgacccagcgggcccagaacgccctcgacaacctggtgatgctgcacaacagcgagcagggcggccgcgcctaccggcacgcgatggaggagctccccgacacgatcgagaccctgatgctgctcgccctgatcgccgtcctgaccgggggcgtgaccctcttcttcctgtccgggcgcggcctggggaagaccagcatcggcctcctgtgcgtgatggcctccagcgtcctgctctggatggcctccgtggagccccactggatcgcggccagcatcatcctggagttcttcctgatggtgctcctgatccccgagccggaccggcagcgcacgccccaggacaaccagctggcctacgtcgtgatcggcctcctgttcatgatcctgaccgtggccgccaacgagatggggctcctggagaccaccaagaaggacctgggcatcgggcacgtcgcggtggagaaccaccaccacgccgccatgctcgacgtggacctgcaccccgcctccgcctggacgctgtacgcggtcgccaccaccatcatcaccccgatgatgcgccacacgatcgagaacaccaccgccaacatcagcctcaccgccatcgccaaccaggcggccatcctgatgggcctggacaaggggtggcccatctccaagatggacatcggcgtgcccctcctggccctgggctgctacagccaggtgaaccccctcacgctgaccgccgcggtcctgatgctcgtggcccactacgccatcatcgggccgggcctgcaggccaaggccacccgggaggcgcagaagcgcaccgccgccgggatcatgaagaaccccacggtggacggcatcgtcgccatcgacctggaccccgtggtgtacgacgccaagttcgagaagcagctcgggcagatcatgctgctgatcctctgcacctcccagatcctgctgatgcggaccacctgggcgctctgcgagagcatcacgctggccaccggccccctgaccaccctctgggagggctccccggggaagttctggaacacgaccatcgccgtcagcatggccaacatcttccgcggctcctacctggccggggcgggcctggccttcagcctcatgaagtccctgggcgggggccggcgcgggaccggcgcccagggggagaccctgggcgagaagtggaagcggcagctcaaccagctgtccaagagcgagttcaacacgtacaagcgctccggcatcatggaggtggaccggagcgaggccaaggaggggctgaagcgcggcgagaccaccaagcacgcggtgtcccgggggaccgccaagctccgctggttcgtcgagcggaacctggtgaagcccgagggcaaggtgatcgacctggggtgcggccgcggcgggtggagctactactgcgccggcctgaagaaggtcacggaggtgaaggggtacaccaagggcgggcccggccacgaggagcccatcccgatggccacctacggctggaacctcgtgaagctgcactccgggaaggacgtcttcttcatcccgcccgagaagtgcgacaccctgctctgcgacatcggcgagagctcccccaacccgacgatcgaggaggggcggaccctgcgcgtgctgaagatggtggagccctggctccggggcaaccagttctgcatcaagatcctgaacccctacatgcccagcgtcgtggagaccctggagcagatgcagcgcaagcacgggggcatgctcgtgcggaacccgctgtcccgcaacagcacccacgagatgtactgggtctcctgcggcaccgggaacatcgtgagcgccgtgaacatgacgtcccgcatgctgctcaaccggttcaccatggcgcaccgcaagcccacctacgagcgggacgtcgacctgggcgccgggacccgccacgtggccgtggagcccgaggtcgccaacctggacatcatcggccagcggatcgagaacatcaagcacgagcacaagagcacgtggcactacgacgaggacaacccctacaagacctgggcctaccacggctcctacgaggtgaagccgagcgggtccgcgagcagcatggtcaacggcgtggtgaagctcctgaccaagccctgggacgtcatccccatggtgacccagatcgccatgacggacaccacccccttcgggcagcagcgcgtgttcaaggagaaggtcgacacccggacgccgaaggccaagcgcggcaccgcccagatcatggaggtgaccgccaagtggctgtgggggttcctctcccggaacaagaagccccgcatctgcacccgggaggagttcacgcgcaaggtgcggagcaacgcggccatcggcgccgtcttcgtggacgagaaccagtggaactccgccaaggaggcggtggaggacgagcgcttctgggacctggtccaccgggagcgcgagctgcacaagcagggcaagtgcgcgacctgcgtgtacaacatgatggggaagcgggagaagaagctcggcgagttcgggaaggccaagggcagccgcgccatctggtacatgtggctgggggcccggttcctggagttcgaggcgctcggcttcatgaacgaggaccactggttctcccgcgagaacagcctgtccggcgtggagggggagggcctgcacaagctcgggtacatcctgcgggacatcagcaagatccccggcgggaacatgtacgccgacgacaccgccggctgggacacccgcatcacggaggacgacctgcagaacgaggcccgcatcaccgacatcatggagccggagcacgccctcctggcgaagtccatcttcaagctgacctaccagaacaaggtcgtgcgggtgcagcgccccgccaagaacggcaccgtcatggacgtgatcagccggcgcgaccagcgggggtccggccaggtggggacgtacggcctcaacaccttcaccaacatggaggcccagctgatccgccagatggagagcgagggcatcttctcccccagcgagctggagacccccaacctcgccgagcgggtcctggactggctggagaagtacggggtggagcgcctcaagcggatggccatctccggcgacgactgcgtggtcaagccgatcgacgaccgcttcgcgacggccctgaccgccctgaacgacatggggaaggtgcggaaggacatcccccagtgggagcccagcaagggctggaacgactggcagcaggtccccttctgctcccaccacttccaccagctcatcatgaaggacgggcgcgagatcgtcgtgccgtgccggaaccaggacgagctggtgggccgcgcccgggtcagccagggcgccgggtggagcctgcgcgagaccgcgtgcctcggcaagtcctacgcccagatgtggcagctgatgtacttccaccggcgcgacctgcggctcgccgccaacgcgatctgcagcgccgtgcccgtggactggatccccacctcccgcacgacctggagcatccacgcccaccaccagtggatgaccaccgaggacatgctgtccgtctggaaccgcgtgtggatcgaggagaacccctggatggaggacaagacgcacatcagctcctggggcgacgtgccgtacctgggcaagcgggaggaccagtggtgcgggagcctcatcggcctgaccgcccgcgccacctgggcgaccaacatccaggtcgccatcaaccaggtgcggcgcctgatcggcaacgagaactacctcgactacatgacctccatgaagcggttcaagaacgagagcgaccccgagggggccctgtggtga

SEQ ID NO: 8350 - RNA, 9879 nt, synthetic construct
  misc_feature 1..9879: note = derived and/or modified CDS sequence (opt1) from DENV-1__FJ024464__SS-prME
  source 1..9879: mol_type = other RNA
agcgtgaccatgctgctgatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgggacaagcggtccgtggccctcgcgccccacgtgggcctggggctggagacccgcaccgagacctggatgagctccgagggcgcgtggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggagctggccgagacccagcacggcaccgtgctggtgcagatcaagtacgagggcaccgacgcgccctgcaagatccccttcagcacgcaggacgagaagggggtcacccagaacggccggctgatcaccgccaacccgatcgtgaccgacaaggagaagcccgtgaacatcgaggccgagccgcccttcggggagtcctacatcgtcatcggcgccggcgagaaggcgctcaagctgagctggttcaagaaggggtccagcatcggcaagatgttcgaggccacggcccgcggggtgcggcgcatggccatcctgggcgacaccgcctgggacttcgggtccatcggcggcgtgttcaccagcgtcgggaagctcgtgcaccagatcttcggcaccgcgtacggggtgctgttctccggcgtcagctggacgatgaagatcgggatcggcgtgctgctcacctggctgggcctgaactcccgcagcacctccctcagcatgacctgcatcgccgtggggctggtcacgctgtacctcggcgtgatggtgcaggccgactccgggtgcgtcatcaactggaagggccgggagctgaagtgcgggagcggcatcttcgtgaccaacgaggtgcacacctggaccgagcagtacaagttccaggccgacagcccgaagcgcctgtccgccgcgatcggcaaggcctgggaggagggggtctgcggcatccggagcgccacccgcctcgagaacatcatgtggaagcagatctccaacgagctgaaccacatcctgctcgagaacgacatgaagttcacggtggtggtcggggacgtggccggcatcctggcccaggggaagaagatgatccggccccagcccatggagtacaagtacagctggaagtcctggggcaaggcgaagatcatcggcgccgacgtgcagaacaccaccttcatcatcgacgggcccaacaccccggagtgccccgacgaccagcgcgcctggaacatctgggaggtcgaggactacggcttcgggatcttcacgaccaacatctggctgaagctccgggacagctacacccaggtgtgcgaccaccgcctgatgtccgccgcgatcaaggacagcaaggccgtgcacgccgacatgggctactggatcgagtccgagaagaacgagacctggaagctggcccgggccagcttcatcgaggtcaagacgtgcatctggcccaagtcccacaccctctggagcaacggcgtgctggagtccgagatgatcatccccaagatctacgggggcccgatgagccagcacaactaccgccccgggtacttcacccagaccgcgggcccctggcacctggggaagctcgagctggacttcgacctgtgcgagggcacgaccgtggtcgtggacgagcactgcggcaaccgggggccgtccctccgcaccaccacggtgaccggcaagatcatccacgagtggtgctgccggagctgcaccctgccgcccctgcgcttccgcggggaggacggctgctggtacgggatggagatccgccccgtcaaggagaaggaggagaacctcgtgaagtccatggtgagcgccggcagcggcgaggtcgactccttcagcctggggctgctctgcatctccatcatgatcgaggaggtgatgcggagccgctggtcccggaagatgctgatgaccggcacgctggccgtgttcttcctcctgatcatggggcagctgacctggaacgacctcatccgcctgtgcatcatggtcggcgccaacgccagcgaccgcatggggatgggcaccacctacctggcgctcatggccacgttcaagatgcggccgatgttcgccgtgggcctgctgttccgccggctcacctcccgcgaggtgctgctgctcaccatcgggctgagcctggtcgcctccgtggagctccccaacagcctggaggagctgggcgacgggctcgccatgggcatcatgatcctgaagctgctcaccgacttccagtcccaccagctgtgggcgacgctgctcagcctgaccttcatcaagaccaccttctccctgcactacgcctggaagacgatggccatggtcctcagcatcgtgtccctgttccccctgtgcctcagcaccacctcccagaagaccacgtggctgcccgtgctgctcggcagcctggggtgcaagccgctgaccatgttcctcatcgccgagaacaagatctggggccggcgctcctggcccctgaacgaggggatcatggcggtcggcatcgtgagcatcctgctcagctccctgctgaagaacgacgtgcccctcgccgggcccctgatcgccggcggcatgctgatcgcctgctacgtcatcagcgggtccagcgccgacctctccctggagaaggcggccgaggtgagctgggaggaggaggccgagcactccggcgccagccacaacatcctggtggaggtccaggacgacgggaccatgaagatcaaggacgaggagcgggacgacaccctcaccatcctgctgaaggccacgctcctggcggtgtccggcgtgtacccgctgagcatccccgccaccctcttcgtctggtacttctggcagaagaagaagcagcgctccggggtgctgtgggacacccccagcccgcccgaggtggagcgggccgtcctggacgacggcatctaccgcatcatgcagcggggcctgctcgggcgctcccaggtgggcgtgggggtcttccaggagaacgtgttccacaccatgtggcacgtgacgcggggcgccgtcctgatgtaccaggggaagcgcctggagcccagctgggcctccgtgaagaaggacctcatcagctacggcggcgggtggcggctgcagggctcctggaacaccggggaggaggtgcaggtcatcgcggtggagcccggcaagaaccccaagaacgtgcagaccgcccccgggaccttcaagacgcccgagggcgaggtcggcgccatcgccctggacttcaagcccgggaccagcggctcccccatcgtgaaccgcgaggggaagatcgtgggcctctacggcaacggggtcgtgaccaccagcggcacgtacgtgagcgccatcgcgcaggccaaggcctcccaggaggggccgctgcccgagatcgaggacgaggtcttccggaagcgcaacctgaccatcatggacctccaccccggcagcgggaagacccggcgctacctgccggccatcgtgcgggaggcgatcaagcgcaagctgcgcaccctcatcctggcccccacgcgggtggtcgcctccgagatggccgaggccctgaagggcatgcccatccgctaccagaccaccgcggtcaagagcgagcacaccggcaaggagatcgtggacctcatgtgccacgccacgttcaccatgcggctgctgtcccccgtccgcgtgccgaactacaacatgatcatcatggacgaggcccacttcaccgaccccagctccatcgccgcccgggggtacatcagcacccgcgtgggcatgggggaggcggccgccatcttcatgacggccacgccgcccggctccgtcgaggccttcccgcagagcaacgcggtgatccaggacgaggagcgggacatccccgagcgctcctggaacagcgggtacgagtggatcaccgacttccccggcaagaccgtgtggttcgtcccctccatcaagagcggcaacgacatcgccaactgcctccggaagaacgggaagcgcgtgatccagctgtcccggaagacgttcgacaccgagtaccagaagaccaagaacaacgactgggactacgtggtcaccacggacatcagcgagatgggcgccaacttccgcgccgaccgggtgatcgacccgcgccggtgcctgaagcccgtgatcctcaaggacgggcccgagcgcgtcatcctggcgggccccatgccggtgaccgtcgcctccgccgcccagcggcgcgggcggatcggccgcaaccacaacaaggagggcgaccagtacatctacatggggcagcccctgaacaacgacgaggaccacgcccactggaccgaggcgaagatgctcctggacaacatcaacacccccgagggcatcatccccgccctgttcgagccggagcgcgagaagtccgccgccatcgacggggagtaccggctccgcggcgaggcccggaagacgttcgtggagctgatgcgccgcggggacctgcccgtgtggctctcctacaaggtcgcgagcgagggcttccagtacagcgaccgccggtggtgcttcgacggcgagcgcaacaaccaggtgctggaggagaacatggacgtggagatctggaccaaggagggggagcggaagaagctgcgcccccggtggctcgacgcccgcacctactccgaccccctggccctgcgggagttcaaggagttcgccgccggccgccggagcgtctccggggacctcatcctggagatcggcaagctgccgcagcacctcacccagcgcgcgcagaacgccctggacaacctggtgatgctccacaacagcgagcagggcgggcgggcctaccgccacgccatggaggagctgcccgacacgatcgagaccctgatgctcctggcgctgatcgccgtgctcaccggcggggtcaccctgttcttcctgtccggccgggggctcggcaagaccagcatcggcctgctgtgcgtgatggcctccagcgtgctcctgtggatggcctccgtcgagccccactggatcgccgcgagcatcatcctggagttcttcctcatggtgctgctgatccccgagccggaccgccagcggacgccccaggacaaccagctcgcctacgtggtcatcgggctgctgttcatgatcctcaccgtggccgccaacgagatgggcctgctggagaccaccaagaaggacctcgggatcggccacgtggccgtcgagaaccaccaccacgcggccatgctggacgtggacctgcaccccgcctccgcctggacgctctacgccgtggcgaccaccatcatcaccccgatgatgcgccacacgatcgagaacaccaccgccaacatcagcctgaccgccatcgccaaccaggccgcgatcctgatggggctcgacaagggctggcccatctccaagatggacatcggcgtccccctgctggccctcgggtgctacagccaggtgaaccccctgacgctgaccgccgccgtgctcatgctggtcgcgcactacgccatcatcggcccggggctgcaggccaaggccacccgcgaggcccagaagcggaccgcggccggcatcatgaagaaccccacggtggacgggatcgtggccatcgacctcgaccccgtcgtgtacgacgccaagttcgagaagcagctgggccagatcatgctgctcatcctgtgcacctcccagatcctgctcatgcgcaccacctgggccctgtgcgagagcatcacgctggcgaccggccccctcaccaccctgtgggaggggtccccgggcaagttctggaacacgaccatcgccgtgagcatggccaacatcttccgggggtcctacctggccggcgccggcctcgcgttcagcctgatgaagtccctcgggggcgggcgccgggggaccggggcccagggcgagaccctcggcgagaagtggaagcgccagctgaaccagctgtccaagagcgagttcaacacgtacaagcggtccgggatcatggaggtcgaccgcagcgaggccaaggagggcctcaagcgcggggagaccaccaagcacgccgtgtcccgcggcaccgcgaagctgcggtggttcgtggagcgcaacctggtcaagcccgaggggaaggtgatcgacctgggctgcggccgcgggggctggagctactactgcgccgggctcaagaaggtgacggaggtcaagggctacaccaagggcggccccggccacgaggagcccatcccgatggccacctacgggtggaacctggtgaagctgcactccggcaaggacgtgttcttcatcccgcccgagaagtgcgacaccctcctgtgcgacatcggggagagctcccccaacccgacgatcgaggagggccgcaccctgcgggtcctcaagatggtggagccctggctgcgcgggaaccagttctgcatcaagatcctgaacccctacatgcccagcgtggtcgagaccctcgagcagatgcagcggaagcacggcggcatgctggtgcgcaacccgctgtcccggaacagcacccacgagatgtactgggtgtcctgcgggaccggcaacatcgtcagcgccgtgaacatgacgtcccgcatgctcctgaaccgcttcaccatggcccaccggaagcccacctacgagcgcgacgtggacctgggggcgggcacccggcacgtcgccgtggagcccgaggtggccaacctcgacatcatcggccagcgcatcgagaacatcaagcacgagcacaagagcacgtggcactacgacgaggacaacccctacaagacctgggcctaccacgggtcctacgaggtcaagccgagcggctccgccagcagcatggtgaacggggtcgtgaagctgctgaccaagccctgggacgtgatccccatggtcacccagatcgcgatgacggacaccacccccttcggccagcagcgggtgttcaaggagaaggtggacacccgcacgccgaaggccaagcgggggaccgcccagatcatggaggtcaccgccaagtggctctggggcttcctgtcccgcaacaagaagccccggatctgcacccgcgaggagttcacgcggaaggtgcgcagcaacgccgcgatcggcgccgtgttcgtcgacgagaaccagtggaactccgccaaggaggccgtggaggacgagcggttctgggacctggtgcaccgcgagcgggagctccacaagcaggggaagtgcgcgacctgcgtctacaacatgatgggcaagcgcgagaagaagctgggggagttcggcaaggccaaggggagccgggccatctggtacatgtggctgggcgcccgcttcctcgagttcgaggccctgggcttcatgaacgaggaccactggttctcccgggagaacagcctgtccggggtggagggcgaggggctccacaagctgggctacatcctgcgcgacatcagcaagatccccgggggcaacatgtacgcggacgacaccgccggctgggacacccggatcacggaggacgacctccagaacgaggcccgcatcaccgacatcatggagccggagcacgccctgctggccaagtccatcttcaagctcacctaccagaacaaggtggtccgcgtgcagcggcccgcgaagaacgggaccgtgatggacgtcatcagccgccgggaccagcgcggctccggccaggtggggacgtacggcctgaacaccttcaccaacatggaggcccagctgatccggcagatggagagcgaggggatcttctcccccagcgagctcgagacccccaacctggccaagcgcgtgctggactggctcgagaagtacggcgtcgagcggctgaagcgcatggccatctccggggacgactgcgtggtgaagccgatcgacgaccggttcgccacggcgctgaccgccctcaacgacatgggcaaggtccgcaaggacatcccccagtgggagcccagcaaggggtggaacgactggcagcaggtccccttctgctcccaccacttccaccagctgatcatgaaggacggccgggagatcgtggtcccgtgccgcaaccaggacgagctggtgggccgggcccgcgtgagccagggggccggctggagcctccgggagaccgcctgcctggggaagtcctacgcgcagatgtggcagctgatgtacttccaccgccgggacctccgcctggccgccaacgccatctgcagcgcggtccccgtggactggatccccacctcccggacgacctggagcatccacgcccaccaccagtggatgaccaccgaggacatgctgtccgtgtggaaccgcgtctggatcgaggagaacccctggatggaggacaagacgcacatcagctcctggggcgacgtgccgtacctcgggaagcgcgaggaccagtggtgcggcagcctgatcggcctgaccgcccgggccacctgggccaccaacatccaggtggcgatcaaccaggtccgccggctcatcgggaacgagaactacctggactacatgacctccatgaagcgcttcaagaacgagagcgaccccgagggcgccctgtggtga

SEQ ID NO: 8351 - RNA, 9879 nt, synthetic construct
  misc_feature 1..9879: note = derived and/or modified CDS sequence (opt1) from DENV-1__FJ410191__SS-prME
  source 1..9879: mol_type = other RNA
agcgtgaccatgctgctcatgctgatgcccaccgccctggccttccacctcacgacccggggcggggagccccacatgatcgtgtccaagcaggagcggggcaagagcctgctgttcaagacctccgccggggtgaacatgtgcaccctcatcgccatggacctgggcgagttctgcgaggacaccatgacctacaagtgcccccggatcaccgaggccgagcccgacgacgtggactgctggtgcaacgccaccgacacgtgggtgacctacgggacctgcagccagaccggcgagcaccggcgcgacaagcggtccgtggccctggcgccccacgtgggcctcgggctggagacgcgcaccgagacctggatgagctccgagggcgcctggaagcagatccagaaggtcgagacctgggccctgcggcaccccgggttcacggtgatcgccctcttcctggcgcacgccatcggcaccagcatcacccagaaggggatcatcttcatcctgctcatgctggtgaccccctccatggccatgcgctgcgtcggcatcggcagccgggacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcgcaagctgtgcatcgaggccaagatctccaacaccaccacggacagccggtgcccgacccagggcgaggccaccctcgtggaggagcaggacgccaacttcgtctgccgccggaccttcgtggaccgcggctgggggaacggctgcgggctgttcggcaaggggtccctgatcacgtgcgccaagttcaagtgcgtgaccaagctcgagggcaagaccgtccagcacgagaacctgaagtacagcgtgatcgtgaccgtccacacgggcgaccagcaccaggtggggaacgagtccaccgagcacggcaccaccgcgaccatcacgccccaggcccccagcaccgagatccagctgaccgactacggggccctcaccctggactgcagcccccggacgggcctggacttcaacgagatggtcctcctgaccatgaaggagaagtcctggctggtgcacaagcagtggttcctcgacctgccgctgccctggaccagcggggcctccaccagccaggagacgtggaaccgcaaggacctcctggtgaccttcaagaccgcccacgcgaagaagcaggaggtcgtggtgctgggctcccaggagggcgccatgcacaccgccctcacgggggccaccgagatccagaccagcggcaccacgaccatcttcgccgggcacctgaagtgccggctgaagatggacaagctcaccctgaagggcacctcctacgtcatgtgcacggggagcttcaagctggagaaggaggtggcggagacccagcacggcaccgtgctcgtccagatcaagtacgagggcaccgacgccccctgcaagatccccttctccacgcaggacgagaagggggtgacccagaacggccgcctgatcaccgccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccacggcccgcggggcccgccggatggcgatcctcggcgacaccgcctgggacttcgggagcatcggcggcgtgttcacctccgtcgggaagctggtgcaccagatcttcggcaccgcctacggggtgctgttcagcggcgtctcctggacgatgaagatcgggatcggcgtgctcctgacctggctgggcctcaacagccgctccaccagcctgtccatgacctgcatcgccgtggggctggtcacgctctacctgggcgtgatggtgcaggccgacagcgggtgcgtcatcaactggaagggccgcgagctgaagtgcgggagcggcatcttcgtgaccaacgaggtgcacacctggaccgagcagtacaagttccaggcggactccccgaagcggctcagcgccgccatcggcaaggcctgggaggagggggtctgcggcatccgctccgccacccggctggagaacatcatgtggaagcagatcagcaacgagctgaaccacatcctcctggagaacgacatgaagttcacggtggtggtcggggacgtggcgggcatcctggcccaggggaagaagatgatccgcccccagcccatggagtacaagtactcctggaagtcctggggcaaggccaagatcatcggcgccgacgtgcagaacaccaccttcatcatcgacgggcccaacaccccggagtgccccgacgaccagcgggcgtggaacatctgggaggtcgaggactacggcttcgggatcttcacgaccaacatctggctcaagctgcgcgactcctacacccaggtgtgcgaccaccggctgatgagcgccgccatcaaggactccaaggccgtgcacgccgacatgggctactggatcgagagcgagaagaacgagacctggaagctcgcgcgcgcctccttcatcgaggtcaagacgtgcatctggcccaagagccacaccctgtggtccaacggcgtgctggagagcgagatgatcatccccaagatctacgggggcccgacctcccagcacaactaccggcccgggtacttcacccagacggccggcccctggcacctcgggaagctggagctggacttcgacctctgcgagggcaccaccgtggtcgtggacgagcactgcggcaaccgcgggccgagcctgcggaccacgaccgtgaccggcaagatcatccacgagtggtgctgccgctcctgcaccctgccgcccctgcggttcaagggggaggacggctgctggtacgggatggagatccgccccgtcaaggagaaggaggagaacctggtcaagagcatggtgagcgccggctccggcgaggtcgacagcttctccctggggctcctgtgcatcagcatcatgatcgaggaggtgatgcggtcccgctggagccggaagatgctgatgacgggcaccctcgccgtgttcttcctgctgatcatggggcagctcacctggaacgacctgatccgcctgtgcatcatggtcggcgcgaacgcctccgaccggatggggatgggcaccacgtacctcgccctgatggccaccttcaagatgcgcccgatgttcgccgtggggctcctgttccgccggctgaccagccgcgaggtgctgctcctgaccatcgggctgtccctcgtcgcgagcgtggagctgcccaactccctggaggagctcggcgacgggctggccatgggcatcatgatcctgaagctcctgacggacttccagagccaccagctgtgggccaccctcctgtccctgaccttcatcaagaccacgttcagcctccactacgcctggaagaccatggcgatggtcctgtccatcgtgagcctgttccccctctgcctgtccaccaccagccagaagacgacctggctgcccgtgctcctgggctccctggggtgcaagccgctcaccatgttcctgatcgccgagaacaagatctggggccgcaagagctggcccctgaacgaggggatcatggccgtcggcatcgtgagcatcctcctgtccagcctgctcaagaacgacgtgcccctggccgggcccctgatcgccggcggcatgctcatcgcgtgctacgtcatctccgggagctccgccgacctgagcctggagaaggccgccgaggtgtcctgggaggaggaggccgagcacagcggcgcgtcccacaacatcctcgtggaggtccaggacgacgggaccatgaagatcaaggacgaggagcgcgacgacaccctgacgatcctgctcaaggccaccctgctggccgtgagcggcgtgtacccgctctccatccccgccaccctgttcgtctggtacttctggcagaagaagaagcagcggagcggggtgctgtgggacacccccagcccgcccgaggtggagcgcgccgtcctcgacgacggcatctaccggatcatgcagcgcggcctgctggggcggagccaggtgggcgtgggggtcttccaggagaacgtgttccacacgatgtggcacgtgacccgcggcgcggtcctgatgtaccaggggaagcggctcgagccctcctgggccagcgtgaagaaggacctgatctcctacggcggcgggtggcgcctgcagggcagctggaacaccggggaggaggtgcaggtcatcgccgtggagcccggcaagaaccccaagaacgtgcagaccgcccccgggacgttcaagacctccgagggcgaggtcggcgccatcgcgctcgacttcaagcccgggaccagcggcagccccatcgtgaaccgggaggggaagatcgtgggcctgtacggcaacggggtcgtgaccacgtccggcacctacgtgagcgccatcgcccaggccaaggcgtcccaggaggggcccctgccggagatcgaggacgaggtcttccgcaagcggaacctcaccatcatggacctgcaccccggcagcgggaagacccgccggtacctgcccgccatcgtgcgcgaggccatcaagcggaagctccgcacgctgatcctggccccgacccgggtggtcgcctccgagatggcggaggccctcaagggcatgcccatccgctaccagaccaccgccgtgaagggcgagcacacggggaaggagatcgtggacctgatgtgccacgccaccttcaccatgcgcctgctcagccccgtccgggtgcccaactacaacatgatcatcatggacgaggcccacttcaccgacccgtccagcatcgcggcccgcggctacatctccacgcgggtggggatgggcgaggccgccgccatcttcatgaccgcgacgccgcccgggagcgtcgaggccttcccccagtccaacgccgtgatccaggacgaggagcgcgacatcccggagcggagctggaactccggctacgagtggatcaccgacttccccggcaagacggtgtggttcgtccccagcatcaagtccgggaacgacatcgccaactgcctgcgcaagaacggcaagcgggtgatccagctgagccgcaagaccttcgacaccgagtaccagaagaccaagaacaacgactgggactacgtggtcacgaccgacatctccgagatgggggcgaacttccgggccgaccgcgtgatcgacccccggcgctgcctcaagccggtgatcctgaaggacggccccgagcgggtcatcctggccgggcccatgcccgtgaccgtcgccagcgccgcgcagcgccggggccgcatcggccggaaccacaacaaggagggggaccagtacatctacatgggccagccgctcaacaacgacgaggaccacgcccactggaccgaggccaagatgctgctggacaacatcaacacgcccgaggggatcatccccgccctcttcgagcccgagcgcgagaagtccgccgcgatcgacggcgagtaccggctgcgcggggaggcccgcaagaccttcgtggagctgatgcggcgcggcgacctcccggtgtggctgagctacaaggtcgccagcgagggcttccagtactccgaccggcgctggtgcttcgacggggagcggaacaaccaggtgctggaggagaacatggacgtggagatctggaccaaggagggcgagcgcaagaagctccggccccgctggctggacgcccggacctacagcgaccccctggccctccgcgagttcaaggagttcgcggccgggcggcgctccgtcagcggcgacctgatcctggagatcggcaagctcccccagcacctgacgcagcgggcccagaacgccctggacaacctcgtgatgctgcacaactccgagcagggcgggcgcgcgtaccggcacgccatggaggagctgccggacaccatcgagaccctcatgctgctggccctcatcgccgtgctgaccgggggcgtcaccctgttcttcctcagcgggcgcggcctgggcaagacgtccatcgggctgctctgcgtgatggccagctccgcgctgctgtggatggccagcgtggagccccactggatcgccgcctccatcatcctcgagttcttcctgatggtcctgctcatccccgagcccgaccggcagcgcaccccgcaggacaaccagctggcctacgtggtgatcggcctcctcttcatgatcctgaccgtcgcggccaacgagatggggctgctcgagaccacgaagcgggacctgggcatcgggcacgtggccgtggagaaccaccaccacgccgccatgctggacgtcgacctccaccccgcgagcgcctggaccctgtacgccgtggccaccaccatcatcacgcccatgatgcgccacaccatcgagaacaccaccgccaacatctccctgacggcgatcgccaaccaggccgccatcctcatgggcctggacaagggctggccgatcagcaagatggacatcggggtgcccctgctcgcgctgggctgctactcccaggtcaaccccctgaccctcaccgccgccgtgctgatgctggtggcccactacgccatcatcgggcccggcctccaggcgaaggccacccgggaggcccagaagcgcacggccgccgggatcatgaagaacccgaccgtcgacggcatcgtggcgatcgacctggaccccgtggtctacgacgccaagttcgagaagcagctgggccagatcatgctcctggtgctgtgcaccagccagatcctcctgatgcgcaccacgtgggccctgtgcgagtccatcaccctcgccaccgggcccctgaccacgctgtgggagggcagccccgggaagttctggaacaccaccatcgccgtgtccatggcgaacatcttccggggcagctacctcgccggcgccgggctggccttcagcctgatgaagtccctcggcgggggccgccgggggaccggcgcgcagggcgagacgctgggggagaagtggaagcgccagctgaaccagctcagcaagtccgagttcaacacctacaagcggagcggcatcatggaggtcgaccgctccgaggccaaggaggggctgaagcggggcgagaccaccaagcacgccgtgagccgcgggacggccaagctgcggtggttcgtggagcgcaacctcgtcaagccggagggcaaggtgatcgacctgggctgcgggcggggcgggtggtcctactactgcgccggcctgaagaaggtgaccgaggtcaaggggtacaccaagggcggccccgggcacgaggagcccatccccatggcgacctacggctggaacctggtgaagctccacagcgggaaggacgtgttcttcatcccgcccgagaagtgcgacacgctgctgtgcgacatcggcgagtccagccccaaccccaccatcgaggaggggcgcaccctccgggtcctgaagatggtggagccgtggctgcgcggcaaccagttctgcatcaagatcctcaacccctacatgccctccgtggtcgagaccctggagcagatgcagcggaagcacggcgggatgctggtgcgcaaccccctcagccggaactccacccacgagatgtactgggtgagctgcggcacggggaacatcgtctccgccgtgaacatgaccagccgcatgctgctgaaccggttcaccatggcccaccgcaagccgacctacgagcgcgacgtggacctcggcgccggcacgcggcacgtcgccgtggagcccgaggtggcgaacctggacatcatcgggcagcgcatcgagaacatcaagcacgagcacaagtccacctggcactacgacgaggacaacccctacaagacctgggcctaccacggcagctacgaggtcaagccctccgggagcgccagctccatggtgaacggcgtcgtgaagctgctcaccaagccgtgggacgtgatccccatggtcacgcagatcgccatgaccgacaccacccccttcgggcagcagcgggtgttcaaggagaaggtggacacgcgcacccccaaggccaagcggggcaccgcgcagatcatggaggtcaccgccaagtggctgtggggcttcctgagccgcaacaagaagccgcggatctgcacgcgcgaggagttcacccggaaggtgcgctccaacgccgccatcggggcggtgttcgtcgacgagaaccagtggaacagcgccaaggaggccgtggaggacgagcggttctgggacctcgtgcaccgcgagcgggagctgcacaagcagggcaagtgcgcgacctgcgtctacaacatgatggggaagcgcgagaagaagctgggcgagttcgggaaggccaagggctcccgggcgatctggtacatgtggctcggcgcccgcttcctggagttcgaggccctggggttcatgaacgaggaccactggttcagccgggagaactccctcagcggcgtggagggggagggcctgcacaagctggggtacatcctccgcgacatctccaagatccccggcggcaacatgtacgccgacgacaccgccgggtgggacacgcggatcaccgaggacgacctgcagaacgaggcgaagatcaccgacatcatggagcccgagcacgccctgctcgccaagagcatcttcaagctgacctaccagaacaaggtggtccgcgtgcagcggccggccaagaacggcacggtgatggacgtcatctcccgccgcgaccagcgggggagcggccaggtgggcacctacgggctgaacaccttcaccaacatcgaggcccagctcatccgccagatggagtccgaggagatcttcagcccctccgagctggagacgcccaacctggcgggccgggtgctcgactggctggagaagcacggggtcgagcgcctgaagcggatggccatcagcggcgacgactgcgtggtgaagcccatcgacgaccgcttcgccaccgccctcaccgccctgaacgacatggggaaggtccggaaggacatcccgcagtgggagccctccaagggctggaacgactggcagcaggtccccttctgcagccaccacttccaccagctgatcatgaaggacggccgcgagatcgtggtcccctgccggaaccaggacgagctcgtggggcgcgcgcgggtgagccagggcgccgggtggtccctgcgcgagaccgcctgcctgggcaagagctacgcccagatgtggcagctcatgtacttccaccggcgcgacctgcggctggcggccaacgccatctgctccgccgtcccggtggactgggtgcccacgagccgcaccacctggtccatccacgcccaccaccagtggatgaccacggaggacatgctcagcgtctggaaccgggtgtggatcgaggagaacccctggatggaggacaagacccacatctccagctggggcgacgtgccctacctgggcaagcgcgaggaccagtggtgcggctccctgatcgggctcaccgcgcgggccacctgggccaccaacatccaggtcgccatcaaccaggtgcgccgcctgatcggcaacgagaactacctggactacatgacgagcatgaagcggttcaagaacgagtccgacccggagggggccctctggtga

SEQ ID NO: 8352 - RNA, 9879 nt, synthetic construct
  misc_feature 1..9879: note = derived and/or modified CDS sequence (opt1) from DENV-1__FJ432723__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgcgggggtgaacatgtgcaccctcatcgccatggacctgggcgagctgtgcgaggacaccatgacctacaagtgcccccggatcaccgaggccgagcccgacgacgtggactgctggtgcaacgccacggacacctgggtgacctacgggacctgcagccagacgggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtggggaagctggtccaccagatcttcggcaccgcctacggggtgctgttctccggcgtgagctggaccatgaagatcgggatcggcgtcctgctgacgtggctcggcctgaactcccgcagcacctccctgagcatgacctgcatcgccgtggggctcgtgaccctgtacctgggcgtcatggtgcaggccgactccgggtgcgtgatcaactggaagggccgggagctcaagtgcgggagcggcatcttcgtcacgaacgaggtgcacacctggaccgagcagtacaagttccaggcggacagcccgaagcgcctgtccgccgccatcggcaaggcctgggaggagggggtgtgcggcatccggagcgccacccgcctggagaacatcatgtggaagcagatctccaacgagctcaaccacatcctgctggagaacgacatgaagttcaccgtcgtggtgggggacgtcgtgggcatcctcgcgcaggggaagaagatgatccggccccagcccatggagcacaagtacagctggaagtcctggggcaaggccaagatcatcggcgccgacgtgcagaacacgaccttcatcatcgacgggcccaacaccccggagtgccccgacgaccagcgcgcctggaacatctgggaggtcgaggactacggcttcgggatcttcaccacgaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacctgcatctggcccaagtcccacacgctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcaccacggtggtcgtggacgagcactgcggcaaccgggggccgtccctgcgcaccaccaccgtgacgggcaagatcatccacgagtggtgctgccggagctgcaccctgccgcccctccgcttcaagggggaggacggctgctggtacgggatggagatccggcccgtcaaggagaaggaggagaacctggtgaagtccatggtgagcgccggcagcggcgaggtcgactccttcagcctcgggctgctgtgcatctccatcatgatcgaggaggtgatgcgcagccggtggtcccgcaagatgctcatgaccggcaccctggccgtgttcctgctcctgatcatggggcagctgacgtggaacgacctcatccggctgtgcatcatggtcggcgccaacgcgagcgaccgcatggggatgggcaccacctacctggccctcatcgccaccttcaagatgcgcccgatgttcgccgtggggctgctgttccggcgcctcacgtcccgggaggtgctgctgctcaccatcgggctgagcctggtcgcctccgtggagctccccaacagcctggaggagctgggcgacgggctcgcgatgggcatcatgatcctgaagctgctcaccgacttccagtcccaccagctgtgggccaccctgctcagcttcacgttcatcaagaccaccctgtccctgcactacgcctggaagaccatggccatggtcctcagcatcgtgtccctgttccccctgtgcctcagcacgacctcccagaagaccacctggctgcccgtgctgctcggcagcctggggtgcaagccgctgacgatgttcctcatcgcggagaacaagatctggggccgcaagtcctggcccctgaacgaggggatcatggccgtcggcgtggtgagcatcctgctcagctccctgctgaagaacgacgtccccctcgccgggcccctgatcgccggcggcatgctgatcgcctgctacgtgatcagcgggtccagcgcggacctctccctggagaaggccgccgaggtgagctgggaggaggaggccgagcactccggcgccagccacaacatcctggtcgaggtgcaggacgacgggaccatgaagatcaaggacgaggagcgggacgacaccctcaccatcctgctgaaggcgaccctcctggccgtgtccggcgtctacccgctgagcatccccgccaccctcttcgtgtggtacttctggcagaagaagaagcagcgctccggggtgctgtgggacacccccagcccgcccgaggtcgagcgggccgtgctggacgacggcatctaccgcatcatgcagcggggcctgctcgggcgctcccaggtgggcgtcggggtgttccaggagaacgtgttccacaccatgtggcacgtcacccggggcgccgtgctgatgtaccaggggaagcgcctggagcccagctgggcgtccgtgaagaaggacctcatcagctacggcggcgggtggcggctgcagggctcctggaacacgggggaggaggtccaggtgatcgccgtggagcccggcaagaaccccaagaacgtccagaccgcccccgggaccttcaagacccccgagggcgaggtgggcgccatcgccctggacttcaagcccgggacgagcggctcccccatcgtgaaccgcgaggggaagatcgtcggcctctacggcaacggggtggtgaccaccagcggcacctacgtcagcgcgatcgcccaggccaaggcctcccaggaggggccgctgcccgagatcgaggacgaggtgttccggaagcgcaacctgacgatcatggacctccaccccggcagcgggaagacccggcgctacctgccggcgatcgtgcgggaggccatcaagcgcaagctgcggaccctcatcctggcccccacccgcgtcgtggcctccgagatggccgaggcgctgaagggcatgcccatccgctaccagacgaccgccgtcaagagcgagcacaccggcaaggagatcgtcgacctcatgtgccacgccaccttcacgatgcggctgctgtcccccgtgcgcgtgccgaactacaacatgatcatcatggacgaggcccacttcaccgaccccagctccatcgccgcgcgggggtacatcagcacccgcgtcggcatgggggaggccgccgccatcttcatgaccgccacgccgcccggctccgtggaggcgttcccgcagagcaacgccgtgatccaggacgaggagcgggacatccccgagcgctcctggaacagcgggtacgagtggatcaccgacttccccggcaagaccgtctggttcgtgccctccatcaagagcggcaacgacatcgccaactgcctccggaagaacgggaagcgcgtgatccagctgtcccggaagaccttcgacacggagtaccagaagaccaagaacaacgactgggactacgtcgtgaccaccgacatcagcgagatgggcgccaacttccgcgcggaccgggtgatcgacccgcgccggtgcctgaagcccgtcatcctcaaggacgggcccgagcgcgtgatcctggccggccccatgccggtcacggtggcctccgccgcccagcggcgcgggcggatcggccgcaaccacaacaaggagggcgaccagtacatctacatggggcagcccctgaacaacgacgaggaccacgcgcactggaccgaggccaagatgctcctggacaacatcaacacccccgagggcatcatccccgccctgttcgagccggagcgggagaagtccgccgccatcgacggggagtaccgcctccgcggcgaggcgcggaagaccttcgtggagctgatgcgccgcggggacctgcccgtctggctctcctacaaggtggccagcgagggcttccagtacagcgaccgccggtggtgcttcgacggcgagcgcaacaaccaggtgctggaggagaacatggacgtcgagatctggacgaaggagggggagcggaagaagctgcgcccccggtggctcgacgcccgcacctactccgaccccctggccctgcgggagttcaaggagttcgccgcgggccgccggagcgtgtccggggacctcatcctggagatcggcaagctgccgcagcacctcacccagcgcgcccagaacgccctggacaacctggtgatgctccacaacagcgagcagggcgggcgggcctaccgccacgcgatggaggagctgcccgacaccatcgagacgctgatgctcctggccctgatcgccgtcctcaccggcggggtgaccctgttcttcctgtccggccgggggctcggcaagaccagcatcggcctgctgtgcgtgatggcctccagcgtcctcctgtggatggcctccgtggagccccactggatcgcggccagcatcatcctggagttcttcctcatggtgctgctgatccccgagccggaccgccagcggacgccccaggacaaccagctcgcctacgtcgtgatcgggctgctgttcatgatcctcacggtggccgccaacgagatgggcctgctggagaccaccaagaaggacctcgggatcggccacgtcgcggtggagaaccaccaccacgccaccatgctggacgtggacctgcaccccgcctccgcctggacgctctacgccgtcgcgaccaccatcatcaccccgatgatgcgccacacgatcgagaacaccaccgccaacatcagcctgaccgccatcgccaaccaggccgcgatcctgatggggctcgacaagggctggcccatctccaagatggacatcggcgtgcccctgctggccctcgggtgctacagccaggtgaaccccctgacgctgaccgccgccgtcctcatgctggtggcgcactacgccatcatcggcccggggctgcaggccaaggccacccgggaggcccagaagcgcaccgcggccggcatcatgaagaaccccacggtggacgggatcgtcgccatcgacctcgaccccgtggtgtacgacgccaagttcgagaagcagctgggccagatcatgctgctcatcctgtgcacctcccagatcctgctcatgcgcaccacctgggccctgtgcgagagcatcacgctggcgaccggccccctcaccaccctgtgggaggggtccccgggcaagttctggaacacgaccatcgccgtcagcatggccaacatcttccgggggtcctacctggccggcgccggcctcgcgttcagcctgatgaagtccctcgggggcgggcgccgggggaccggggcccagggcgagaccctcggcgagaagtggaagcgccagctgaaccagctgtccaagagcgagttcaacacgtacaagcggtccgggatcatggaggtggaccgcagcgaggccaaggagggcctcaagcgcggggagaccacccgccacgccgtgtcccggggcaccgcgaagctgcgctggttcgtcgagcggaacctggtgaagcccgaggggaaggtgatcgacctgggctgcggccgcgggggctggagctactactgcgccgggctcaagaaggtcacggaggtgaagggctacaccaagggcgggcccggccacgaggagcccatcccgatggccacctacgggtggaacctggtgaagctgcactccggcaaggacgtcttcttcacgccgcccgagaagtgcgacacgctcctgtgcgacatcggggagagctcccccaacccgaccatcgaggagggccggaccctgcgcgtgctcaagatggtggagccctggctgcgggggaaccagttctgcatcaagatcctgaacccctacatgcccagcgtcgtggagaccctcgagcagatgcagcgcaagcacggcggcatgctggtgcggaacccgctgtcccgcaacagcacccacgagatgtactgggtctcctgcgggacgggcaacatcgtgagcgccgtgaacatgacctcccggatgctcctgaaccgcttcaccatggcccaccgcaagcccacctacgagcgggacgtcgacctgggggcgggcacgcgccacgtggccgtggagcccgaggtcgccaacctcgacatcatcggccagcggatcgagaacatcaagcacgagcacaagagcacctggcactacgacgaggacaacccctacaagacctgggcctaccacgggtcctacgaggtgaagccgagcggctccgccagcagcatggtcaacggggtggtgaagctgctgaccaagccctgggacgtcatccccatggtgacgcagatcgcgatgaccgacaccacccccttcggccagcagcgcgtgttcaaggagaaggtcgacacgcggaccccgaaggccaagcgcgggaccgcccagatcatggaggtgaccgccaagtggctctggggcttcctgtcccggaacaagaagccccgcatctgcacgcgggaggagttcacccgcaaggtgcggagcaacgccgcgatcggcgccgtcttcgtggacgagaaccagtggaactccgccaaggaggccgtggaggacgagcgcttctgggacctggtccagaaggagcgggagctccacaagcaggggaagtgcgcgacctgcgtgtacaacatgatgggcaagcgcgagaagaagctgggggagttcggcaaggccaaggggagccgggccatctggtacatgtggctgggcgcccgcttcctcgagttcgaggccctgggcttcatgaacgaggaccactggttctcccgggagaacagcctgtccggggtggagggcgaggggctccacaagctgggctacatcctgcgcgacatcagcaagatccccgggggcaacatgtacgcggacgacaccgccggctgggacacgcggatcaccgaggacgacctccagaacgaggccaagatcaccgacatcatggagccggagcacgccctgctggccacctccatcttcaagctcacgtaccagaacaaggtcgtgcgcgtgcagcggcccgcgaagaacgggaccgtcatggacgtgatcagccgccgcgaccagcggggctccggccaggtgggcacctacggcctgaacaccttcacgaacatggaggcccagctgatccgccagatggagagcgaggggatcttcctccccggcgagctggagacccccaacctggccgagcgggtcctcgactggctggagaagtacggggtggagcgcctgaagcggatggccatctccggcgacgactgcgtggtcaagccgatcgacgaccgcttcgccaccgcgctcaccgccctgaacgacatggggaaggtgcggaaggacatcccccagtgggagcccagcaagggctggaacgactggcagcaggtccccttctgctcccaccacttccaccagctgatcatgaaggacggccgcgagatcgtcgtgccgtgccggaaccaggacgagctcgtggggcgcgcccgggtcagccagggcgccgggtggtccctgcgcgagacggcctgcctgggcaagagctacgcgcagatgtggcagctcatgtacttccaccggcgcgacctgcggctggccgccaacgccatctgcagcgcggtgcccgtggactgggtccccacctcccgcaccacctggagcatccacgcccaccaccagtggatgacgaccgaggacatgctctccgtgtggaaccgggtgtggatcgaggagaacccctggatggaggacaagacccacgtcagctcctggggcgacgtgccgtacctgggcaagcgcgaggaccagtggtgcggcagcctgatcgggctcaccgcccgggccacctgggcctccaacatccaggtggcgatcaaccaggtccgccgcctgatcggcaacgagaactacctggactacatgacgagcatgaagcggttcaagaacgagggggaccccgagggcgccctctggtga

SEQ ID NO: 8353 - RNA, 9879 nt, synthetic construct
  misc_feature 1..9879: note = derived and/or modified CDS sequence (opt1) from DENV-1__FJ410192__SS-prME
  source 1..9879: mol_type = other RNA
agcgtgaccatgctgctgatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgggacaagcggtccgtggccctcgcgccccacgtgggcctggggctggagacccgcaccgagacctggatgagctccgagggcgcctggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggagctggccgagacccagcacggcaccgtgctggtgcagatcaagtacgagggcaccgacgcgccctgcaagatccccttcagcacgcaggacgagaagggggtcacccagaacggccggctgatcaccgccaacccgatcgtgaccgacaaggagaagcccgtgaacatcgaggccgagccgcccttcggggagtcctacatcgtcatcggcgccggcgagaaggcgctcaagctgagctggttcaagaaggggtccagcatcggcaagatgttcgaggccacggcccgcggggcccggcgcatggccatcctgggcgacaccgcgtgggacttcgggtccatcggcggcgtgttcaccagcgtggggaagctcgtccaccagatcttcggcaccgcctacggggtgctgttctccggcgtgagctggacgatgaagatcgggatcggcgtcctgctcacctggctgggcctgaactcccgcagcacctccctcagcatgacctgcatcgccgtggggctggtgacgctgtacctcggcgtcatggtgcaggccgactccgggtgcgtgatcaactggaagggccgggagctgaagtgcgggagcggcatcttcgtcaccaacgaggtgcacacctggaccgagcagtacaagttccaggccgacagcccgaagcgcctgtccgcggccatcggcaaggcctgggaggagggggtgtgcggcatccggagcgccacccgcctcgagaacatcatgtggaagcagatctccaacgagctgaaccacatcctgctcgagaacgacatgaagttcacggtcgtggtgggggacgtcgccggcatcctggcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctgaagctccgggacagctacacccaggtctgcgaccaccgcctgatgtccgcggccatcaaggacagcaaggccgtgcacgccgacatgggctactggatcgagtccgagaagaacgagacctggaagctggcccgggcgagcttcatcgaggtgaagacgtgcatctggcccaagtcccacaccctctggagcaacggcgtcctggagtccgagatgatcatccccaagatctacgggggcccgatcagccagcacaactaccgccccgggtacttcacccagaccgccggcccctggcacctggggaagctcgagctggacttcgacctgtgcgagggcacgaccgtggtggtcgacgagcactgcggcaaccgggggccgtccctccgcaccaccacggtgaccggcaagatcatccacgagtggtgctgccggagctgcaccctgccgcccctgcgcttccgcggggaggacggctgctggtacgggatggagatccgccccgtgaaggagaaggaggagaacctcgtcaagtccatggtgagcgccggcagcggcgaggtggactccttcagcctggggctgctctgcatctccatcatgatcgaggaggtcatgcggagccgctggtcccggaagatgctgatgaccggcacgctggccgtgttcttcctcctgatcatggggcagctgacctggaacgacctcatccgcctgtgcatcatggtgggcgccaacgcgagcgaccgcatggggatgggcaccacctacctggccctcatggccacgttcaagatgcggccgatgttcgccgtcggcctgctgttccgccggctcacctcccgcgaggtgctgctgctcaccatcgggctgagcctggtggcctccgtcgagctccccaacagcctggaggagctgggcgacgggctcgcgatgggcatcatgatcctgaagctgctcaccgacttccagtcccaccagctgtgggccacgctgctcagcctgaccttcatcaagaccaccttctccctgcactacgcctggaagacgatggccatgatcctcagcatcgtgtccctgttccccctgtgcctcagcaccacctcccagaagaccacgtggctgcccgtcctgctcggcagcctggggtgcaagccgctgaccatgttcctcatcgcggagaacaagatctggggccggcgctcctggcccctgaacgaggggatcatggccgtgggcatcgtgagcatcctgctcagctccctgctgaagaacgacgtccccctcgccgggcccctgatcgccggcggcatgctgatcgcctgctacgtgatcagcgggtccagcgcggacctctccctggagaaggccgccgaggtgagctgggaggaggaggccgagcactccggcgccagccacaacatcctggtcgaggtgcaggacgacgggaccatgaagatcaaggacgaggagcgggacgacaccctcaccatcctgctgaaggcgacgctcctggccgtgtccggcgtctacccgctgagcatccccgccaccctcttcgtgtggtacttctggcagaagaagaagcagcgctccggggtgctgtgggacacccccagcccgcccgaggtcgagcgggccgtgctggacgacggcatctaccgcatcatgcagcggggcctgctcgggcgctcccaggtgggcgtcggggtgttccaggagaacgtgttccacaccatgtggcacgtcacgcggggcgccgtgctgatgtaccaggggaagcgcctggagcccagctgggcgtccgtgaagaaggacctcatcagctacggcggcgggtggcggctgcagggctcctggaacaccggggaggaggtccaggtgatcgccgtggagcccggcaagaaccccaagaacgtccagaccgcccccgggaccttcaagacgcccgagggcgaggtgggcgccatcgccctggacttcaagcccgggaccagcggctcccccatcgtgaaccgcgaggggaagatcgtcggcctctacggcaacggggtggtgaccaccagcggcacgtacgtcagcgcgatcgcccaggccaaggcctcccaggaggggccgctgcccgagatcgaggacgaggtgttccggaagcgcaacctgaccatcatggacctccaccccggcagcgggaagacccggcgctacctgccggcgatcgtgcgggaggccatcaagcgcaagctgcgcaccctcatcctggcccccacgcgggtcgtggcctccgagatggccgaggcgctgaagggcatgcccatccgctaccagaccaccgccgtcaagagcgagcacaccggcaaggagatcgtcgacctcatgtgccacgccacgttcaccatgcggctgctgtcccccgtgcgcgtgccgaactacaacatgatcatcatggacgaggcccacttcaccgaccccagctccatcgccgcgcgggggtacatcagcacccgcgtcggcatgggggaggccgccgccatcttcatgacggccacgccgcccggctccgtggaggcgttcccgcagagcaacgccgtgatccaggacgaggagcgggacatccccgagcgctcctggaacagcgggtacgagtggatcaccgacttccccggcaagaccgtctggttcgtgccctccatcaagagcggcaacgacatcgccaactgcctccggaagaacgggaagcgcgtgatccagctgtcccggaagacgttcgacaccgagtaccagaagaccaagaacaacgactgggactacgtcgtgaccacggacatcagcgagatgggcgccaacttccgcgcggaccgggtgatcgacccgcgccggtgcctgaagcccgtcatcctcaaggacgggcccgagcgcgtgatcctggccggccccatgccggtgaccgtcgcctccgccgcccagcggcgcgggcggatcggccgcaaccacaacaaggagggcgaccagtacatctacatggggcagcccctgaacaacgacgaggaccacgcgcactggaccgaggccaagatgctcctggacaacatcaacacccccgagggcatcatccccgccctgttcgagccggagcgcgagaagtccgccgccatcgacggggagtaccggctccgcggcgaggcgcggaagacgttcgtggagctgatgcgccgcggggacctgcccgtctggctctcctacaaggtggccagcgagggcttccagtacagcgaccgccggtggtgcttcgacggcgagcgcaacaaccaggtgctggaggagaacatggacgtcgagatctggaccaaggagggggagcggaagaagctgcgcccccggtggctcgacgcccgcacctactccgaccccctggccctgcgggagttcaaggagttcgccgcgggccgccggagcgtgtccggggacctcatcctggagatcggcaagctgccgcagcacctcacccagcgcgcccagaacgccctggacaacctggtgatgctccacaacagcgagcagggcgggcgggcctaccgccacgcgatggaggagctgcccgacacgatcgagaccctgatgctcctggccctgatcgccgtcctcaccggcggggtgaccctgttcttcctgtccggccgggggctcggcaagaccagcatcggcctgctgtgcgtgatggcctccagcgtcctcctgtggatggcctccgtggagccccactggatcgcggccagcatcatcctggagttcttcctcatggtgctgctgatccccgagccggaccgccagcggacgccccaggacaaccagctcgcctacgtcgtgatcgggctgctgttcatgatcctcaccgtggccgccaacgagatgggcctgctggagaccaccaagaaggacctcgggatcggccacgtcgcggtggagaaccaccaccacgccgccatgctggacgtggacctgcaccccgcctccgcctggacgctctacgcggtcgccaccaccatcatcaccccgatgatgcgccacacgatcgagaacaccaccgccaacatcagcctgaccgccatcgccaaccaggcggccatcctgatggggctcgacaagggctggcccatctccaagatggacatcggcgtgcccctgctggccctcgggtgctacagccaggtgaaccccctgacgctgaccgccgcggtcctcatgctggtggcccactacgccatcatcggcccggggctgcaggccaaggccacccgcgaggcgcagaagcggaccgccgccggcatcatgaagaaccccacggtggacgggatcgtcgccatcgacctcgaccccgtggtgtacgacgccaagttcgagaagcagctgggccagatcatgctgctcatcctgtgcacctcccagatcctgctcatgcgcaccacctgggcgctgtgcgagagcatcacgctggccaccggccccctcaccaccctgtgggaggggtccccgggcaagttctggaacacgaccatcgccgtcagcatggccaacatcttccgggggtcctacctggccggcgcgggcctcgccttcagcctgatgaagtccctcgggggcgggcgccgggggaccggggcccagggcgagaccctcggcgagaagtggaagcgccagctgaaccagctgtccaagagcgagttcaacacgtacaagcggtccgggatcatggaggtggaccgcagcgaggccaaggagggcctcaagcgcggggagaccaccaagcacgcggtgtcccgcggcaccgccaagctgcggtggttcgtcgagcgcaacctggtgaagcccgaggggaaggtgatcgacctgggctgcggccgcggcgggtggagctactactgcgccgggctcaagaaggtcacggaggtgaaggggtacaccaagggcggccccggccacgaggagcccatcccgatggccacctacgggtggaacctggtgaagctgcactccggcaaggacgtcttcttcatcccgcccgagaagtgcgacaccctcctgtgcgacatcggggagagctcccccaacccgacgatcgaggagggccgcaccctgcgggtgctcaagatggtggagccctggctgcgcgggaaccagttctgcatcaagatcctgaacccctacatgcccagcgtcgtggagaccctcgagcagatgcagcggaagcacggcggcatgctggtgcgcaacccgctgtcccggaacagcacccacgagatgtactgggtctcctgcgggaccggcaacatcgtgagcgccgtgaacatgacgtcccgcatgctcctgaaccgcttcaccatggcgcaccggaagcccacctacgagcgcgacgtcgacctgggggccggcacccggcacgtggccgtggagcccgaggtcgccaacctcgacatcatcggccagcgcatcgagaacatcaagcacgagcacaagagcacgtggcactacgacgaggacaacccctacaagacctgggcctaccacgggtcctacgaggtgaagccgagcggctccgcgagcagcatggtgaacggggtcgtgaagctgctgaccaagccctgggacgtcatccccatggtgacccagatcgccatgacggacaccacccccttcggccagcagcgggtgttcaaggagaaggtcgacacccgcacgccgaaggccaagcgggggaccgcccagatcatggaggtgaccgccaagtggctctggggcttcctgtcccgcaacaagaagccccggatctgcacccgcgaggagttcacgcggaaggtgcgcagcaacgcggccatcggcgccgtcttcgtggacgagaaccagtggaactccgccaaggaggcggtggaggacgagcggttctgggacctggtccaccgcgagcgggagctccacaagcaggggaagtgcgcgacctgcgtgtacaacatgatgggcaagcgcgagaagaagctgggggagttcggcaaggccaaggggagccgggccatctggtacatgtggctgggcgcccgcttcctcgagttcgaggcgctgggcttcatgaacgaggaccactggttctcccgggagaacagcctgtccggggtggagggcgaggggctccacaagctgggctacatcctgcgcgacatcagcaagatccccgggggcaacatgtacgccgacgacaccgccggctgggacacccggatcacggaggacgacctccagaacgaggcccgcatcaccgacatcatggagccggagcacgccctgctggcgaagtccatcttcaagctcacctaccagaacaaggtcgtgcgcgtgcagagccccgccaagaacgggaccgtcatggacgtgatctcccggcgcgaccagcggggcagcggccaggtggggacgtacggcctgaacaccttcaccaacatggaggcccagctgatccgccagatggagtccgaggggatcttcagcccctccgagctcgagacccccaacctggccgagcgggtcctggactggctcgagaagtacggcgtggagcgcctgaagcggatggccatcagcggggacgactgcgtggtcaagccgatcgacgaccgcttcgcgacggccctgaccgccctcaacgacatgggcaaggtgcggaaggacatcccccagtgggagccctccaaggggtggaacgactggcagcaggtccccttctgcagccaccacttccaccagctgatcatgaaggacggccgcgagatcgtcgtgccgtgccggaaccaggacgagctggtgggccgcgcccgggtcagccagggggccggctggtccctccgcgagaccgcgtgcctgggcaagagctacgcccagatgtggcagctgatgtacttccaccggcgcgacctccggctggccgccaacgcgatctgctccgccgtgcccgtggactggatccccaccagccgcacgacctggtccatccacgcccaccaccagtggatgaccaccgaggacatgctgagcgtctggaaccgggtgtggatcgaggagaacccctggatggaggacaagacgcacatctccagctggggcgacgtgccgtacctcgggaagcgcgaggaccagtggtgcggctccctgatcggcctgaccgcccgcgccacctgggcgaccaacatccaggtcgccatcaaccaggtgcggcgcctcatcgggaacgagaactacctggactacatgaccagcatgaagcggttcaagaacgagtccgaccccgagggcgccctgtggtga

SEQ ID NO: 8354 - RNA, 9879 nt, synthetic construct
  misc_feature 1..9879: note = derived and/or modified CDS sequence (opt1) from DENV-1__FJ410194__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgagaccgagcccgacgacgtggactgctggtgcaacgccacggacacctgggtgacctacgggacctgcagccagacgggcgagcaccggcgcgacaagcggtccgtggccctcgcgccccacgtgggcctggggctggagacccgcaccgagacctggatgagctccgagggcgcgtggaagcagatccagcgggtcgagacgtgggccctccgccacccggggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgccccacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgccgctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtcgggaagctggtgcaccagatcttcggcaccgcctacggggtgctgttctccggcgtcagctggacgatgaagatcgggatcggcgtgctgctgacctggctcggcctgaactcccgcagcacctccctgagcatgacctgcatcgccgtggggctcgtcacgctgtacctgggcgtgatggtgcaggccgactccgggtgcgtcatcaactggaagggccgggagctcaagtgcgggagcggcatcttcgtgaccaacgaggtgcacacctggaccgagcagtacaagttccaggccgacagcccgaagcgcctgtccgcggccatcggcaaggcctgggaggagggggtctgcggcatccggagcgccacccgcctggagaacatcatgtggaagcagatctccaacgagctcaaccacatcctgctggagaacgacatgaagttcacggtggtggtcggggacgtggccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtcgaggactacggcttcgggatcttcacgaccaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacgtgcatctggcccaagtcccacaccctgtggagcaacggcgtgctcgagtccgagatgatcatccccaagatctacgggggcccgatcagccagcacaactaccgccccgggtacttcacccaggccgccggcccctggcacctggggaagctggagctcgacttcgacctgtgcgagggcaccacggtggtcgtggacgagcactgcggcaaccgggggccgtccctgcgcaccaccaccgtgacgggcaagatcatccacgagtggtgctgccggagctgcaccctgccgcccctccgcttccgcggggaggacggctgctggtacgggatggagatccgccccgtcaaggagaaggaggagaacctggtgaagtccatggtgagcgccggcagcggcgaggtcgactccttcagcctcgggctgctgtgcatctccatcatgatcgaggaggtgatgcggagccgctggtcccggcgcatgctcatgaccggcaccctggccgtgttcttcctgctcatcatggggcagctgacgtggaacgacctgatccgcctctgcatcatggtcggcgcgaacgccagcgaccggatggggatgggcaccacctacctggccctgatggccaccttcaagatgcgcccgatgttcgccgtgggcctcctgttccggcgcctgacgtcccgggaggtgctcctgctgaccatcgggctcagcctggtcgcgtccgtggagctgcccaacagcctcgaggagctgggcgacgggctggccatgggcatcatgatcctcaagctgctgaccgacttccagtcccaccagctctgggccaccctgctgagcctcacgttcatcaagaccaccttctccctgcactacgcctggaagaccatggcgatggtcctgagcatcgtgtccctcttccccctgtgcctgagcacgacctcccagaagaccacctggctccccgtgctgctgggcagcctcgggtgcaagccgctgacgatgttcctgatcgccgagaacaagatctggggccgccggtcctggcccctcaacgaggggatcatggccgtcggcatcgtgagcatcctgctgagctccctcctgaagaacgacgtgcccctggccgggcccctcatcgccggcggcatgctgatcgcgtgctacgtcatcagcgggtccagcgccgacctgtccctcgagaaggccgccgaggtgagctgggaggaggaggccgagcactccggcgcgagccacaacatcctggtggaggtccaggacgacgggaccatgaagatcaaggacgaggagcgcgacgacaccctgaccatcctcctgaaggccaccctgctcgccgtgtccggcgtgtacccgctgagcatccccgccacgctgttcgtctggtacttctggcagaagaagaagcagcggtccggggtgctctgggacacccccagcccgcccgaggtggagcgcgccgtcctggacgacggcatctaccggatcatgcagcgcggcctgctggggcggtcccaggtgggcgtgggggtcttccaggagaacgtgttccacaccatgtggcacgtgacccgcggcgcggtcctcatgtaccaggggaagcggctggagcccagctgggcctccgtgaagaaggacctgatcagctacggcggcgggtggcgcctccagggctcctggaacacgggggaggaggtgcaggtcatcgccgtggagcccggcaagaaccccaagaacgtgcagaccgcccccgggaccttcaagacccccgagggcgaggtcggcgccatcgcgctggacttcaagcccgggacgagcggctcccccatcgtgaaccgggaggggaagatcgtgggcctgtacggcaacggggtcgtgaccaccagcggcacctacgtgagcgccatcgcccaggccaaggcgtcccaggaggggccgctccccgagatcgaggacgaggtcttccgcaagcggaacctgacgatcatggacctgcaccccggcagcgggaagacccgccggtacctcccggccatcgtgcgcgaggccatcaagcgcaagctgcggaccctgatcctcgcccccacccgcgtggtcgcctccgagatggcggaggccctgaagggcatgcccatccggtaccagacgaccgccgtcaagagcgagcacaccggcaaggagatcgtggacctgatgtgccacgccaccttcacgatgcgcctcctgtcccccgtccgggtgccgaactacaacatgatcatcatggacgaggcccacttcaccgaccccagctccatcgcggcccgcgggtacatcagcacccgggtgggcatgggggaggccgccgccatcttcatgaccgcgacgccgcccggctccgtcgaggccttcccgcagagcaacgccgtgatccaggacgaggagcgcgacatccccgagcggtcctggaacagcgggtacgagtggatcaccgacttccccggcaagaccgtgtggttcgtcccctccatcaagagcggcaacgacatcgccaactgcctgcgcaagaacgggaagcgggtgatccagctctcccgcaagaccttcgacacggagtaccagaagaccaagaacaacgactgggactacgtggtcaccaccgacatcagcgagatgggcgcgaacttccgggccgaccgcgtgatcgacccgcggcgctgcctgaagcccgtgatcctgaaggacgggcccgagcgggtcatcctcgccggccccatgccggtgacggtcgcctccgccgcgcagcgccgggggcgcatcggccgcaaccacaacaaggagggcgaccagtacatctacatggggcagcccctgaacaacgacgaggaccacgcccactggaccgaggccaagatgctgctcgacaacatcaacacccccgagggcatcatccccgccctgttcgagccggagcgggagaagtccgccgcgatcgacggggagtaccgcctgcggggcgaggcccgcaagaccttcgtggagctcatgcggcgcggggacctgcccgtgtggctgtcctacaaggtcgccagcgagggcttccagtacagcgaccggcgctggtgcttcgacggcgagcggaacaaccaggtgctcgaggagaacatggacgtggagatctggacgaaggagggggagcgcaagaagctgcggccccgctggctggacgcccggacctactccgaccccctcgccctgcgcgagttcaaggagttcgcggccggccggcgcagcgtctccggggacctgatcctcgagatcggcaagctgccgcagcacctgacccagcgggcccagaacgccctcgacaacctggtgatgctgcacaacagcgagcagggcgggcgcgcgtaccggcacgccatggaggagctccccgacaccatcgagacgctgatgctgctcgccctgatcgccgtgctgaccggcggggtcaccctcttcttcctgtccggccgcgggctgggcaagaccagcatcggcctcctgtgcgtgatggcctccagcgtgctgctctggatggcgtccgtcgagccccactggatcgccgccagcatcatcctggagttcttcctgatggtgctcctgatccccgagccggaccggcagcgcacgccccaggacaaccagctggcctacgtggtcatcgggctcctgttcatgatcctgacggtggccgcgaacgagatgggcctcctggagaccaccaagaaggacctggggatcggccacgtggccgtcgagaaccaccaccacgccgccatgctcgacgtggacctgcaccccgcctccgcgtggaccctgtacgccgtggccacgaccatcatcaccccgatgatgcgccacaccatcgagaacacgaccgccaacatcagcctcaccgccatcgcgaaccaggccgccatcctgatggggctggacaagggctggcccatctccaagatggacatcggcgtccccctcctggccctggggtgctacagccaggtgaaccccctcaccctgacggcggccgtgctgatgctcgtcgcccactacgccatcatcggcccggggctgcaggccaaggcgacccgggaggcccagaagcgcaccgccgccggcatcatgaagaaccccaccgtggacgggatcgtggccatcgacctggaccccgtcgtgtacgacgcgaagttcgagaagcagctcggccagatcatgctgctgatcctctgcacgtcccagatcctgctgatgcggaccacctgggccctctgcgagagcatcaccctggccacgggccccctgaccaccctctgggaggggtccccgggcaagttctggaacaccacgatcgccgtgagcatggccaacatcttccgcgggtcctacctggcgggcgccggcctggccttcagcctcatgaagtccctcgggggcgggcggcgcgggaccggggcccagggcgagaccctgggcgagaagtggaagcggcagctcaaccagctgtccaagagcgagttcaacacctacaagcgctccgggatcatggaggtcgaccggagcgaggcgaaggagggcctgaagcgcggggagacgaccaagcacgccgtgtcccggggcaccgccaagctccgctggttcgtggagcggaacctggtcaagcccgaggggaaggtgatcgacctgggctgcggccgcgggggctggagctactactgcgccgggctgaagaaggtgaccgaggtcaagggctacacgaagggcgggcccggccacgaggagcccatcccgatggccacctacgggtggaacctcgtgaagctgccctccggcaaggacgtgttcttcatcccgcccgagaagtgcgacaccctgctctgcgacatcggggagagctccccgaaccccaccatcgaggagggccggacgctgcgcgtcctgaagatggtggagccctggctccgggggaaccagttctgcatcaagatcctgaacccctacatgccgagcgtggtcgagaccctggagcagatgcagcgcaagcacggcggcatgctcgtgcggaaccccctgtcccgcaacagcacccacgagatgtactgggtgtcctgcgggaccggcaacatcgtcagcgcggtgaacatgacctcccgcatgctgctcaaccggttcacgatggcccaccgcaagcccacctacgagcgggacgtggacctgggggccggcacccgccacgtcgccgtggagcccgaggtggccaacctggacatcatcggccagcggatcgagaacatcaagcacgagcacaagagcacctggcactacgacgaggacaacccgtacaagacgtgggcgtaccacgggtcctacgaggtcaagcccagcggctccgccagcagcatggtgaacggggtcgtgaagctcctgaccaagccctgggacgtgatccccatggtcacccagatcgccatgaccgacacgaccccgttcggccagcagcgcgtgttcaaggagaaggtggacacccggacccccaaggccaagcgcgggacggcccagatcatggaggtcaccgcgaagtggctgtggggcttcctctcccggaacaagaagccccgcatctgcacccgggaggagttcacccgcaaggtgcggagcaacgccgccatcggcgccgtgttcgtcgacgagaaccagtggaactccgcgaaggaggccgtggaggacgagcgcttctgggacctggtgcaccgggagcgcgagctgcacaagcaggggaagtgcgccacgtgcgtctacaacatgatgggcaagcgggagaagaagctcggggagttcggcaaggccaaggggagccgcgccatctggtacatgtggctgggcgcgcggttcctggagttcgaggccctcggcttcatgaacgaggaccactggttctcccgcgagaacagcctgtccggggtggagggcgaggggctgcacaagctcggctacatcctgcgggacatcagcaagatccccgggggcaacatgtacgccgacgacaccgccggctgggacacccgcatcaccgaggacgacctgcagaacgagccccgcatcacggacatcatggagcccgagcacgccctcctggcgaagtccatcttcaagctgacctaccagaacaaggtggtccgggtgcagagccccgccaagaacgggaccgtgatggacgtcatctcccgccgggaccagcgcggcagcggccaggtggggacctacggcctcaacacgttcaccaacatggaggcccagctgatccggcagatggagtccgaggggatcttcagcccgtccgagctggagacccccaacctcgccgagcgcgtgctggactggctggagaagtacggcgtcgagcggctcaagcgcatggccatcagcggggacgactgcgtggtgaagcccatcgacgaccggttcgcgaccgccctgacggccctgaacgacatgggcaaggtccgcaaggacatcccccagtgggagccgtccaaggggtggaacgactggcagcaggtccccttctggagccaccacttccaccagctcatcatgaaggacggccgggagatcgtggtcccctgccgcaaccaggacgagctggtgggccgggcccgcgtgagccagggggccggctggtccctgcgggagaccgcgtgcctcgccaagagctacgcccagatgtggcagctgatgtacttccaccgccgggacctgcgcctcgccgcgaacgccatctgctccgccgtccccgtggactggatcccgaccagccggaccacgtggtccatccacgcccaccaccagtggatgaccaccgaggacatgctgagcgtgtggaaccgcgtctggatcgaggagaacccctggatggaggacaagacccacatctccagctggggcgacgtgccctacctgggcaagcgcgaggaccagtggtgcgggtccctcatcggcctgacggcccgggcgacctgggccaccaacatccaggtggccatcaaccaggtccgccggctgatcggcaacgagaactacctcgactacatgaccagcatgaagcgcttcaagaacgagtccgaccccgagggggccctgtggtga

SEQ ID NO: 8355 - RNA, 9879 nt, synthetic construct
  misc_feature 1..9879: note = derived and/or modified CDS sequence (opt1) from DENV-1__FJ432725__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgagaccgagcccgacgacgtggactgctggtgcaacgccacggacacctgggtgacctacgggacctgcagccagacgggcgagcaccggcgcgacaagcggtccgtggccctcgcgccccacgtgggcctggggctggagacccgcaccgagacctggatgagctccgagggcgcctggaagcagatccagcgggtggagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtcgggaagctggtgcaccagatcttcggcaccgcctacggggtcctgttctccggcgtcagctggacgatgaagatcgggatcggcgtgctgctgacctggctcggcctgaactcccgcagcacctccctgagcatgacctgcatcgccgtggggctcgtcacgctgtacctgggcgtgatggtgcaggccgactccgggtgcgtcatcaactggaagggccgggagctcaagtgcgggagcggcatcttcgtgaccaacgaggtgcacacctggaccgagcagtacaagttccaggccgacagcccgaagcgcctgtccgcggccatcggcaaggcctgggaggagggggtctgcggcatccggagcgccacccgcctggagaacatcatgtggaagcagatctccaacgagctcaaccacatcctgctggagaacgacatgaagttcacggtggtggtcggggacgtggccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtcgaggactacggcttcgggatcttcacgaccaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacgtgcatctggcccaagtcccacaccctgtggagcaacggcgtgctcgagtccgagatgatcatccccaagatctacgggggcccgatcagccagcacaactaccgccccgggtacttcacccaggccgccggcccctggcacctggggaagctggagctcgacttcgacctgtgcgagggcaccacggtggtcgtggacgagcactgcggcaaccgggggccgtccctgcgcaccaccaccgtgacgggcaagatcatccacgagtggtgctgccggagctgcaccctgccgcccctccgcttccgcggggaggacggctgctggtacgggatggagatccgccccgtcaaggagaaggaggagaacctggtgaagtccatggtgagcgccggcagcggcgaggtcgactccttcagcctcgggctgctgtgcatctccatcatgatcgaggaggtgatgcggagccgctggtcccggcgcatgctcatgaccggcaccctggccgtgttcttcctgctcatcatggggcagctgacgtggaacgacctgatccgcctctgcatcatggtcggcgcgaacgccagcgaccggatggggatgggcaccacctacctggccctgatggccaccttcaagatgcgcccgatgttcgccgtgggcctcctgttccggcgcctgacgtcccgggaggtgctcctgctgaccatcgggctcagcctggtcgcgtccgtggagctgcccaacagcctcgaggagctgggcgacgggctggccatgggcatcatgatcctcaagctgctgaccgacttccagtcccaccagctctgggccaccctgctgagcctcacgttcatcaagaccaccttctccctgcactacgcctggaagaccatggcgatggtcctgagcatcgtgtccctcttccccctgtgcctgagcacgacctcccagaagaccacctggctccccgtgctgctgggcagcctcgggtgcaagccgctgacgatgttcctgatcgccgagaacaagatctggggccgccggtcctggcccctcaacgaggggatcatggccgtcggcatcgtgagcatcctgctgagctccctcctgaagaacgacgtgcccctggccgggcccctcatcgccggcggcatgctgatcgcgtgctacgtcatcagcgggtccagcgccgacctgtccctcgagaaggccgccgaggtgagctgggaggaggaggccgagcactccggcgcgagccacaacatcctggtggaggtccaggacgacgggaccatgaagatcaaggacgaggagcgcgacgacaccctgaccatcctcctgaaggccaccctgctcgccgtgtccggcgtgtacccgctgagcatccccgccacgctgttcgtctggtacttctggcagaagaagaagcagcggtccggggtgctctgggacacccccagcccgcccgaggtggagcgcgccgtcctggacgacggcatctaccggatcatgcagcgcggcctgctggggcggtcccaggtgggcgtgggggtcttccaggagaacgtgttccacaccatgtggcacgtgacccgcggcgcggtcctcatgtaccaggggaagcggctggagcccagctgggcctccgtgaagaaggacctgatcagctacggcggcgggtggcgcctccagggctcctggaacacgggggaggaggtgcaggtcatcgccgtggagcccggcaagaaccccaagaacgtgcagaccgcccccgggaccttcaagacccccgagggcgaggtcggcgccatcgcgctggacttcaagcccgggacgagcggctcccccatcgtgaaccgggaggggaagatcgtgggcctgtacggcaacggggtcgtgaccaccagcggcacctacgtgagcgccatcgcccaggccaaggcgtcccaggaggggccgctccccgagatcgaggacgaggtcttccgcaagcggaacctgacgatcatggacctgcaccccggcagcgggaagacccgccggtacctcccggccatcgtgcgcgaggccatcaagcgcaagctgcggaccctgatcctcgcccccacccgcgtggtcgcctccgagatggcggaggccctgaagggcatgcccatccggtaccagacgaccgccgtcaagagcgagcacaccggcaaggagatcgtggacctgatgtgccacgccaccttcacgatgcgcctcctgtcccccgtccgggtgccgaactacaacatgatcatcatggacgaggcccacttcaccgaccccagctccatcgcggcccgcgggtacatcagcacccgggtgggcatgggggaggccgccgccatcttcatgaccgcgacgccgcccggctccgtcgaggccttcccgcagagcaacgccgtgatccaggacgaggagcgcgacatccccgagcggtcctggaacagcgggtacgagtggatcaccgacttccccggcaagaccgtgtggttcgtcccctccatcaagagcggcaacgacatcgccaactgcctgcgcaagaacgggaagcgggtgatccagctctcccgcaagaccttcgacacggagtaccagaagaccaagaacaacgactgggactacgtggtcaccaccgacatcagcgagatgggcgcgaacttccgggccgaccgcgtgatcgacccgcggcgctgcctgaagcccgtgatcctgaaggacgggcccgagcgggtcatcctcgccggccccatgccggtgacggtcgcctccgccgcgcagcgccgggggcgcatcggccgcaaccacaacaaggagggcgaccagtacatctacatggggcagcccctgaacaacgacgaggaccacgcccactggaccgaggccaagatgctgctcgacaacatcaacacccccgagggcatcatccccgccctgttcgagccggagcgggagaagtccgccgcgatcgacggggagtaccgcctgcggggcgaggcccgcaagaccttcgtggagctcatgcggcgcggggacctgcccgtgtggctgtcctacaaggtcgccagcgagggcttccagtacagcgaccggcgctggtgcttcgacggcgagcggaacaaccaggtgctcgaggagaacatggacgtggagatctggacgaaggagggggagcgcaagaagctgcggccccgctggctggacgcccggacctactccgaccccctcgccctgcgcgagttcaaggagttcgcggccggccggcgcagcgtctccggggacctgatcctcgagatcggcaagctgccgcagcacctgacccagcgggcccagaacgccctcgacaacctggtgatgctgcacaacagcgagcagggcgggcgcgcgtaccggcacgccatggaggagctccccgacaccatcgagacgctgatgctgctcgccctgatcgccggcgtgaccgggggcgtcaccctggtgttcctctccgggcgcggcctgggcaagaccagcatcgggctgctctgcgtgatggcctccagcgtcctgctgtggatggcgtccgtggagccccactggatcgccgccagcatcatcctcgagttcttcctgatggtgctgctcatccccgagccggaccggcagcgcacgccccaggacaaccagctggcctacgtcgtgatcggcctcctcttcatgatcctgacggtggccgcgaacgagatggggctgctcgagaccaccaagaaggacctgggcatcgggcacgtcgccgtggagaaccaccaccacgccgccatgctggacgtggacctccaccccgcctccgcgtggaccctgtacgccgtcgccacgaccatcatcaccccgatgatgcgccacaccatcgagaacacgaccgccaacatcagcctgaccgccatcgcgaaccaggccgccatcctcatgggcctggccaagggctggcccatctccaagatggacatcggggtgcccctgctcgcgctgggctgctacagccaggtgaaccccctgaccctcacggccccggtcctgatgctggtggcccactacgccatcatcgggcccggcctccaggccaaggcgacccgggaggcccagaagcgcaccgccgccgggatcatgaagaaccccaccgtggacggcatcgtcgccatcgacctggaccccgtggtgtacgacgcgaagttcgagaagcagctgggccagatcatgctcctgatcctgtgcacgtcccagatcctcctgatgcggaccacctgggccctgtgcgagagcatcaccctcgccacggggccgctgaccaccctgtgggagggctcccccgggaagttctggaacaccacgatcgccgtcagcatggccaacatcttccgcggctcctacctcgcgggcgccgggctggccttcagcctgatgaagtccctcggcgggggccggcgcgggaccggcgcccagggcgagaccctgggggagaagtggaagcggcagctgaaccagctctccaagagcgagttcaacacctacaagcgctccggcatcatggaggtggaccggagcgaggcgaaggaggggctgaagcgcggcgagacgaccaagcacgccgtgtcccgggggaccgccaagctgcgctggttcgtcgagcggaacctcgtgaagcccgagggcaaggtgatcgacctgggctgcgggcgcggcgggtggagctactactgcgccggcctgaagaaggtcaccgaggtgaaggggtacacgaagggcggccccgggcacgaggagccgatccccatggccacctacggctggaacctggtgaagctccactccgggaaggacgtcttcttcatcccgcccgagaagtgcgacaccctgctgtgcgacatcggcgagagctccccgaaccccaccatcgaggaggggcggacgctccgcgtgctgaagatggtggagccctggctgcggggcaaccagttctgcatcaagatcctcaacccctacatgccgagcgtcgtggagaccctggagcagatgcagcgcaagcacggcgggatgctggtgcggaaccccctctcccgcaacagcacccacgagatgtactgggtctcctgcggcaccgggaacatcgtgagcgcggtgaacatgacctcccgcatgctgctgaaccggttcacgatggcccaccgcaagcccacctacgagcgggacgtcgacctcggcgccggcccccgccacgtggccgtggagccggaggtcgccaacctggacatcatcgggcagcggatcgagaacatcaagcacgagcacaagagcacctggcactacgacgaggacaacccctacaagacctgggcgtaccacggctcctacgaggtgaagcccagcgggtccgccagcagcatggtcaacggcgtggtgaagctgctcacgaagccctgggacgtcatcccgatggtgacccagatcgccatgaccgacaccacgcccttcgggcagcagcgcgtgttcaaggagaaggtcgacacccggacccccaaggccaagcgcggcaccgcccagatcatggaggtgacggcgaagtggctgtggggcttcctgtcccggaacaagaagccgcgcatctgcacccgggaggagttcacccgcaaggtgcggagcaacgccgccatcggggccgtcttcgtggacgagaaccagtggaactccgcgaaggaggccgtggaggacgagcgcttctgggacctcggccaccgggagcgcgagctgcacaagcaggggaagtgcgcgacctgcgtcagcaacatgatgggcaagcgggagaagaagctgggggagttcggcaagcccaagggctcccgccccatctggtacatgtggctcggggcccggttcctggagttcgaggccctgggcttcatgaacgaggaccactggttcagccgcgagaactccctcagcggggtggagggcgaggggctgcacaagctgggctacatcctccgggacatctccaagatccccggcgggaacatgtacgcggacgacacggccggctgggacacccgcatcaccgaggacgacctgcagaacgaggcccgcatcaccgacatcatggagccggagcacgccctgctcgccaagagcatcttcaagctgacgtaccagaacaaggtggtccgggtgcagcgccccgcgaagaacgggaccgtgatggacgtcatctccagccgggaccagcgcggctccggccaggtggggacctacggcctgaacaccttcacgaacatggaggcccagctcatccggcagatggagagcgaggggatcttctcccccagcgagctggagacccccaacctggccgagcgcgtgctcgactggctggagaagtacggcgtcgagcggctgaagcgcatggccatctccggggacgactgcgtggtgaagccgatcgacgaccggttcgccaccgcgctcaccgccctgaacgacatgggcaaggtccgcaaggacatcccccagtgggagcccagcaagggctggaacgactggcagcaggtccccttctgcagccaccacttccaccagctgatcatgaaggacgggcgggagatcgtggtcccgtgccgcaaccaggacgagctcgtgggccgggcccgcgtgtcccagggggccggctggagcctgcgggagacggcctgcctggggaagtcctacgcgcagatgtggcagctcatgtacttccaccgccgggacctgcgcctggccgccaacgccatctgcagcgcggtccccgtggactggatccccacctcccggaccacctggagcatccacgcccaccaccagtggatgacgaccgaggacatgctctccgtgtggaaccgcgtctggatcgaggagaacccctggatggaggacaagacccacatcagctcctggggcgacgtgccgtacctgggcaagcgcgaggaccagtggtgcgggagcctgatcggcctcaccgcccgggccacgtgggccaccaacatccaggtggcgatcaaccaggtccgccggctgatcgggaacgagaactacctggactacatgacctccatgaagcgcttcaagaacgagagcgaccccgagggcgccctctggtga

SEQ ID NO: 8356 - RNA, 9879 nt, synthetic construct
  misc_feature 1..9879: note = derived and/or modified CDS sequence (opt1) from DENV-1__FJ432729__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgcgggggtgaacatgtgcaccctcatcgccatggacctgggcgagctgtgcgaggacaccatgacctacaagtgcccccggatcaccgaggccgagcccgacgacgtggactgctggtgcaacgccacggacacctgggtcacctacgggacctgcagccagacgggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgtgatcggcacctccatcacccagaaggggatcatcttcatcctcctgatgctggtcacgcccagcatggccatgcggtgcgtgggcatcggctcccgcgacttcgtggaggggctcagcggcgccacctgggtcgacgtggtgctggagcacgggtcctgcgtcaccaccatggccaaggacaagcccacgctggacatcgagctcctgaagaccgaggtgaccaaccccgccgtgctgcggaagctctgcatcgaggcgaagatcagcaacaccacgaccgactcccgctgccccacccagggcgaggccaccctgatggaggagcaggacgccaacttcgtctgccggcgcacgttcgtggaccggggctgggggaacggctgcgggctgttcggcaaggggagcctcatcacgtgcgccaagttcaagtgcgtgaccaagctggagggcaagatcgtccagtacgagaacctgaagtactccgtgatcgtgaccgtccacacgggcgaccagcaccaggtggggaacgagagcaccgagcacggcaccatcgccaccatcacgccccaggcgcccacgtccgagatccagctcaccgactacggggccctgaccctggactgcagcccccgcaccggcctcgacttcaacgagatggtcctgctgacgatgaaggagaagtcctggctcgtgcacaagcagtggttcctggacctgccgctcccctggaccagcggggccagcacctcccaggagacctggaaccggcaggacctgctggtgacgttcaagaccgcccacgccaagaagcaggaggtcgtggtgctcggcagccaggagggcgcgatgcacaccgccctgaccggggccacggagatccagacctccggcaccaccacgatcttcgccgggcacctgaagtgccgcctcaagatggacaagctgaccctgaagggcatgagctacgtcatgtgcaccgggtccttcaagctcgagaaggaggtggccgagacccagcacggcacggtgctggtccagatcaagtacgagggcaccgacgcgccctgcaagatccccttcagcacccaggacgagaagggggtgacccagaacggccggctgatcacggccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccaccgcccgcggggcccggcgcatggccatcctgggcgacaccgcgtgggacttcgggtccatcggcggcgtgttcacgagcgtcgggaagctggtgcaccagatcttcggcaccgcctacggggtgctgttctccggcgtcagctggaccatgaagatcgggatcggcgtgctgctgacctggctcggcctgaactcccgcagcacgtccctgagcatgacctgcatcgccgtggggctcgtcaccctgtacctgggcgtgatggtgcaggccgactccgggtgcgtcatcaactggaagggccgggagctcaagtgcgggagcggcatcttcgtgaccaacgaggtgcacacgtggaccgagcagtacaagttccaggccgacagcccgaagcgcctgtccgcggccatcggcaaggcctgggaggagggggtctgcggcatccggagcgccacccgcctggagaacatcatgtggaagcagatctccaacgagctcaaccacatcctgctggagaacgacatgaagttcaccgtggtggtcggggacgtggtgggcatcctcgcccaggggaagaagatgatccggccccagcccatggagcacaagtacagctggaagtcctggggcaaggcgaagatcatcggcgccgacgtccagaacaccacgttcatcatcgacgggcccaacaccccggagtgccccgacgaccagcgcgcctggaacatctgggaggtggaggactacggcttcgggatcttcaccaccaacatctggctgaagctgcgggacagccacacccaggtgtgcgaccaccgcctcatgtccgccgcgatcaaggacagcaaggccgtccacgccgacatgggctactggatcgagtccgagaagaacgagacctggaagctggcccgggccagcttcatcgaggtgaagacctgcatctggcccaagtcccacaccctgtggagcaacggcgtgctcgagtccgagatgatcatccccaagatctacgggggcccgatcagccagcacaactaccgccccgggtacttcacgcagaccgcgggcccctggcacctggggaagctggagctcgacttcgacctgtgcgagggcaccaccgtcgtggtggacgagcactgcggcaaccgggggccgtccctgcgcacgaccaccgtcaccggcaagatcatccacgagtggtgctgccggagctgcacgctgccgcccctccgcttcaagggggaggacggctgctggtacgggatggagatccggcccgtgaaggagaaggaggagaacctggtgaagtccatggtcagcgccggcagcggcgaggtggactccttcagcctcgggctgctgtgcatctccatcatgatcgaggaggtgatgcgcagccggtggtcccgcaagatgctcatgaccggcaccctggccgtcttcctgctcctgatcatggggcagctgacctggaacgacctcatccggctgtgcatcatggtgggcgccaacgccagcgaccgcatggggatgggcacgacctacctggcgctcatggccaccttcaagatgcgcccgatgttcgccgtgggcctgctgttccggcgcctcacctcccgggaggtcctgctgctcacgatcgggctgagcctggtggcctccgtcgagctccccaacagcctggaggagctgggcgacgggctcgccatgggcatcatgatcctgaagctgctcaccgacttccagtcccaccagctgtgggcgaccctgctcagcctgaccttcatcaagacgaccctgtccctccactacgcctggaagaccatggccatggtgctgagcatcgtgtccctgttccccctctgcctgagcaccacgtcccagaagaccacctggctgcccgtcctcctgggcagcctggggtgcaagccgctcgccatgctgctgatcgcggagaacaagatctggggccgcaagtcctggcccctcaacgaggggatcatggccgtgggcgtggtcagcatcctgctgagctccctcctgaagaacgacgtgcccctggccgggcccctcatcgccggcggcatgctgatcgcctgctacgtgatcagcgggtccagcgcggacctgtccctcgagaaggccgccgaggtcagctgggaggaggaggccgagcactccggcgccagccacaacatcctggtggaggtgcaggacgacgggaccatgaagatcaaggacgaggagcgggacgacacgctgaccatcctcctgaaggcgaccctgctcgccgtctccggcgtgtacccgctgagcatccccgccaccctgttcgtgtggtacttctggcagaagaagaagcagcgctccggggtcctgtgggacacccccagcccgcccgaggtggagcgggccgtgctcgacgacggcatctaccgcatcatgcagcggggcctgctggggcgctcccaggtcggcgtgggggtgttccaggagaacgtcttccacacgatgtggcacgtgacccggggcgccgtgctcatgtaccaggggaagcgcctggagcccagctgggcgtccgtcaagaaggacctgatcagctacggcggcgggtggcggctccagggctcctggaacaccggggaggaggtccaggtgatcgccgtcgagcccggcaagaaccccaagaacgtgcagaccgcccccgggacgttcaagacccccgagggcgaggtgggcgccatcgccctggacttcaagcccgggaccagcggctcccccatcgtcaaccgcgaggggaagatcgtgggcctgtacggcaacggggtggtcaccacgagcggcacctacgtgagcgcgatcgcccaggccaaggcctcccaggaggggccgctccccgagatcgaggacgaggtgttccggaagcgcaacctgaccatcatggacctgcaccccggcagcgggaagacccggcgctacctcccggcgatcgtccgggaggccatcaagcgcaagctgcggacgctgatcctcgcccccacccgcgtggtggcctccgagatggccgaggcgctgaagggcatgcccatccgctaccagaccaccgccgtcaagagcgagcacacgggcaaggagatcgtggacctgatgtgccacgccaccttcaccatgcggctcctgtcccccgtgcgcgtcccgaactacaacatgatcatcatggacgaggcccacttcaccgaccccagctccatcgccgcgcgggggtacatcagcacgcgcgtgggcatgggggaggccgccgccatcttcatgaccgccacgccgcccggctccgtggaggcgttcccgcagagcaacgccgtcatccaggacgaggagcgggacatccccgagcgctcctggaacagcgggtacgagtggatcaccgacttccccggcaagacggtgtggttcgtgccctccatcaagagcggcaacgacatcgccaactgcctgcggaagaacgggaagcgcgtcatccagctctcccggaagaccttcgacaccgagtaccagaagaccaagaacaacgactgggactacgtggtgacgaccgacatcagcgagatgggcgccaacttccgcgcggaccgggtcatcgacccgcgccggtgcctgaagcccgtgatcctgaaggacgggcccgagcgcgtcatcctcgccggccccatgccggtgaccgtggcctccgccgcccagcggcgcgggcggatcggccgcaaccacaacaaggagggcgaccagtacatctacatggggcagcccctgaacaacgacgaggaccacgcgcactggaccgaggccaagatgctgctcgacaacatcaacacgcccgagggcatcatccccgccctgttcgagccggagcgggagaagtccgccgccatcgacggggagtaccgcctgcgcggcgaggcgcggaagaccttcgtcgagctcatgcgccgcggggacctgcccgtgtggctgtcctacaaggtggccagcgagggcttccagtacagcgaccgccggtggtgcttcgacggcgagcgcaacaaccaggtcctcgaggagaacatggacgtggagatctggaccaaggagggggagcggaagaagctgcgcccccggtggctggacgcccgcacctactccgaccccctcgccctgcgggagttcaaggagttcgccgcgggccgccggagcgtgtccggggacctgatcctcgagatcggcaagctgccgcagcacctgacgcagcgcgcccagaacgccctcgacaacctggtcatgctgcacaacagcgagcagggcgggcgggcctaccgccacgcgatggaggagctccccgacaccatcgagaccctgatgctgctcgccctgatcgccgtgctgaccggcggggtgaccctcttcttcctgtccggccgggggctgggcaagaccagcatcggcctcctgtgcgtcatggcctccagcgtgctgctctggatggcctccgtggagccccactggatcgcggccagcatcatcctggagttcttcctgatggtcctcctgatccccgagccggaccgccagcggacgccccaggacaaccagctggcctacgtggtgatcgggctcctgttcatgatcctgaccgtcgccgccaacgagatgggcctcctggagaccacgaagaaggacctggggatcggccacgtggcggtggagaaccaccaccacgccaccatgctcgacgtcgacctgcaccccgcctccgcctggaccctgtacgccgtggcgaccacgatcatcaccccgatgatgcgccacaccatcgagaacaccacggccaacatcagcctcaccgccatcgccaaccaggccgcgatcctgatggggctggacaagggctggcccatctccaagatggacatcggcgtgcccctcctggccctggggtgctacagccaggtcaaccccctcaccctgaccgccgccgtgctgatgctcgtggcgcactacgccatcatcggcccggggctgcaggccaaggccacgcgggaggcccagaagcgcaccgcggccggcatcatgaagaaccccaccgtcgacgggatcgtggccatcgacctggaccccgtggtctacgacgccaagttcgagaagcagctcggccagatcatgctgctgatcctctgcacctcccagatcctgctgatgcgcacgacctgggccctctgcgagagcatcaccctggcgaccggccccctgacgaccctctgggaggggtccccgggcaagttctggaacaccaccatcgccgtgagcatggccaacatcttccgggggtcctacctggccggcgccggcctggcgttcagcctcatgaagtccctcgggggcgggcgccgggggacgggggcccagggcgagaccctgggcgagaagtggaagcgccagctcaaccagctgtccaagagcgagttcaacatctacaagcggtccgggatcatggaggtggaccgcagcgaggccaaggagggcctgaagcgcggggagaccacccgccacgccgtctcccggggcacggcgaagctgcgctggttcgtggagcggaacctcgtgaagcccgaggggaaggtcatcgacctgggctgcggccgcgggggctggagctactactgcgccgggctgaagaaggtgaccgaggtgaagggctacaccaagggcgggcccggccacgaggagcccatcccgatggccacctacgggtggaacctcgtcaagctgcactccggcaaggacgtgttcttcacgccgcccgagaagtgcgacaccctgctctgcgacatcggggagagctcccccaacccgaccatcgaggagggccggaccctgcgcgtgctgaagatggtcgagccctggctccgggggaaccagttctgcatcaagatcctgaacccctacatgcccagcgtggtggagacgctggagcagatgcagcgcaagcacggcggcatgctcgtccggaacccgctgtcccgcaacagcacccacgagatgtactgggtgtcctgcgggaccggcaacatcgtgagcgccgtcaacatgacctcccggatgctgctcaaccgcttcaccatggcccaccgcaagcccacgtacgagcgggacgtggacctgggggcgggcacccgccacgtggccgtcgagcccgaggtggccaacctggacatcatcggccagcggatcgagaacatcaagcacgagcacaagagcacctggcactacgacgaggacaacccctacaagacctgggcctaccacgggtcctacgaggtcaagccgagcggctccgccagcagcatggtgaacggggtggtcaagctcctgacgaagccctgggacgtgatccccatggtgacccagatcgcgatgaccgacaccacgcccttcggccagcagcgcgtcttcaaggagaaggtggacacccggaccccgaaggccaagcgcgggaccgcccagatcatggaggtgacggcccggtggctgtggggcttcctctcccgcaacaagaagccccggatctgcacccgcgaggagttcacccggaaggtccgcagcaacgccgcgatcggcgccgtgttcgtggacgagaaccagtggaactccgccaaggaggccgtcgaggacgagcggttctgggacctggtgcagaaggagcgcgagctgcacaagcaggggaagtgcgcgacctgcgtgtacaacatgatgggcaagcgggagaagaagctcggggagttcggcaaggccaaggggagccgcgccatctggtacatgtggctgggcgcccggttcctggagttcgaggccctcggcttcatgaacgaggaccactggttctcccgcgagaacagcctgtccggggtcgagggcgaggggctgcacaagctcggctacatcctgcgggacatcagcaagatccccgggggcaacatgtacgcggacgacacggccggctgggacacccgcatcaccgaggacgacctgcagaacgaggcccggatcaccgacatcatggagccggagcacgccctcctggccacgtccatcttcaagctgacctaccagaacaaggtggtgcgcgtccagcgccccgcgaagaacgggaccgtgatggacgtgatcagccggcgcgaccagcggggctccgggcaggtcggcacctacggcctcaacacgttcaccaacatggaggcccagctgatccgccagatggagagcgaggggatcttcctgccctccgagctcgagacccagaacctggccgagcgggtgctggactggctcgagaagtacggcgtggagcgcctgaagcggatggccatcagcggggacgactgcgtcgtgaagcccatcgacgaccgcttcgccaccgcgctgacggccctcaacgacatgggcaaggtgcggaaggacatcccgcagtgggagccctccaaggggtggaacgactggcagcaggtccccttctgcagccaccacttccaccagctgatcatgaaggacggccgcgagatcgtggtgccctgccggaaccaggacgagctggtcggccgcgcccgggtgtcccagggggccggctggagcctccgcgagaccgcctgcctgggcaagagctacgcgcagatgtggcagctgatgtacttccaccggcgcgacctccggctggccgccaacgccatctgctccgcggtgccggtcgactgggtgcccaccagccgcaccacgtggtccatccacgcccaccaccagtggatgaccaccgaggacatgctgagcgtgtggaaccgggtctggatcgaggagaacccctggatggaggacaagacccacgtgtccagctggggcgacgtgccctacctcgggaagcgcgaggaccagtggtgcggctccctgatcggcctgacggcccgcgccacctgggccagcaacatccaggtcgcgatcaaccaggtgcggcgcctcatcgggaacgagaactacctggactacatgacctccatgaagcggttcaagaacgagggcgacccggagggggccctgtggtga

SEQ ID NO: 8357 - RNA, 9879 nt, synthetic construct
  misc_feature 1..9879: note = derived and/or modified CDS sequence (opt1) from DENV-1__FJ432730__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagttctgcgaggacacgatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagaccgtccagtacgagaacctgaagtacagcgtgatcgtgaccgtccacacgggcgaccagcaccaggtggggaacgagtccaccgagcacggcaccaccgcgaccatcacgccccaggcccccagcaccgagatccagctgaccgactacggggccctcaccctggactgcagcccccggacgggcctggacttcaacgagatggtcctcctgaccatgaaggagaagtcctggctggtgcacaagcagtggttcctcgacctgccgctgccctggaccagcggggcctccaccagccaggagacgtggaaccggaaggacctcctggtgaccttcaagaccgcccacgcgaagaagcaggaggtcgtggtgctgggctcccaggagggcgccatgcacaccgccctcacgggggccaccgagatccagaccagcggcatgaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctcgtccagatcaagtacgagggcaccgacgccccctgcaagatccccttctccacccaggacgagaagggggtgacccagaacggccggctgatcacggccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacaccgcctgggacttcgggagcatcggcggcgtgttcacgtccgtcgggaagctggtgcaccagatcttcggcaccgcctacggggtgctgttcagcggcgtctcctggaccatgaagatcgggatcggcgtgctcctgacctggctgggcctcaacagccgctccacgagcctgtccatgacctgcatcgccgtggggctggtcaccctctacctgggcgtgatggtgcaggccgacagcgggtgcgtcatcaactggaagggccgggagctgaagtgcgggagcggcatcttcgtgaccaacgaggtgcacacgtggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagttcaccgtggtggtcggggacgtggcgggcatcctggcccaggggaagaagatgatccggccccagcccatggagtacaagtactcctggaagtcctggggcaaggccaagatcatcggcgccgacgtgcagaacaccacgttcatcatcgacgggcccaacaccccggagtgccccgacgaccagcgcgcgtggaacatctgggaggtcgaggactacggcttcgggatcttcaccaccaacatctggctcaagctgcgggactcctacacccaggtgtgcgaccaccgcctgatgagcgccgccatcaaggactccaaggccgtgcacgccgacatgggctactggatcgagagcgagaagaacgagacgtggaagctcgcgcgggcctccttcatcgaggtcaagacctgcatctggcccaagagccacaccctgtggtccaacggcgtgctggagagcgagatgatcatccccaagatctacgggggcccgatctcccagcacaactaccgccccgggtacttcacgcagaccgccggcccctggcacctcgggaagctggagctggacttcgacctctgcgagggcaccaccgtggtcgtggacgagcactgcggcaaccgggggccgagcctgcgcacgaccaccgtgaccggcaagatcatccacgagtggtgctgccggtcctgcacgctgccgcccctgcgcttcaagggggaggacggctgctggtacgggatggagatccggcccgtcaaggagaaggaggagaacctggtcaagagcatggtgagcgccggctccggcgaggtcgacagcttctccctggggctcctgtgcatcagcatcatgatcgaggaggtgatgcgctcccggtggagccgcaagatgctgatgaccggcaccctcgccgtgttcttcctgctgatcatggggcagctcacctggaacgacctgatccggctgtgcatcatggtcggcgcgaacgcctccgaccgcatggggatgggcacgacctacctcgccctgatggccaccttcaagatgcgcccgatgttcgccgtgggcctcctgttccggcgcctgaccagccgggaggtgctgctcctgacgatcgggctgtccctcgtcgcgagcgtggagctgcccaactccctggaggagctcggcgacgggctggccatgggcatcatgatcctgaagctcctgaccgacttccagagccaccagctgtgggccaccctcctgtccctgaccttcatcaagacgaccttcagcctccactacgcctggaagaccatggcgatggtcctgtccatcgtgagcctgttccccctctgcctgtccaccacgagccagaagaccacctggctgcccgtgctcctgggctccctggggtgcaagccgctcaccatgttcctgatcgccgagaacaagatctggggccgcaagagctggcccctgaacgaggggatcatggccgtcggcatcgtgagcatcctcctgtccagcctgctcaagaacgacgtgcccctggccgggcccctgatcgccggcggcatgctcatcgcgtgctacgtcatctccgggagctccgccgacctgagcctggagaaggccgccgaggtgtcctgggaggaggaggccgagcacagcggcgcgtcccacaacatcctcgtggaggtccaggacgacgggacgatgaagatcaaggacgaggagcgggacgacaccctgaccatcctgctcaaggccaccctgctggccgtgagcggcgtgtacccgctctccatccccgccaccctgttcgtctggtacttctggcagaagaagaagcagcgcagcggggtgctgtgggacacgcccagcccgcccgaggtggagcgggccgtcctcgacgacggcatctaccgcatcatgcagcggggcctgctggggcgcagccaggtgggcgtgggggtcttccaggagaacgtgttccacaccatgtggcacgtgacccggggcgcggtcctgatgtaccaggggaagcgcctcgagccctcctgggccagcgtgaagaaggacctgatctcctacggcggcgggtggcggctgcagggcagctggaacaccggggaggaggtgcaggtcatcgccgtggagcccggcaagaaccccaagaacgtgcagacggcccccgggaccttcaagacctccgagggcgaggtcggcgccatcgcgctcgacttcaagcccgggaccagcggcagccccatcgtgaaccgcgaggggaagatcgtgggcctgtacggcaacggggtcgtgacgacctccggcacctacgtgagcgccatcgcccaggccaaggcgtcccaggaggggcccctgccggagatcgaggacgaggtcttccggaagcgcaacctcaccatcatggacctgcaccccggcagcgggaagacgcggcgctacctgcccgccatcgtgcgggaggccatcaagcgcaagctccggaccctgatcctggccccgacccgcgtggtcgcctccgagatggcggaggccctcaagggcatgcccatccgctaccagaccacggccgtcaagagcgagcacaccggcaaggagatcgtggacctgatgtgccacgccaccttcaccatgcggctgctctcccccgtccgcgtgcccaactacaacatgatcatcatggacgaggcccacttcacggacccgagctccatcgcggcccgggggtacatcagcacccgcgtgggcatgggggaggccgccgccatcttcatgaccgcgacgccgcccggctccgtcgaggccttcccccagagcaacgccgtgatccaggacgaggagcgggacatcccggagcgctcctggaacagcgggtacgagtggatcacggacttccccggcaagaccgtgtggttcgtcccctccatcaagagcggcaacgacatcgccaactgcctgcggaagaacgggaagcgcgtgatccagctgtcccggaagaccttcgacaccgagtaccagaagacgaagaacaacgactgggactacgtggtcaccaccgacatcagcgagatgggcgcgaacttccgcgccgaccgggtgatcgacccccgccggtgcctcaagccggtgatcctgaaggacgggcccgagcgcgtcatcctggccggccccatgcccgtgaccgtcgcctccgccgcgcagcggcgcgggcggatcggccgcaaccacaacaaggagggcgaccagtacatctacatggggcagccgctcaacaacgacgaggaccacgcccactggacggaggccaagatgctgctggacaacatcaacacccccgagggcatcatccccgccctcttcgagcccgagcgggagaagtccgccgcgatcgacggggagtaccgcctgcgcggcgaggcccggaagaccttcgtggagctgatgcgccgcggggacctcccggtgtggctgagctacaaggtcgcctccgagggcttccagtacagcgaccgccggtggtgcttcgacggcgagcgcaacaaccaggtgctggaggagaacatggacgtggagatctggaccaaggagggggagcggaagaagctccgcccccggtggctggacgcccgcacgtactccgaccccctggccctccgggagttcaaggagttcgcggccggccgccggagcgtctccggggacctgatcctggagatcggcaagctcccccagcacctgacccagcgcgcccagaacgccctggacaacctcgtgatgctgcacaacagcgagcagggcgggcgggcgtaccgccacgccatggaggagctgccggacaccatcgagaccctcatgctgctggccctcatcgccgtgctgacgggcggggtcaccctgttcttcctctccggccgggggctgggcaagaccagcatcggcctgctctgcgtgatggcctccagcgtgctgctgtggatggcgtccgtcgagccccactggatcgccgccagcatcatcctcgagttcttcctgatggtgctgctcatccccgagcccgaccgccagcggaccccgcaggacaaccagctggcctacgtggtcatcgggctcctcttcatgatcctgaccgtggccgcgaacgagatgggcctgctcgagacgaccaagaaggacctggggatcggccacgtggccgtcgagaaccaccaccacgccgccatgctggacgtggacctccaccccgcctccgcgtggaccctgtacgccgtggccaccacgatcatcacccccatgatgcgccacaccatcgagaacaccacggccaacatcagcctgaccgccatcgcgaaccaggccgccatcctcatggggctggacaagggctggccgatctccaagatggacatcggcgtccccctgctcgccctggggtgctacagccaggtgaaccccctgaccctcaccgcggccgtgctgatgctggtcgcccactacgccatcatcggccccgggctccaggccaaggcgacgcgggaggcccagaagcgcaccgccgccggcatcatgaagaacccgaccgtggacgggatcgtggccatcgacctggaccccgtcgtgtacgacgcgaagttcgagaagcagctgggccagatcatgctcctgatcctgtgcacctcccagatcctcctgatgcgcacgacctgggccctgtgcgagagcatcaccctcgccaccggccccctgacgaccctgtgggaggggtcccccggcaagttctggaacaccaccatcgccgtgagcatggccaacatcttccgggggagctacctcgcgggcgccggcctggccttctccctgatgaagtccctcgggggcgggcgccggggcacgggggcccagggcgagaccctgggcgagaagtggaagcgccagctgaaccagctctccaagagcgagttcaacacctacaagcggtccgggatcatggaggtcgaccgcagcgaggcgaaggagggcctgaagcgcggggagaccacgaagcacgccgtgtcccgcggcaccgccaagctgcggtggttcgtggagcgcaacctcgtcaagccggaggggaaggtgatcgacctgggctgcggccgcggcgggtggagctactactgcgccgggctgaagaaggtgaccgaggtcaaggggtacaccaagggcgggcccggccacgaggagcccatccccatggccacgtacgggtggaacctggtgaagctccactccggcaaggacgtgttcttcatcccgcccgagaagtgcgacaccctgctgtgcgacatcggggagagctcccccaaccccaccatcgaggagggccgcaccctccgggtcctgaagatggtggagccgtggctgcgcgggaaccagttctgcatcaagatcctcaacccctacatgcccagcgtggtcgagacgctggagcagatgcagcggaagcacggcggcatgctggtgcgcaaccccctctcccggaacagcacccacgagatgtactgggtgtcctgcgggaccggcaacatcgtcagcgcggtgaacatgacctcccgcatgctgctgaaccggttcaccatggcccaccgcaagccgacgtacgagcgcgacgtggacctcggggccggcacccggcacgtcgccgtggagcccgaggtggccaacctggacatcatcggccagcgcatcgagaacatcaagcacgagcacaagagcacctggcactacgacgaggacaacccctacaagacctgggcgtaccacgggtcctacgaggtcaagcccagcggcagcgcctccagcatggtgaacggggtcgtgaagctgctcacgaagccgtgggacgtgatccccatggtcacccagatcgccatgaccgacaccacgcccttcggccagcagcgggtgttcaaggagaaggtggacacccgcacccccaaggccaagcgggggaccgcccagatcatggaggtcacggcgaagtggctgtggggcttcctgtcccgcaacaagaagccgcggatctgcacccgcgaggagttcacccggaaggtgcgcagcaacgccgccatcggcgccgtgttcgtcgacgagaaccagtggaactccgcgaaggaggccgtggaggacgagcggttctgggacctcgtgcaccgcgagcgggagctgcacaagcaggggaagtgcgcgacctgcgtctacaacatgatgggcaagcgcgagaagaagctgggggagttcggcaaggccaaggggagccgggccatctggtacatgtggctcggcgcgcgcttcctggagttcgaggccctgggcttcatgaacgaggaccactggttctcccgggagaacagcctctccggggtggagggcgaggggctgcacaagctgggctacatcctccgcgacatcagcaagatccccgggggcaacatgtacgccgacgacacggccggctgggacacccggatcaccgaggacgacctgcagaacgaggccaagatcaccgacatcatggagcccgagcacgcgctgctcgccaagtccatcttcaagctgacgtaccagaacaaggtggtccgcgtgcagcggccggccaagaacgggaccgtgatggacgtcatcagccgccgcgaccagcggggctccggccaggtgggcacctacggcctgaacaccttcacgaacatggaggcccagctcatccgccagatggagagcgaggggatcttctcccccagcgagctggagacccccaacctggcccggcgcgtgctcgactggctggagaagcacggcgtcgagcggctgaagcgcatggcgatctccggggacgactgcgtggtgaagcccatcgacgaccggttcgccaccgccctcaccgccctgaacgacatgggcaaggtccgcaaggacatcccgcagtgggagcccagcaaggggtggaacgactggcagcaggtccccttctgcagccaccacttccaccagctgatcatgaaggacggccgggagatcgtggtcccctgccgcaaccaggacgagctcgtgggccgggcccgcgtgtcccagggggcgggctggagcctgcgggagacggcctgcctggggaagtcctacgcccagatgtggcagctcatgtacttccaccgccgggacctgcgcctggccgcgaacgccatctgcagcgccgtcccggtggactgggtgcccacctcccggaccacctggagcatccacgcccaccaccagtggatgacgaccgaggacatgctctccgtctggaaccgcgtgtggatcgaggagaacccctggatggaggacaagacccacatcagctcctggggcgacgtgccctacctggggaagcgggaggaccagtggtgcggcagcctgatcggcctcaccgcccgcgcgacgtgggccaccaacatccaggtcgccatcaaccaggtgcgccggctgatcgggaacgagaactacctggactacatgacctccatgaagcgcttcaagaacgagagcgacccggagggcgccctctggtga

SEQ ID NO: 8358 - RNA, 9879 nt, synthetic construct
  misc_feature 1..9879: note = derived and/or modified CDS sequence (opt1) from DENV-1__FJ432732__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccaccgacacctgggtgacctacgggacctgcagccagacgggcgagcaccggcgggacaagcggtccgtggccctcgcgccccacgtgggcctggggctggagacccgcaccgagacctggatgagctccgagggcgcgtggaagcagatccagcgggtggagacgtgggccctccggcaccccgggttcaccgtgatcgccctgttcctggcccacgtgatcggcaccagcatcacccagaaggggatcatcttcatcctcctgatgctggtcacgccctccatggcgatgcggtgcgtgggcatcggcagccgcgacttcgtggaggggctctccggcgccacctgggtcgacgtggtgctggagcacgggagctgcgtcaccaccatggccaaggacaagcccacgctggacatcgagctcctgaagaccgaggtgaccaaccccgccgtgctgcggaagctctgcatcgaggccaagatctccaacaccacgaccgacagccgctgcccgacccagggcgaggcgaccctggtcgaggagcaggacgccaacttcgtgtgccggcgcacgttcgtggaccggggctgggggaacggctgcgggctgttcggcaaggggtccctcatcacgtgcgccaagttcaagtgcgtcaccaagctggagggcaagatcgtgcagtacgagaacctgaagtacagcgtgatcgtcaccgtgcacacgggcgaccagcaccaggtcgggaacgagtccaccgagcacggcaccaccgccaccatcacgccccaggcccccaccaccgagatccagctcaccgactacggggcgctgacgctggactgcagcccccgcaccggcctcgacttcaacgagatggtgctgctgaccatgaaggagaagtcctggctcgtgcacaagcagtggttcctggacctgcccctcccctggaccagcggggccagcacgtcccaggagacctggaaccggcaggacctgctggtcaccttcaagaccgcccacgccaagaagcaggaggtggtggtcctcggcagccaggagggcgccatgcacacggcgctgaccggggccaccgagatccagacctccggcacgaccaccatcttcgccgggcacctgaagtgccgcctcaagatggacaagctgaccctgaagggcatgagctacgtgatgtgcacggggtccttcaagctcgagaaggaggtggccgagacccagcacggcaccgtcctggtgcagatcaagtacgagggcaccgacgccccctgcaagatccccttcagcacgcaggacgagaagggggtgacccagaacggccggctgatcaccgcgaacccgatcgtcaccgacaaggagaagcccgtgaacatcgaggccgagccgcccttcggggagtcctacatcacgatcggcgccggcgagaaggccctgaagctcagctggttcaagaaggggtccagcatcggcaagatgttcgaggcgaccgcccgcggggcccggcgcatggccatcctgggcgacaccgcctgggacttcgggtccatcggcggcgtgttcaccagcgtcgggaagctggtgcaccagatcttcggcacggcgtacggggtcctgttctccggcgtcagctggaccatgaagatcgggatcggcgtgctgctgacctggctcggcctgaactcccgcagcacctccctgagcatgacgtgcatcgccgtggggctcgtcaccctgtacctgggcgtgatggtgcaggccgactccgggtgcgtcatcaactggaagggccgggagctcaagtgcgggagcggcatcttcgtgaccaacgaggtgcacacctggaccgagcagtacaagttccaggccgacagcccgaagcgcctgtccgccgcgatcggcaaggcctgggaggagggggtctgcggcatccggagcgccacgcgcctggagaacatcatgtggaagcagatctccaacgagctcaaccacatcctgctggagaacgacatgaagttcaccgtggtggtcggggacgtggccggcatcttcgcccaggggaagaagatgatccggccccagcccatggagtacaagtacagctggaagtcctggggcaaggcgaagatcatcggcgccgacgtgcagaacaccaccttcatcatcgacgggcccaacacgccggagtgccccgacgaccagcgcgcctggaacatctgggaggtcgaggactacggcttcgggatcttcaccaccaacatctggctcaagctgcgggacagctacacccaggtgtgcgaccaccgcctgatgtccgccgcgatcaaggacagcaaggccgtgcacgccgacatgggctactggatcgagtccgagaagaacgagacgtggaagctcgcccgggccagcttcatcgaggtcaagacctgcatctggcccaagtcccacaccctgtggagcaacggcgtgctggagtccgagatgatcatccccaagatctacgggggcccgatcagccagcacaactaccgccccgggtacttcacccagacggcgggcccctggcacctcgggaagctggagctggacttcgacctctgcgagggcaccaccgtggtcgtggacgagcactgcggcaaccgggggccgtccctgcgcaccacgaccgtgaccggcaagatcatccacgagtggtgctgccggagctgcaccctgccgcccctgcgcttccgcggggaggacggctgctggtacgggatggagatccgccccgtcaaggagaaggaggagaacctggtgaagtccatggtgagcgccggcagcggcgaggtcgactccttcagcctggggctcctgtgcatctccatcatgatcgaggaggtgatgcggagccgctggtcccggaagatgctgatgacgggcaccctcgccgtgttcttcctgctgatcatggggcagctcacctggaacgacctgatccgcctgtgcatcatggtcggcgccaacgccagcgaccgcatggggatgggcaccacgtacctcgcgctgatggccaccttcaagatgcggccgatgttcgccgtgggcctcctcttccgccggctgacctcccgcgaggtgctgctcctgaccatcgggctgagcctcgtcgcctccgtggagctgcccaacagcctggaggagctcggcgacgggctggccatgggcatcatgatcctgaagctcctgacggacttccagtcccaccagctgtgggcgaccctcctgagcctgaccttcatcaagaccacgttctccctccactacgcctggaagaccatggccatggtcctgagcatcgtgtccctgttccccctctgcctgagcaccacctcccagaagacgacctggctgcccgtgctcctgggcagcctggggtgcaagccgctcaccatgttcctgatcgccgagaacaagatctggggccggcgctcctggcccctgaacgaggggatcatggcggtcggcatcgtgagcatcctcctgagctccctgctcaagaacgacgtgcccctggccgggcccctgatcgccggcggcatgctcatcgcctgctacgtcatcagcgggtccagcgccgacctgtccctggagaaggcggccgaggtgagctgggaggaggaggccgagcactccggcgccagccacaacatcctcgtggaggtccaggacgacgggaccatgaagatcaaggacgaggagcgggacgacaccctgacgatcctgctcaaggccaccctgctggcggtgtccggcgtgtacccgctcagcatccccgccaccctgttcgtctggtacttctggcagaagaagaagcagcgctccggggtgctgtgggacacccccagcccgcccgaggtggagcgggccgtcctcgacgacggcatctaccgcatcatgcagcggggcctgctggggcgctcccaggtgggcgtgggggtcttccaggagaacgtgttccacacgatgtggcacgtgacccggggcgccgtcctgatgtaccaggggaagcgcctcgagcccagctgggcctccgtgaagaaggacctgatcagctacggcggcgggtggcggctgcagggctcctggaacaccggggaggaggtgcaggtcatcgcggtggagcccggcaagaaccccaagaacgtgcagaccgcccccgggacgttcaagacccccgagggcgaggtcggcgccatcgccctcgacttcaagcccgggaccagcggctcccccatcgtgaaccgcgaggggaagatcgtgggcctgtacggcaacggggtcgtgaccacgagcggcacctacgtgagcgccatcgcgcaggccaaggcctcccaggaggggccgctgcccgagatcgaggacgaggtcttccggaagcgcaacctcaccatcatggacctgcaccccggcagcgggaagacccggcgctacctgccggccatcgtgcgggaggcgatcaagcgcaagctccgcacgctgatcctggcccccacccgggtggtcgcctccgagatggccgaggccctcaagggcatgcccatccgctaccagaccaccgcggtcaagagcgagcacacgggcaaggagatcgtggacctgatgtgccacgccaccttcaccatgcggctgctctcccccgtccgcgtgccgaactacaacatgatcatcatggacgaggcccacttcaccgaccccagctccatcgccgcccgggggtacatcagcacgcgcgtgggcatgggggaggcggccgccatcttcatgaccgccacgccgcccggctccgtcgaggccttcccgcagagcaacgcggtgatccaggacgaggagcgggacatccccgagcgctcctggaacagcgggtacgagtggatcaccgacttccccggcaagacggtgtggttcgtcccctccatcaagagcggcaacgacatcgccaactgcctgcggaagaacgggaagcgcgtgatccagctgtcccggaagaccttcgacaccgagtaccagaagaccaagaacaacgactgggactacgtggtcacgaccgacatcagcgagatgggcgccaacttccgcgccgaccgggtgatcgacccgcgccggtgcctcaagcccgtgatcctgaaggacgggcccgagcgcgtcatcctggcgggccccatgccggtgaccgtcgcctccgccgcccagcggcgcgggcggatcggccgcaaccacaacaaggagggcgaccagtacatctacatggggcagcccctcaacaacgacgaggaccacgcccactggaccgaggcgaagatgctgctggacaacatcaacacgcccgagggcatcatccccgccctcttcgagccggagcgcgagaagtccgccgccatcgacggggagtaccggctgcgcggcgaggcccggaagaccttcgtggagctgatgcgccgcggggacctccccgtgtggctgtcctacaaggtcgcgagcgagggcttccagtacagcgaccgccggtggtgcttcgacggcgagcgcaacaaccaggtgctggaggagaacatggacgtggagatctggaccaaggagggggagcggaagaagctccgcccccggtggctggacgcccgcacctactccgaccccctggccctccgggagttcaaggagttcgccgccggccgccggagcgtctccggggacctgatcctggagatcggcaagctcccgcagcacctgacgcagcgcgcgcagaacgccctggacaacctcgtgatgctgcacaacagcgagcagggcgggcgggcctaccgccacgccatggaggagctgcccgacaccatcgagaccctcatgctgctggcgctcatcgccgtgctgaccggcggggtcaccctgttcttcctctccggccgggggctgggcaagacgagcatcggcctgctctgcgtgatggcctccagcgtgctgctgtggatggcctccgtcgagccccactggatcgccgcgagcatcatcctcgagttcttcctgatggtgctgctcatccccgagccggaccgccagcggacgccccaggacaaccagctggcctacgtggtcatcgggctcctcttcatgatcctgaccgtggccgccaacgagatgggcctgctcgagaccacgaagaaggacctggggatcggccacgtggccgtcgagaaccaccaccacgcggccatgctggacgtggacctccaccccgcctccgcctggaccctgtacgccgtggcgaccaccatcatcacgccgatgatgcgccacaccatcgagaacaccaccgccaacatcagcctgacggccatcgccaaccaggccgcgatcctcatggggctggacaagggctggcccatctccaagatggacatcggcgtccccctgctcgccctggggtgctacagccaggtgaaccccctgaccctcaccgccgccgtgctgatgctggtcgcgcactacgccatcatcggcccggggctccaggccaaggccacccgcgaggcccagaagcggacggcggccggcatcatgaagaaccccaccgtggacgggatcgtggccatcgacctggaccccgtcgtgtacgacgccaagttcgagaagcagctgggccagatcatgctcctgatcctgtgcacctcccagatcctcctgatgcgcaccacgtgggccctgtgcgagagcatcaccctcgcgaccggccccctgaccacgctgtgggaggggtccccgggcaagttctggaacaccaccatcgccgtgagcatggccaacatcttccgggggtcctacctcgccggcgccggcctggcgttcagcctgatgaagtccctcgggggcgggcgccggggcaccggggcccagggcgagacgctgggcgagaagtggaagcgccagctgaaccagctctccaagagcgagttcaacacctacaagcggtccgggatcatggaggtcgaccgcagcgaggccaaggagggcctgaagcgcggggagaccaccaagcacgccgtgtcccgcggcacggcgaagctgcggtggttcgtggagcgcaacctcgtcaagcccgaggggaaggtgatcgacctgggctgcggccgcggcgggtggagctactactgcgccgggctgaagaaggtgaccgaggtcaaggggtacaccaagggcggccccggccacgaggagcccatcccgatggccacctacgggtggaacctggtgaagctccactccggcaaggacgtgttcttcatcccgcccgagaagtgcgacacgctgctgtgcgacatcggggagagctcccccaacccgaccatcgaggagggccgcaccctccgggtcctgaagatggtggagccctggctgcgcgggaaccagttctgcatcaagatcctcaacccctacatgcccagcgtggtcgagaccctggagcagatgcagcggaagcacggcggcatgctggtgcgcaacccgctctcccggaacagcacccacgagatgtactgggtgtcctgcgggacgggcaacatcgtcagcgccgtgaacatgacctcccgcatgctgctgaaccgcttcaccatggcccaccggaagcccacctacgagcgcgacgtggacctcggggcgggcacgcggcacgtcgccgtggagcccgaggtggccaacctggacatcatcggccagcgcatcgagaacatcaagcacgagcacaagagcacctggcactacgacgaggacaacccctacaagacctgggcctaccacgggtcctacgaggtcaagccgagcggctccgccagcagcatggtgaacggggtcgtgaagctgctcaccaagccctgggacgtgatccccatggtcacgcagatcgcgatgaccgacaccacccccttcggccagcagcgggtgttcaaggagaaggtggacacgcgcaccccgaaggccaagcgggggaccgcccagatcatggaggtcaccgccaagtggctgtggggcttcctgtcccgcaacaagaagccccggatctgcacgcgcgaggagttcacccggaaggtgcgcagcaacgccgcgatcggcgccgtgttcgtcgacgagaaccagtggaactccgccaaggaggccgtggaggacgagcggttctgggacctcgtgcaccgcgagcgggagctgcacaagcaggggaagtgcgcgacctgcgtctacaacatgatgggcaagcgcgagaagaagctgggggagttcggcaaggccaaggggagccgggccatctggtacatgtggctcggcgcccgcttcctggagttcgaggccctgggcttcatgaacgaggaccactggttctcccgggagaacagcctctccggggtggagggcgaggggctgcacaagctgggctacatcctccgcgacatcagcaagatccccgggggcaacatgtacgcggacgacaccgccggctgggacacgcggatcaccgaggacgacctgcagaacgaggcccgcatcaccgacatcatggagccggagcacgccctgctcgccaagtccatcttcaagctgacctaccagaacaaggtggtccgcgtgcagcggcccgcgaagaacgggacggtgatggacgtcatcagccgccgggaccagcgcggctccggccaggtggggacctacggcctgaacaccttcaccaacatggaggcccagctcatccggcagatggagagcgaggggatcttctcccccagcgagctggagacgcccaacctggccgagcgcgtgctcgactggctggagaagtacggcgtcgagcggctgaagcgcatggccatctccggggacgactgcgtggtgaagccgatcgacgaccggttcgccaccgcgctcaccgccctgaacgacatgggcaaggtccgcaaggacatcccccagtgggagcccagcaaggggtggaacgactggcagcaggtccccttctgctcccaccacttccaccagctgatcatgaaggacggccgggagatcgtggtcccgtgccgcaaccaggacgagctcgtgggccgggcccgcgtgagccagggggccggctggagcctgcgggagaccgcctgcctggggaagtcctacgcgcagatgtggcagctcatgtacttccaccgccgggacctgcgcctggccgccaacgccatctgcagcgcggtccccgtggactggatccccacgtcccggaccacctggagcatccacgcccaccaccagtggatgaccacggaggacatgctctccgtgtggaaccgcgtctggatcgaggagaacccctggatggaggacaagacccacatcagctcctggggcgacgtgccgtacctggggaagcgcgaggaccagtggtgcggcagcctgatcggcctcaccgcccgggccacctgggccaccaacatccaggtggcgatcaaccaggtccgccggctgatcgggaacgagaactacctggactacatgacgtccatgaagcgcttcaagaacgagagcgaccccgagggcgccctctggtga

SEQ ID NO: 8359 - RNA, 9879 nt, synthetic construct
  misc_feature 1..9879: note = derived and/or modified CDS sequence (opt1) from DENV-1__FJ432733__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgccggggtgaacatgtgcaccctcatcgccatggacctgggcgagctgtgcgaggacaccatgacctacaagtgcccccggatcaccgaggtggagcccgacgacgtggactgctggtgcaacgccaccgacacctgggtgacctacgggacctgcagccagacgggcgagcaccggcgcgacaagcggagcgtggccctcgcgccccacgtcggcctggggctggagacccgcaccgagacctggatgtccagcgagggcgcctggaagcagatccagcgggtggagacgtgggccctccgccaccccgggttcaccgtgatcgccctgttcctggcccacgtcatcggcacctccatcacccagaaggggatcatcttcatcctcctgatgctggtgacgcccagcatggcgatgcggtgcgtgggcatcggctcccgcgacttcgtcgaggggctcagcggcgccacctgggtggacgtggtcctggagcacgggtcctgcgtgaccaccatggccaaggacaagcccacgctggacatcgagctcctgaagaccgaggtgaccaaccccgccgtcctgcggaagctctgcatcgaggccaagatcagcaacaccacgaccgactcccgctgccccacccagggcgaggcgaccctgatggaggagcaggacgccaacttcgtgtgccggcgcacgttcgtggaccggggctgggggaacggctgcgggctgttcggcaaggggagcctcatcacgtgcgccaagttcaagtgcgtcaccaagctggagggcaagatcgtgcagtacgagaacctgaagtactccgtgatcgtcaccgtgcacacgggcgaccagcaccaggtcgggaacgagagcaccgagcacggcaccatcgccaccatcacgccccaggcccccacgtccgagatccagctcaccgactacggggcgctgaccctggactgcagcccccgcaccggcctcgacttcaacgagatggtgctgctgacgatgaaggagaagtcctggctcgtgcacaagcagtggttcctggacctgccgctcccctggaccagcggggccagcacctcccaggagacctggaaccggcaggacctgctggtcacgttcaagaccgcccacgccaagaagcaggaggtggtggtcctcggcagccaggagggcgccatgcacaccgcgctgaccggggccacggagatccagacctccggcaccaccacgatcttcgccgggcacctgaagtgccgcctcaagatggacaagctgaccctgaagggcatgagctacgtgatgtgcaccgggtccttcaagctcgagaaggaggtggccgagacccagcacggcacggtcctggtgcagatcaagtacgagggcaccgacgccccctgcaagatccccttcagcacccaggacgagaagggggtgacccagaacggccggctgatcacggcgaacccgatcgtcaccgacaaggagaagcccgtgaacatcgaggccgagccgcccttcggggagtcctacatcgtgatcggcgccggcgagaaggccctgaagctcagctggttcaagaaggggtccagcatcggcaagatgttcgaggcgaccgcccgcggggcccggcgcatggccatcctgggcgacaccgcctgggacttcgggtccatcggcggcgtcttcacgagcgtggggaagctggtgcaccagatcttcggcaccgcgtacggggtcctcttctccggcgtgagctggaccatgaagatcgggatcggcgtgctgctgacctggctcggcctgaactcccgcagcacgtccctgagcatgacctgcatcgccgtcgggctcgtgaccctgtacctgggcgtgatggtccaggccgactccgggtgcgtgatcaactggaagggccgggagctcaagtgcgggagcggcatcttcgtgaccaacgaggtccacacgtggaccgagcagtacaagttccaggccgacagcccgaagcgcctgtccgccgcgatcggcaaggcctgggaggagggggtgtgcggcatccggagcgccacccgcctggagaacatcatgtggaagcagatctccaacgagctcaaccacatcctgctggagaacgacatgaagttcaccgtggtcgtgggggacgtggtcggcatcctcgcccaggggaagaagatgatccggccccagcccatggagcacaagtacagctggaagtcctggggcaaggccaagatcatcggcgcggacgtgcagaacaccacgttcatcatcgacgggcccaacaccccggagtgccccgacgaccagcgcgcctggaacatctgggaggtggaggactacggcttcgggatcttcaccaccaacatctggctgaagctgcgggacagccacacgcaggtctgcgaccaccgcctcatgtccgccgccatcaaggacagcaaggcggtgcacgccgacatgggctactggatcgagtccgagaagaacgagacctggaagctggcccgggccagcttcatcgaggtgaagacctgcatctggcccaagtcccacaccctgtggagcaacggcgtcctcgagtccgagatgatcatccccaagatctacgggggcccgatcagccagcacaactaccgccccgggtacttcacgcagaccgccggcccctggcacctggggaagctggagctcgacttcgacctgtgcgagggcaccaccgtggtggtcgacgagcactgcggcaaccgggggccgtccctgcgcacgaccaccgtgaccggcaagatcatccacgagtggtgctgccggagctgcacgctgccgcccctccgcttcaagggggaggacggctgctggtacgggatggagatccggcccgtgaaggagaaggaggagaacctggtcaagtccatggtgagcgcgggcagcggcgaggtggactccttcagcctcgggctgctgtgcatctccatcatgatcgaggaggtcatgcgcagccggtggtcccgcaagatgctcatgaccggcaccctggccgtgttcctgctcctgatcatggggcagctgacctggaacgacctcatccggctgtgcatcatggtgggcgccaacgccagcgaccgcatggggatgggcacgacctacctggccctcatggcgaccttcaagatgcgcccgatgttcgccgtcgggctgctgttccggcgcctcacctcccgggaggtgctgctgctcacgatcgggctgagcctggtcgcctccgtggagctccccaacagcctggaggagctgggcgacgggctcgccatgggcatcatgatcctgaagctgctcaccgacttccagtcccaccagctgtgggccaccctgctcagcctgaccttcatcaagacgaccctgtccctccactacgcgtggaagaccatggccatggtgctgagcatcgtctccctgttccccctctgcctgagcaccacgtcccagaagaccacctggctgcccgtgctcctgggcagcctggggtgcaagccgctcgccatgctgctgatcgccgagaacaagatctggggccgcaagtcctggcccctcaacgaggggatcatggcggtgggcgtcgtgagcatcctgctgagctccctcctgaagaacgacgtgcccctggccgggcccctcatcgccggcggcatgctgatcgcctgctacgtcatcagcgggtccagcgccgacctgtccctcgagaaggcggccgaggtgagctgggaggaggaggccgagcactccggcgccagccacaacatcctggtggaggtccaggacgacgggaccatgaagatcaaggacgaggagcgggacgacacgctgaccatcctcctgaaggccaccctgctcgcggtgtccggcgtgtacccgctgagcatccccgccaccctgttcgtctggtacttctggcagaagaagaagcagcgctccggggtgctgtgggacacccccagcccgcccgaggtggagcgggccgtcctcgacgacggcatctaccgcatcatgcagcggggcctgctggggcgctcccaggtgggcgtgggggtcttccaggagaacgtgttccacacgatgtggcacgtgacccggggcgccgtcctcatgtaccaggggaagcgcctggagcccagctgggcctccgtgaagaaggacctgatcagctacggcggcgggtggcggctccagggctcctggaacaccggggaggaggtgcaggtcatcgcggtggagcccggcaagaaccccaagaacgtgcagaccgcccccgggacgttcaagacccccgagggcgaggtcggcgccatcgccctggacttcaagcccgggaccagcggctcccccatcgtgaaccgcgaggggaagatcgtgggcctgtacggcaacggggtcgtgaccacgagcggcacctacgtgagcgccatcgcgcaggccaaggcctcccaggaggggccgctccccgagatcgaggacgaggtcttccggaagcgcaacctgaccatcatggacctgcaccccggcagcgggaagacccggcgctacctcccggccatcgtgcgggaggcgatcaagcgcaagctgcggacgctgatcctcgcccccacccgcgtggtcgcctccgagatggccgaggccctgaagggcatgcccatccgctaccagaccaccgcggtcaagagcgagcacacgggcaaggagatcgtggacctgatgtgccacgccaccttcaccatgcggctcctgtcccccgtccgcgtgccgaactacaacatgatcatcatggacgaggcccacttcaccgaccccagctccatcgccgcccgggggtacatcagcacgcgcgtgggcatgggggaggcggccgccatcttcatgaccgccacgccgcccggctccgtcgaggccttcccgcagagcaacgcggtgatccaggacgaggagcgggacatccccgagcgctcctggaacagcgggtacgagtggatcaccgacttccccggcaagacggtgtggttcgtcccctccatcaagagcggcaacgacatcgccaactgcctgcggaagaacgggaagcgcgtgatccagctctcccggaagaccttcgacaccgagtaccagaagaccaagaacaacgactgggactacgtggtcacgaccgacatcagcgagatgggcgccaacttccgcgccgaccgggtgatcgacccgcgccggtgcctgaagcccgtcatcctgaaggacgggcccgagcgcgtgatcctcgcgggccccatgccggtgaccgtcgcctccgccgcccagcggcgcgggcggatcggccgcaaccacaacaaggagggcgaccagtacatctacatggggcagcccctgaacaacgacgaggaccacgcccactggaccgaggcgaagatgctgctcgacaacatcaacacgcccgagggcatcatccccgccctgttcgagccggagcgggagaagtccgccgccatcgacggggagtaccgcctgcgcggcgaggcccggaagaccttcgtggagctcatgcgccgcggggacctgcccgtgtggctgtcctacaaggtcgcgagcgagggcttccagtacagcgaccgccggtggtgcttcgacggcgagcgcaacaaccaggtgctcgaggagaacatggacgtggagatctggaccaaggagggggagcggaagaagctgcgcccccggtggctggacgcccgcacctactccgaccccctcgccctgcgggagttcaaggagttcgccgccggccgccggagcgtctccggggacctgatcctcgagatcggcaagctgccgcagcacctgacgcagcgcgcgcagaacgccctcgacaacctggtgatgctgcacaacagcgagcagggcgggcgggcctaccgccacgccatggaggagctccccgacaccatcgagaccctgatgctgctcgcgctgatcgccgtgctgaccggcggggtcaccctgttcttcctgtccggccgggggctgggcaagaccagcatcggcctcctgtgcgtgatggcctccagcgtgctgctctggatggcctccgtcgagccccactggatcgccgcgagcatcatcctggagttcttcctgatggtgctcctgatccccgagccggaccgccagcggacgccccaggacaaccagctggcctacgtggtcatcgggctcctgttcatgatcctgaccgtggccgccaacgagatgggcctcctggagaccacgaagaaggacctggggatcggccacgtggccgtcgagaaccaccaccacgcgaccatgctcgacgtggacctgcaccccgcctccgcctggaccctgtacgccgtggccaccacgatcatcaccccgatgatgcgccacaccatcgagaacaccacggcgaacatcagcctcaccgccatcgccaaccaggccgccatcctgatggggctggacaagggctggcccatctccaagatggacatcggcgtccccctcctggcgctggggtgctacagccaggtgaaccccctcaccctgaccgccgccgtgctgatgctcgtcgcccactacgcgatcatcggcccggggctgcaggccaaggccacgcgggaggcccagaagcgcaccgccgcgggcatcatgaagaaccccaccgtggacgggatcgtggccatcgacctggaccccgtcgtgtacgacgccaagttcgagaagcagctcggccagatcatgctgctgatcctctgcacctcccagatcctgctgatgcgcacgacctgggccctctgcgagagcatcaccctggccaccggccccctgacgaccctctgggaggggtccccgggcaagttctggaacaccaccatcgcggtgagcatggccaacatcttccgggggtcctacctggccggcgccggcctggccttcagcctcatgaagtccctcgggggcgggcgccgggggacgggggcgcagggcgagaccctgggcgagaagtggaagcgccagctcaaccagctgtccaagagcgagttcaacatctacaagcggtccgggatcatggaggtcgaccgcagcgaggccaaggagggcctgaagcgcggggagaccacccgccacgccgtgtcccggggcacggccaagctgcgctggttcgtggagcggaacctcgtcaagcccgaggggaaggtgatcgacctgggctgcggccgcgggggctggagctactactgcgcggggctgaagaaggtgaccgaggtcaagggctacaccaagggcgggcccggccacgaggagcccatcccgatggccacctacgggtggaacctcgtgaagctgcactccggcaaggacgtgttcttcacgccgcccgagaagtgcgacaccctgctctgcgacatcggggagagctcccccaacccgaccatcgaggagggccggaccctgcgcgtcctgaagatggtggagccctggctccgggggaaccagttctgcatcaagatcctgaacccctacatgcccagcgtggtcgagacgctggagcagatgcagcgcaagcacggcggcatgctcgtgcggaacccgctgtcccgcaacagcacccacgagatgtactgggtgtcctgcgggaccggcaacatcgtcagcgccgtgaacatgacctcccggatgctgctcaaccgcttcaccatggcccaccgcaagcccacgtacgagcgggacgtggacctgggggccggcacccgccacgtcgcggtggagcccgaggtcgccaacctggacatcatcggccagcggatcgagaacatcaagcacgagcacaagagcacctggcactacgacgaggacaacccctacaagacctgggcctaccacgggtcctacgaggtgaagccgagcggctccgccagcagcatggtgaacggggtcgtgaagctcctgacgaagccctgggacgtgatccccatggtcacccagatcgccatgaccgacaccacgcccttcggccagcagcgcgtgttcaaggagaaggtggacacccggaccccgaaggcgaagcgcgggaccgcccagatcatggaggtcacggcccggtggctgtggggcttcctctcccgcaacaagaagccccggatctgcacccgcgaggagttcacccggaaggtgcgcagcaacgccgccatcggcgcggtgttcgtcgacgagaaccagtggaactccgccaaggaggccgtggaggacgagcggttctgggacctggtgcagaaggagcgcgagctgcacaagcaggggaagtgcgcgacctgcgtctacaacatgatgggcaagcgggagaagaagctcggggagttcggcaaggcgaaggggagccgcgccatctggtacatgtggctgggcgcccggttcctggagttcgaggccctcggcttcatgaacgaggaccactggttctcccgcgagaacagcctgtccggggtggagggcgaggggctgcacaagctcggctacatcctgcgggacatcagcaagatccccgggggcaacatgtacgccgacgacacggcgggctgggacacccgcatcaccgaggacgacctgcagaacgaggcccggatcaccgacatcatggagccggagcacgccctcctggccacgtccatcttcaagctgacctaccagaacaaggtggtccgcgtgcagcgccccgccaagaacgggaccgtgatggacgtcatcagccggcgcgaccagcggggctccggccaggtgggcacctacggcctcaacacgttcaccaacatggaggcgcagctgatccgccagatggagagcgaggggatcttcctgccctccgagctcgagacccagaacctggccgagcgggtgctggactggctcgagaagtacggcgtcgagcgcctgaagcggatggccatcagcggggacgactgcgtggtgaagcccatcgacgaccgcttcgccaccgccctgacggcgctcaacgacatgggcaaggtccggaaggacatcccgcagtgggagccctccaaggggtggaacgactggcagcaggtccccttctgcagccaccacttccaccagctgatcatgaaggacggccgcgagatcgtggtcccctgccggaaccaggacgagctggtgggccgcgcccgggtgtcccagggggccggctggagcctccgcgagaccgcctgcctgggcaagagctacgcccagatgtggcagctgatgtacttccaccggcgcgacctccggctggcggccaacgccatctgctccgccgtcccggtggactgggtgcccaccagccgcaccacgtggtccatccacgcgcaccaccagtggatgaccaccgaggacatgctgagcgtctggaaccgggtgtggatcgaggagaacccctggatggaggacaagacccacgtgtccagctggggcgacgtcccctacctcgggaagcgcgaggaccagtggtgcggctccctgatcggcctgacggcccgcgccacctgggccagcaacatccaggtggccatcaaccaggtgcggcgcctcatcgggaacgagaactacctggactacatgacctccatgaagcggttcaagaacgagggcgacccggagggggcgctgtggtga

SEQ ID NO: 8360 - RNA, 9879 nt, synthetic construct
  misc_feature 1..9879: note = derived and/or modified CDS sequence (opt1) from DENV-1__FJ410196__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagacctccgccggggtgaacatgtgcaccctcatcgccatggacctgggcgagctgtgcgaggacaccatgacctacaagtgcccccgcatcaccgagaccgagcccgacgacgtggactgctggtgcaacgccacggacacctgggtgacctacgggacctgcagccagacgggcgagcaccggcgcgacaagcggtccgtggccctcgcgccccacgtgggcctggggctggagacccgcaccgagacctggatgagctccgagggcgcgtggaagcagatccagcgggtggagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtcgggaagctggtgcaccagatcttcggcaccgcctacggggtcctcttctccggcgtcagctggacgatgaagatcgggatcggcgtgctgctgacctggctcggcctgaactcccgcagcacctccctgagcatgacctgcatcgccgtggggctcgtcacgctgtacctgggcgtgatggtgcaggccgactccgggtgcgtcatcaactggaagggccgggagctcaagtgcgggagcggcatcttcgtgaccaacgaggtgcacacctggaccgagcagtacaagttccaggccgacagcccgaagcgcctgtccgcggccatcggcaaggcctgggaggagggggtctgcggcatccggagcgccacccgcctggagaacatcatgtggaagcagatctccaacgagctcaaccacatcctgctggagaacgacatgaagttcacggtggtggtcggggacgtggccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtcgaggactacggcttcgggatcttcacgaccaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacgtgcatctggcccaagtcccacaccctgtggagcaacggcgtgctcgagtccgagatgatcatccccaagatctacgggggcccgatcagccagcacaactaccgccccgggtacttcacccaggccgccggcccctggcacctggggaagctggagctcgacttcgacctgtgcgagggcaccacggtggtcgtggacgagcactgcggcaaccgggggccgtccctgcgcaccaccaccgtgacgggcaagatcatccacgagtggtgctgccggagctgcaccctgccgcccctccgcttccgcggggaggacggctgctggtacgggatggagatccgccccgtcaaggagaaggaggagaacctggtgaagtccatggtgagcgccggcagcggcgaggtcgactccttcagcctcgggctgctgtgcatctccatcatgatcgaggaggtgatgcggagccgctggtcccggcgcatgctcatgaccggcaccctggccgtgttcttcctgctcatcatggggcagctgacgtggaacgacctgatccgcctctgcatcatggtcggcgcgaacgccagcgaccggatggggatgggcaccacctacctggccctgatggccaccttcaagatgcgcccgatgttcgccgtgggcctcctgttccggcgcctgacgtcccgggaggtgctcctgctgaccatcgggctcagcctggtcgcgtccgtggagctgcccaacagcctcgaggagctgggcgacgggctggccatgggcatcatgatcctcaagctgctgaccgacttccagtcccaccagctctgggccaccctgctgagcctcacgttcatcaagaccaccttctccctgcactacgcctggaagaccatggcgatggtcctgagcatcgtgtccctcttccccctgtgcctgagcacgacctcccagaagaccacctggctccccgtgctgctgggcagcctcgggtgcaagccgctgacgatgttcctgatcgccgagaacaagatctggggccgccggtcctggcccctcaacgaggggatcatggccgtcggcatcgtgagcatcctgctgagctccctcctgaagaacgacgtgcccctggccgggcccctcatcgccggcggcatgctgatcgcgtgctacgtcatcagcgggtccagcgccgacctgtccctcgagaaggccgccgaggtgagctgggaggaggaggccgagcactccggcgcgagccacaacatcctggtggaggtccaggacgacgggaccatgaagatcaaggacgaggagcgcgacgacaccctgaccatcctcctgaaggccaccctgctcgccgtgtccggcgtgtacccgctgagcatccccgccacgctgttcgtctggtacttctggcagaagaagaagcagcggtccggggtgctctgggacacccccagcccgcccgaggtggagcgcgccgtcctggacgacggcatctaccggatcatgcagcgcggcctgctggggcggtcccaggtgggcgtgggggtcttccaggagaacgtgttccacaccatgtggcacgtgacccgcggcgcggtcctcatgtaccaggggaagcggctggagcccagctgggcctccgtgaagaaggacctgatcagctacggcggcgggtggcgcctccagggctcctggaacacgggggaggaggtgcaggtcatcgccgtggagcccggcaagaaccccaagaacgtgcagaccgcccccgggaccttcaagacccccgagggcgaggtcggcgccatcgcgctggacttcaagcccgggacgagcggctcccccatcgtgaaccgggaggggaagatcgtgggcctgtacggcaacggggtcgtgaccaccagcggcacctacgtgagcgccatcgcccaggccaaggcgtcccaggaggggccgctccccgagatcgaggacgaggtcttccgcaagcggaacctgacgatcatggacctgcaccccggcagcgggaagacccgccggtacctcccggccatcgtgcgcgaggccatcaagcgcaagctgcggaccctgatcctcgcccccacccgcgtggtcgcctccgagatggcggaggccctgaagggcatgcccatccggtaccagacgaccgccgtcaagagcgagcacaccggcaaggagatcgtggacctgatgtgccacgccaccttcacgatgcgcctcctgtcccccgtccgggtgccgaactacaacatgatcatcatggacgaggcccacttcaccgaccccttcagcatcgcggcccgcgggtacatctccacccgggtgggcatgggggaggccgccgccatcttcatgaccgcgacgccgcccggcagcgtcgaggccttcccgcagtccaacgccgtgatccaggacgaggagcgcgacatccccgagcggagctggaactccgggtacgagtggatcaccgacttccccggcaagaccgtgtggttcgtccccagcatcaagtccggcaacgacatcgccaactgcctgcgcaagaacgggaagcgggtgatccagctcagccgcaagaccttcgacacggagtaccagaagaccaagaacaacgactgggactacgtggtcaccaccgacatctccgagatgggcgcgaacttccgggccgaccgcgtgatcgacccgcggcgctgcctgaagcccgtgatcctgaaggacgggcccgagcgggtcatcctcgccggccccatgccggtgacggtcgccagcgccgcgcagcgccgggggcgcatcggccgcaaccacaacaaggagggcgaccagtacatctacatggggcagcccctgaacaacgacgaggaccacgcccactggaccgaggccaagatgctgctcgacaacatcaacacccccgagggcatcatccccgccctgttcgagccggagcgggagaagtccgccgcgatcgacggggagtaccgcctgcggggcgaggcccgcaagaccttcgtggagctcatgcggcgcggggacctgcccgtgtggctgagctacaaggtcgcctccgagggcttccagtacagcgaccggcgctggtgcttcgacggcgagcggaacaaccaggtgctcgaggagaacatggacgtggagatctggacgaaggagggggagcgcaagaagctgcggccccgctggctggacgcccggacctacagcgaccccctcgccctgcgcgagttcaaggagttcgcggccggccggcgctccgtcagctccgacctgatcctcgagatcgggaagctgccgcagcacctgacccagcgggcccagaacgccctcgacaacctggtgatgctgcacaacagcgagcagggcggccgcgcgtaccggcacgccatggaggagctccccgacaccatcgagacgctgatgctgctcgccctgatcgccgtgctgaccgggggcgtcaccctcttcttcctgtccgggcgcggcctggggaagaccagcatcggcctcctgtgcgtgatggcctccagcgtgctgctctggatggcgtccgtcgagccccactggatcgccgccagcatcatcctggagttcttcctgatggtgctcctgatccccgagccggaccggcagcgcacgccccaggacaaccagctggcctacgtggtcatcggcctcctgttcatgatcctgacggtggccgcgaacgagatggggctcctggagaccaccaagaaggacctgggcatcgggcacgtggccgtcgagaaccaccaccacgccgccatgctcgacgtggacctgcaccccgcctccgcgtggaccctgtacgccgtggccacgaccatcatcaccccgatgatgcgccacaccatcgagaacacgaccgccaacatcagcctcaccgccatcgcgaaccaggccgccatcctgatgggcctggacaaggggtggcccatctccaagatggacatcggcgtccccctcctggccctgggctgctacagccaggtgaaccccctcaccctgacggcggccgtgctgatgctcgtcgcccactacgccatcatcgggccgggcctgcaggccaaggcgacccgggaggcccagaagcgcaccgccgccgggatcatgaagaaccccaccgtggacggcatcgtggccatcgacctggaccccgtcgtgtacgacgcgaagttcgagaagcagctcgggcagatcatgctgctgatcctctgcacgtcccagatcctgctgatgcggaccacctgggccctctgcgagagcatcaccctggccacgggccccctgaccaccctctgggagggctccccggggaagttctggaacaccacgatcgccgtgagcatggccaacatcttccgcggctcctacctggcgggggccggcctggccttcagcctcatgaagtccctgggcgggggccggcgcgggaccggcgcccagggggagaccctgggcgagaagtggaagcggcagctcaaccagctgtccaagagcgagttcaacacctacaagcgctccggcatcatggaggtcgaccggagcgaggcgaaggaggggctgaagcgcggcgagacgaccaagcacgccgtgtcccgggggaccgccaagctccgctggttcgtggagcggaacctggtcaagcccgagggcaaggtgatcgacctggggtgcggccgcggcgggtggagctactactgcgccggcctgaagaaggtgaccgaggtcaaggggtacacgaagggcgggcccggccacgaggagcccatcccgatggccacctacggctggaacctcgtgaagctgcactccgggaaggacgtgttcttcatcccgcccgagaagtgcgacaccctgctctgcgacatcggcgagagctcccccaacccgaccatcgaggaggggcggacgctgcgcgtcctgaagatggtggagccctggctccggggcaaccagttctgcatcaagatcctgaacccctacatgcccagcgtggtcgagaccctggagcagatgcagcgcaagcacgggggcatgctcgtgcggaacccgctgtcccgcaacagcacccacgagatgtactgggtgtcctgcggcaccgggaacatcgtcagcgcggtgaacatgacctcccgcatgctgctcaaccggttcacgatggcccaccgcaagcccacctacgagcgggacgtggacctgggcgccgggacccgccacgtcgccgtggagcccgaggtggccaacctggacatcatcggccagcggatcgagaacatcaagcacgagcacaagagcacctggcactacgacgaggacaacccctacaagacgtgggcgtaccacggctcctacgaggtcaagccgagcgggtccgccagcagcatggtgaacggcgtcgtgaagctcctgaccaagccctgggacgtgatccccatggtcacccagatcgccatgaccgacacgacccccttcgggcagcagcgcgtgttcaaggagaaggtggacacccggaccccgaaggccaagcgcggcacggcccagatcatggaggtcaccgcgaagtggctgtgggggttcctctcccggaacaagaagccccgcatctgcacccgggaggagttcacccgcaaggtgcggagcaacgccgccatcggcgccgtgttcgtcgacgagaaccagtggaactccgcgaaggaggccgtggaggacgagcgcttctgggacctggtgcaccgggagcgcgagctgcacaagcagggcaagtgcgccacgtgcgtctacaacatgatggggaagcgggagaagaagctcggcgagttcgggaaggccaagggcagccgcgccatctggtacatgtggctgggggcgcggttcctggagttcgaggccctcggcttcatgaacgaggaccactggttctcccgcgagaacagcctgtccggcgtggagggggagggcctgcacaagctcgggtacatcctgcggggcatcagcaagatccccgggggcaacatgtacgccgacgacaccgccggctgggacacccgcatcaccgaggacgacctgcagaacgaggcccgcatcacggacatcatggagccggagcacgcgctcctggccaagtccatcttcaagctgacctaccagaacaaggtggtccgggtgcagcgccccgccaagaacgggaccgtgatggacgtcatcagccggcgcgaccagcggggctccggccaggtggggacctacggcctcaacacgttcaccaacatggaggcccagctgatccgccagatggagagcgaggggatcttctcccccagcgagctggagacccccaacctcgccgagcgggtgctggactggctggagaagtacggcgtcgagcgcctcaagcggatggcgatctccggggacgactgcgtggtgaagccgatcgacgaccgcttcgccaccgccctgacggccctgaacgacatgggcaaggtccggaaggacatcccccagtgggagcccagcaaggggtggaacgactggcagcaggtccccttctgctcccaccacttccaccagctcatcatgaaggacggccgcgagatcgtggtcccgtgccggaaccaggacgagctggtgggccgcgcccgggtgagccagggggcgggctggagcctgcgcgagaccgcctgcctcgggaagtcctacgcccagatgtggcagctgatgtacttccaccggcgcgacctgcggctcgccgcgaacgccatctgcagcgccgtccccgtggactggatccccacctcccgcaccacgtggagcatccacgcccaccaccagtggatgaccaccgaggacatgctgtccgtgtggaaccgcgtctggatcgaggagaacccctggatggaggacaagacccacatcagctcctggggcgacgtgccgtacctggggaagcgggaggaccagtggtgcggcagcctcatcggcctgacggcccgcgcgacctgggccaccaacatccaggtggccatcaaccaggtccggcgcctgatcgggaacgagaactacctcgactacatgacctccatgaagcggttcaagaacgagagcgaccccgagggcgccctgtggtga

SEQ ID NO: 8361 - RNA, 9879 nt, synthetic construct
  misc_feature 1..9879: note = derived and/or modified CDS sequence (opt1) from DENV-1__FJ432734__SS-prME
  source 1..9879: mol_type = other RNA
agcgtgaccatgctgctcatgctgatgcccaccgccctggccttccacctcaccacccgcggcggggagccccacatgatcgtgagcaagcaggagcggggcaagagcctgctgttcaagaccagcgcgggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggtgctccgccaccccgggttcacggtgatcgccctgttcctggcccacgcgatcggcaccagcatcacccagaaggggatcatcttcatcctcctgatgctggtcaccccctccatggccatgcggtgcgtgggcatcggcagccgcgacttcgtggaggggctctccggcgccacgtgggtcgacgtggtgctggagcacgggagctgcgtcaccaccatggccaaggacaagcccaccctggacatcgagctcctgaagacggaggtgaccaaccccgccgtgctgcggaagctctgcatcgaggcgaagatctccaacaccaccacggacagccgctgcccgacccagggcgaggccaccctggtcgaggagcaggacgccaacttcgtgtgccggcgcaccttcgtggaccggggctgggggaacggctgcgggctgttcggcaaggggtccctcatcacgtgcgccaagttcaagtgcgtcaccaagctggagggcaagatcgtgcagtacgagaacctgaagtacagcgtgatcgtcaccgtgcacaccggcgaccagcaccaggtcgggaacgagtccacggagcacggcaccaccgccaccatcacgccccaggcgcccacgaccgagatccagctcaccgactacggggccctgaccctggactgcagcccccgcacgggcctcgacttcaacgagatggtgctgctgaccatgaaggagaagtcctggctcgtgcacaagcagtggttcctggacctgcccctcccctggaccagcggggccagcacctcccaggagacgtggaaccggcaggacctgctggtcaccttcaagaccgcccacgccaagaagcaggaggtggtggtcctcggcagccaggagggcgcgatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtggccgagacgcagcacggcaccgtcctggtgcagatcaagtacgagggcaccgacgcgccctgcaagatccccttcagcacccaggacgagaagggggtgacgcagaacggccggctgatcaccgccaacccgatcgtcaccgacaaggagaagcccgtgaacatcgaggccgagccgcccttcggggagtcctacatcgtgatcggcgccggcgagaaggcgctgaagctcagctggttcaagaaggggtccagcatcggcaagatgttcgaggccaccgcccgcggggcccggcgcatggccatcctgggcgacacggcgtgggacttcgggtccatcggcggcgtcttcaccagcgtggggaagctggtgcaccagatcttcggcaccgcctacggggtcctcttctccggcgtgagctggaccatgaagatcgggatcggcgtgctgctgacgtggctcggcctgaactcccgcagcacctccctgagcatgacctgcatcgccgtcgggctcgtgaccctgtacctgggcgtgatggtccaggccgactccgggtgcgtgatcaactggaagggccgggagctcaagtgcgggagcggcatcttcgtgacgaacgaggtccacacctggaccgagcagtacaagttccaggccgacagcccgaagcgcctgtccgcggccatcggcaaggcctgggaggagggggtgtgcggcatccggagcgccacccgcctggagaacatcatgtggaagcagatctccaacgagctcaaccacatcctgctggagaacgacatgaagctcaccgtggtcgtgggggacgtggccggcatcctggggcagggcaagaagatgatccggccccagcccatggagtacaagtacagctggaagtcctggggcaaggcgaagatcatcggggccgacgcccagaacacgaccttcatcatcgacggccccaacaccccggagtgccccgacgaccagcgcgcctggaacatctgggaggtcgaggactacgggttcggcatgttcaccacgaacatctggctgaagctccgggacagctacacccaggtgtgcgaccaccgcctgatgtccgcggccatcaaggacagcaaggccgtgcacgccgacatgggctactggatcgagtccgagaagaacgagacctggaagctggcccgggcgagcttcatcgaggtcaagacctgcatctggcccaagtcccacacgctctggagcaacggggtgctggagtccgagatgatcatccccaagatctacggcgggccgatcagccagcacaactaccgccccggctacttcacccagaccgccgggccctggcacctgggcaagctcgagctggacttcgacctgtgcgagggcaccacggtggtcgtggacgagcactgcgggaaccggggcccgtccctccgcaccaccaccgtgacggggaagatcatccacgagtggtgctgccggagctgcaccctgccgcccctgcgcttccggggcgaggacgggtgctggtacggcatggagatccgccccgtcaaggagaaggaggagaacctcgtgaagtccatggtgagcgccggcagcggggaggtcgactccttcagcctgggcctgctctgcatctccatcatgatcgaggaggtgatgcggagccgctggtcccggaagatgctgatgaccgggaccctggccgtgttcttcctcctgatcatgggccagctgacgtggaacgacctcatccgcctgtgcatcatggtcggggccaacgcgagcgaccgcatgggcatgggcaccacctacctggccctcatggccaccttcaagatgcggccgatgttcgccgtggggctgctgttccgccggctcacgtcccgcgaggtgctgctgctcaccatcggcctgagcctggtcgcctccgtggagctccccaacagcctggaggagctgggggacggcctcgcgatgggcatcatgatcctgaagctgctcaccgacttccagtcccaccagctgtgggccaccctgctcagcctgacgttcatcaagaccaccttctccctgcactacgcctggaagaccatggccatggtcctcagcatcgtgtccctgttccccctgtgcctcagcacgacctcccagaagaccacctggctgcccgtgctgctcgggagcctgggctgcaagccgctgacgatgttcctcatcgcggagaacaagatctgggggcggaagtcctggcccctgaacgagggcatcatggccgtcgggatcgtgagcatcctgctcagctccctgctgaagaacgacgtgcccctcgccggccccctgatcgccggcgggatgctgatcgcctgctacgtcatcagcggctccagcgcggacctctccctggagaaggccgccgaggtgagctgggaggaggaggccgagcactccggggccagccacaacatcctggtggaggtccaggacgacggcaccatgaagatcaaggacgaggagcgcgacgacaccctcaccatcctgctgaaggcgaccctcctggccgtgtccggggtgtacccgctgagcatccccgccaccctcttcgtctggtacttctggcagaagaagaagcagcggtccggcgtgctgtgggacacccccagcccgcccgaggtggagcgcgccgtcctggacgacggcatctaccggatcatgcagcgcgggctgctcggccggtcccaggtgggggtgggcgtcttccaggagaacgtgttccacaccatgtggcacgtgacccgcggggccgtcctgatgtaccagggcaagcggctggagcccagctgggcgtccgtgaagaaggacctcatcagctacggcgggggctggcgcctgcgggggtcctggaacacgggcgaggaggtgcaggtcatcgccgtggagcccgggaagaaccccaagaacgtgcagaccgcccccggcaccttcaagacccccgagggcgaggtcggggccatcgccctggacttcaagcccggcacgagcgggtcccccatcgtgaaccgcgagggcaagatcgtgggcctctacgggaacggcgtcgtgaccaccagcgggacctacgtgagcgcgatcgcccaggccaaggcctcccaggagggcccgctgcccgagatcgaggacgaggtcttccggaagcgcaacctgacgatcatggacctccaccccgggagcggcaagacccggcgctacctgccggcgatcgtgcgggaggccatcaagcgcaagctgcgcaccctcatcctggcccccacccgggtggtcgcctccgagatggccgaggcgctgaagggcatgcccatccgctaccagacgaccgccgtcaagagcgagcacaccgggaaggagatcgtggacctcatgtgccacgccaccttcacgatgcggctgctgtcccccgtccgcgtgccgaactacaacatgatcatcatggacgaggcccacttcaccgaccccagctccatcgccgcgcggggctacatcagcacccgcgtggggatgggcgaggccgccgccatcttcatgaccgccacgccgcccgggtccgtcgaggcgttcccgcagagcaacgccgtgatccaggacgaggagcgggacatccccgagcgctcctggaacagcggctacgagtggatcaccgacttccccggcaagaccgtgtggttcgtcccctccatcaagagcgggaacgacatcgccaactgcctccggaagaacggcaagcgcgtgatccagctgtcccggaagaccttcgacacggagtaccagaagaccaagaacaacgactgggactacgtggtcaccaccgacatcagcgagatgggggccaacttccgcgcggaccgggtgatcgacccgcgccggtgcctgaagcccgtgatcctcaaggacggccccgagcgcgtcatcctggccgggcccatgccggtgacggtcgcctccgccgcccagcggcgcggccggatcggccgcaaccacaacaaggagggggaccagtacatctacatgggccagcccctgaacaacgacgaggaccacgcgcactggaccgaggccaagatgctcctggacaacatcaacacccccgaggggatcatccccgccctgttcgagccggagcgcgagaagtccgccgccgtggacggcgagtaccggctccgcggggaggcgcggaagaccttcgtggagctgatgcgccggggcgacctgcccgtctggctctcctacaaggtggccagcgagggcttccagtacagcgaccgccggtggtgcttcgacggggagcgcaacaaccaggtgctggaggagaacatggacgtcgagatctggacgaaggagggcgagcggaagaagctgcgcccccggtggctcgacgcccgcacctactccgaccccctggccctgcgggagttcaaggagttcgccgcggggcgccggagcgtgtccggcgacctcatcctggagatcggcaagctgccgcagcacctcacccagcgcgcccagaacgccctggacaacctggtgatgctccacaacagcgagcagggcgggcgggcctaccgccacgcgatggaggagctgcccgacaccatcgagacgctgatgctcctggccctgatcgccgtcctcaccgggggcgtgaccctgttcttcctgtccgggcggggcctcggcaagaccagcatcgggctgctgtgcgtgatggcctccagcgtcctcctgtggatggcctccgtggagccccactggatcgcggccagcatcatcctggagttcttcctcatggtgctgctgatccccgagccggaccgccagcggacgccccaggacaaccagctcgcctacgtcgtgatcggcctgctgttcatgatcctcacggtggccgccaacgagatggggctgctggagaccaccaagaaggacctcggcatcgggcacgtcgcggtggagaaccaccaccacgccgccatgctggacgtggacctgcaccccgcctccgcctggaccctctacgcggtcgccacgaccatcatcaccccgatgatgcgccacaccatcgagaacacgaccgccaacatcagcctgaccgccatcgccaaccaggcggccatcctgatgggcctcgacaagggctggcccatctccaagatggacatcggggtgcccctgctggccctcggctgctacagccaggtgaaccccctgaccctgacggccgcggtcctcatgctggtggcccactacgccatcatcgggccgggcctgcaggccaaggccacccgcgaggcgcagaagcggaccgccgccgggatcatgaagaaccccaccgtggacggcatcgtcgccatcgacctcgaccccgtggtgtacgacgccaagttcgagaagcagctgggccagatcatgctgctcatcctgtgcacgtcccagatcctgctcatgcgcaccacctgggcgctgtgcgagagcatcaccctggccacggggcccctcaccaccctgtgggagggctccccggggaagttctggaacaccacgatcgccgtcagcatggccaacatcttccggggctcctacctggccggcgcggggctcgccttcagcctgatgaagtccctgggcgggggccgccgggggaccggcgcccagggcgagaccctcggggagaagtggaagcgccagctgaaccagctgtccaagagcgagttcaacacctacaagcggtccggcatcatggaggtggaccgcagcgaggccaaggaggggctcaagcggggcgagacgaccaagcacgcggtgtcccgcgggaccgccaagctgcggtggttcgtcgagcgcaacctggtgaagcccgagggcaaggtgatcgacctgggctgcgggcggggcgggtggagctactactgcgccggcctcaagaaggtcaccgaggtgaaggggtacacgaagggcggccccgggcacgaggagcccatcccgatggccacctacggctggaacctggtgaagctgcactccgggaaggacgtcttcttcatcccgcccgagaagtgcgacaccctcctgtgcgacatcggcgagagctcccccaacccgaccatcgaggaggggcgcacgctgcgggtgctcaagatggtggagccctggctgcgcggcaaccagttctgcatcaagatcctgaacccctacatgcccagcgtcgtggagaccctcgagcagatgcagcggaagcacggcgggatgctggtgcgcaacccgctgtcccggaacagcacccacgagatgtactgggtctcctgcggcaccgggaacatcgtgagcgccgtgaacatgacctcccgcatgctcctgaaccgcttcacgatggcgcaccggaagcccacctacgagcgcgacgtcgacctgggcaccggcacccggcacgtggccgtggagcccgaggtcgccaacctcgacatcatcgggcagcgcatcgagaacatcaagcacgagcacaagagcacgtggcactacgacgaggacaacccctacaagacctgggcctaccacggctcctacgaggtgaagccgagcgggtccgccagcagcatggtcaacggcgtggtgaagctgctgaccaagccctgggacgtcatccccatggtgacccagatcgcgatgacggacaccacccccttcgggcagcagcgggtgttcaaggagaaggtcgacacccgcacgccgaaggccaagcggggcaccgcccagatcatggaggtgaccgcccgctggctctggggcttcctgtcccggaacaagaagccccgcatctgcacccgggaggagttcacgcgcaaggtgcggagcaacgccgcgatcggggccgtcttcgtggacgagaaccagtggaactccgccaaggaggccgtggaggacgagcgcttctgggacctggtccaccgggagcgcgagctccacaagcagggcaagtgcgcgacctgcgtgtacaacatgatggggaagcgggagaagaagctgggcgagttcgggaaggccaagggcagccgcgccatctggtacatgtggctgggcgcccggttcctcgagttcgaggccctggggttcatgaacgaggaccactggttctcccgcgagaacagcctgtccggcgtggagggggagggcctccacaagctggggtacatcctgcgggacatcagcaagatccccggcggcaacatgtacgcggacgacaccgccgggtgggacacccgcatcacggaggacgacctccagaacgaggccaagatcaccgacatcatggagccggagcacgccctgctggccaaggcgatcttcaagctcacctaccagaacaaggtcgtgcgcgtgcagcggcccgccaagaacggcaccgtcatggacgtgatctcccgccgggaccagcgcgggagcggccaggtgggcacgtacgggctgaacaccttcaccaacatggaggcccagctgatccggcagatggagtccgagggcatcttcagcccctccgagctcgagacccccaacctggccgagcgcgccctggactggctcgagaagtacggggtcgagcggctgaagcgcatggcgatcagcggcgacgactgcgtggtgaagccgatcgacgaccggttcgccacggccctgaccgccctcaacgacatggggaaggtccgcaaggacatcccccagtgggagccctccaagggctggaacgactggcagcaggtccccttctgcagccaccacttccaccagctgatcatgaaggacggccgggagatcgtggtcccgtgccgcaaccaggacgagctggtggggcgggcccgcgtgtcccagggcgcggggtggagcctccgggagaccgcctgcctgggcaagagctacgcccagatgtggcagctgatgtacttccaccgccgggacctccgcctggccgcgaacgccatctgctccgccgtccccgtggactgggtgcccaccagccggacgacctggtccatccacgcccaccaccagtggatgaccaccgaggacatgctgagcgtctggaaccgcgtgtggatcgaggagaacccctggatggaggacaagacgcacatctccagctgggaggacgtgccgtacctcgggaagcgcgaggaccagtggtgcggctccctgatcggcctgaccgcccgggcgacctgggccaccaacatccaggtcgccatcaaccaggtgcgccggctcatcgggaacgagaactacctggactacatgaccagcatgaagcgcttcaagaacgagacggaccccgagggcgccctgtggtga

SEQ ID NO: 8362 - RNA, 9879 nt, synthetic construct
  misc_feature 1..9879: note = derived and/or modified CDS sequence (opt1) from DENV-1__FJ432735__SS-prME
  source 1..9879: mol_type = other RNA
agcgtgaccatgctgctcatgctgatgcccaccgccctggccttccacctcacgacccgcggcggggagccccacatgatcgtgagcaagcaggagcggggcaagagcctgctgttcaagaccagcgcgggggtgaacatgtgcaccctcatcgccatggacctgggggagttctgcgaggacacgatgacctacaagtgcccccgcatcaccgaggccgagcccgacgacgtggactgctggtgcaacgccaccgacacgtgggtgacctacgggacctgcagccagaccggggagcaccggcgcgacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagaccgtccagtacgagaacctgaagtacagcgtgatcgtgaccgtccacacgggcgaccagcaccaggtggggaacgagtccaccgagcacggcaccaccgcgaccatcacgccccaggcccccagcaccgagatccagctgaccgactacggggccctcaccctggactgcagcccccggacgggcctggacttcaacgagatggtcctcctgaccatgaaggagaagtcctggctggtgcacaagcagtggttcctcgacctgccgctgccctggaccagcggggcctccaccagccaggagacgtggaaccggaaggacctcctggtgaccttcaagaccgcccacgcgaagaagcaggaggtcgtggtgctgggctcccaggagggcgccatgcacaccgccctcacgggggccaccgagatccagaccagcggcaccacgaccatcttcgccgggcacctgaagtgccgcctgaagatggacaagctcaccctgaagggcatgtcctacgtcatgtgcaccgggagcttcaagctggagaaggaggtggcggagacgcagcacggcaccgtgctcgtccagatcaagtacgagggcaccgacgccccctgcaagatccccttctccacccaggacgagaagggggtgacgcagaacggccggctgatcaccgccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacacggcctgggacttcgggagcatcggcggcgtgttcacctccgtcgggaagctggtgcaccagatcttcggcaccgcctacggggtgctgttcagcggcgtctcctggaccatgaagatcgggatcggcgtgctcctgacgtggctgggcctcaacagccgctccaccagcctgtccatgacctgcatcgccgtggggctggtcaccctctacctgggcgtgatggtgcaggccgacagcgggtgcgtcatcaactggaagggccgggagctgaagtgcgggagcggcatcttcgtgacgaacgaggtgcacacctggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagttcaccgtggtggtcggggacgtggcgggcatcctggcccaggggaagaagatgatccggccccagcccatggagtacaagtactcctggaagtcctggggcaaggccaagatcatcggcgccgacgtgcagaacacgaccttcatcatcgacgggcccaacaccccggagtgccccgacgaccagcgcgcgtggaacatctgggaggtcgaggactacggcttcgggatcttcaccacgaacatctggctcaagctgcgggactcctacacccaggtgtgcgaccaccgcctgatgagcgccgccatcaaggactccaaggccgtgcacgccgacatgggctactggatcgagagcgagaagaacgagacctggaagctcgcgcgggcctccttcatcgaggtcaagacctgcatctggcccaagagccacacgctgtggtccaacggcgtgctggagagcgagatgatcatccccaagatctacgggggcccgatctcccagcacaactaccgccccgggtacttcacccagaccgccggcccctggcacctcgggaagctggagctggacttcgacctctgcgagggcaccacggtggtcgtggacgagcactgcggcaaccgggggccgagcctgcgcaccaccaccgtgacgggcaagatcatccacgagtggtgctgccggtcctgcaccctgccgcccctgcgcttcaagggggaggacggctgctggtacgggatggagatccggcccgtcaaggagaaggaggagaacctggtcaagagcatggtgagcgccggctccggcgaggtcgacagcttctccctggggctcctgtgcatcagcatcatgatcgaggaggtgatgcgctcccggtggagccgcaagatgctgatgaccggcaccctcgccgtgttcttcctgctgatcatggggcagctcacgtggaacgacctgatccggctgtgcatcatggtcggcgcgaacgcctccgaccgcatggggatgggcaccacctacctcgccctgatggccaccttcaagatgcgcccgatgttcgccgtgggcctcctgttccggcgcctgacgagccgggaggtgctgctcctgaccatcgggctgtccctcgtcgcgagcgtggagctgcccaactccctggaggagctcggcgacgggctggccatgggcatcatgatcctgaagctcctgaccgacttccagagccaccagctgtgggccaccctcctgtccctgacgttcatcaagaccaccttcagcctccactacgcctggaagaccatggcgatggtcctgtccatcgtgagcctgttccccctctgcctgtccacgaccagccagaagaccacctggctgcccgtgctcctgggctccctggggtgcaagccgctcacgatgttcctgatcgccgagaacaagatctggggccgcaagagctggcccctgaacgaggggatcatggccgtcggcatcgtgagcatcctcctgtccagcctgctcaagaacgacgtgcccctggccgggcccctgatcgccggcggcatgctcatcgcgtgctacgtcatctccgggagctccgccgacctgagcctggagaaggccgccgaggtgtcctgggaggaggaggccgagcacagcggcgcgtcccacaacatcctcgtggaggtccaggacgacgggaccatgaagatcaaggacgaggagcgggacgacaccctgaccatcctgctcaaggccaccctgctggccgtgagcggcgtgtacccgctctccatccccgccacgctgttcgtctggtacttctggcagaagaagaagcagcgcagcggggtgctgtgggacacccccagcccgcccgaggtggagcgggccgtcctcgacgacggcatctaccgcatcatgcagcggggcctgctggggcgcagccaggtgggcgtgggggtcttccaggagaacgtgttccacaccatgtggcacgtgacccggggcgcggtcctgatgtaccaggggaagcgcctcgagccctcctgggccagcgtgaagaaggacctgatctcctacggcggcgggtggcggctgcagggcagctggaacacgggggaggaggtgcaggtcatcgccgtggagcccggcaagaaccccaagaacgtgcagaccgcccccgggaccttcaagacctccgagggcgaggtcggcgccatcgcgctcgacttcaagcccgggacgagcggcagccccatcgtgaaccgcgaggggaagatcgtgggcctgtacggcaacggggtcgtgaccacctccggcacctacgtgagcgccatcgcccaggccaaggcgtcccaggaggggcccctgccggagatcgaggacgaggtcttccggaagcgcaacctcacgatcatggacctgcaccccggcagcgggaagacccggcgctacctgcccgccatcgtgcgggaggccatcaagcgcaagctccggaccctgatcctggccccgacccgcgtggtcgcctccgagatggcggaggccctcaagggcatgcccatccgctaccagacgaccgccgtcaagagcgagcacaccggcaaggagatcgtggacctgatgtgccacgccaccttcacgatgcggctgctctcccccgtccgcgtgcccaactacaacatgatcatcatggacgaggcccacttcaccgacccgagctccatcgcggcccgggggtacatcagcacccgcgtgggcatgggggaggccgccgccatcttcatgaccgcgacgccgcccggctccgtcgaggccttcccccagagcaacgccgtgatccaggacgaggagcgggacatcccggagcgctcctggaacagcgggtacgagtggatcaccgacttccccggcaagaccgtgtggttcgtcccctccatcaagagcggcaacgacatcgccaactgcctgcggaagaacgggaagcgcgtgatccagctgtcccggaagaccttcgacacggagtaccagaagaccaagaacaacgactgggactacgtggtcaccaccgacatcagcgagatgggcgcgaacttccgcgccgaccgggtgatcgacccccgccggtgcctcaagccggtgatcctgaaggacgggcccgagcgcgtcatcctggccggccccatgcccgtgacggtcgcctccgccgcgcagcggcgcgggcggatcggccgcaaccacaacaaggagggcgaccagtacatctacatggggcagccgctcaacaacgacgaggaccacgcccactggaccgaggccaagatgctgctggacaacatcaacacccccgagggcatcatccccgccctcttcgagcccgagcgggagaagtccgccgcgatcgacggggagtaccgcctgcgcggcgaggcccggaagaccttcgtggagctgatgcgccgcggggacctcccggtgtggctgagctacaaggtcgcctccgagggcttccagtacagcgaccgccggtggtgcttcgacggcgagcgcaacaaccaggtgctggaggagaacatggacgtggagatctggacgaaggagggggagcggaagaagctccgcccccggtggctggacgcccgcacctactccgaccccctggccctccgggagttcaaggagttcgcggccggccgccggagcgtctccggggacctgatcctggagatcggcaagctcccccagcacctgacccagaaggcccagaacgccctggacaacctcgtgatgctgcacaacagcgagcagggcgggcgcgcgtaccggcacgccatggaggagctgccggacaccatcgagacgctcatgctgctggccctcatcgccgtgctgaccggcggggtcaccctgttcttcctctccggccgcgggctgggcaagaccagcatcggcctgctctgcgtgatggcctccagcgtgctgctgtggatggcgtccgtcgagccccactggatcgccgccagcatcatcctcgagttcttcctgatggtgctgctcatccccgagcccgaccggcagcgcaccccgcaggacaaccagctggcctacgtggtcatcgggctcctcttcatgatcctgacggtggccgcgaacgagatgggcctgctcgagaccaccaagaaggacctggggatcggccacgtggccgtcgagaaccaccaccacgccgccatgctggacgtggacctccaccccgcctccgcgtggaccctgtacgccgtggccacgaccatcatcacccccatgatgcggcacaccatcgagaacacgaccgccaacatcagcctgaccgccatcgcgaaccaggccgccatcctcatggggctggacaagggctggccgatctccaagatggacatcggcgtccccctgctcgccctggggtgctacagccaggtgaaccccctgaccctcacggcggccgtgctgatgctggtcgcccactacgccatcatcggccccgggctccaggccaaggcgacccgcgaggcccagaagcggaccgccgccggcatcatgaagaacccgaccgtggacgggatcgtggccatcgacctggaccccgtcgtgtacgacgcgaagttcgagaagcagctgggccagatcatgctcctgatcctgtgcacgtcccagatcctcctgatgcgcaccacctgggccctgtgcgagagcatcaccctcgccacgggccccctgaccaccctgtgggaggggtcccccggcaagttctggaacaccacgatcgccgtgagcatggccaacatcttccgcgggagctacctcgcgggcgccggcctggccttctccctgatgaagtccctcgggggcgggcggcgcggcaccggggcccagggcgagaccctgggcgagaagtggaagcggcagctgaaccagctctccaagagcgagttcaacacctacaagcgctccgggatcatggaggtcgaccggagcgaggcgaaggagggcctgaagcgcggggagacgaccaagcacgccgtgtcccggggcaccgccaagctgcgctggttcgtggagcggaacctcgtcaagccggaggggaaggtgatcgacctgggctgcggccgcgggggctggagctactactgcgccgggctgaagaaggtgaccgaggtcaagggctacacgaagggcgggcccggccacgaggagcccatccccatggccacctacgggtggaacctggtgaagctccactccggcaaggacgtgttcttcatcccgcccgagaagtgcgacaccctgctgtgcgacatcggggagagctcccccaaccccaccatcgaggagggccggacgctccgcgtcctgaagatggtggagccgtggctgcgggggaaccagttctgcatcaagatcctcaacccctacatgcccagcgtggtcgagaccctggagcagatgcagcgcaagcacggcggcatgctggtgcggaaccccctctcccgcaacagcacccacgagatgtactgggtgtcctgcgggaccggcaacatcgtcagcgcggtgaacatgacctcccggatgctgctgaaccgcttcacgatggcccaccggaagccgacctacgagcgcgacgtggacctcggggccggcacccgccacgtcgccgtggagcccgaggtggccaacctggacatcatcggccagcggatcgagaacatcaagcacgagcacaagagcacctggcactacgacgaggacaacccctacaagacgtgggcgtaccacgggtcctacgaggtcaagcccagcggcagcgcctccagcatggtgaacggggtcgtgaagctgctcaccaagccgtgggacgtgatccccatggtcacccagatcgccatgaccgacacgacccccttcggccagcagcgcgtgttcaaggagaaggtggacacccggacccccaaggccaagcgcgggacggcccagatcatggaggtcaccgcgaagtggctgtggggcttcctgtcccggaacaagaagccgcgcatctgcacccgggaggagttcacccgcaaggtgcggagcaacgccgccatcggcgccgtgttcgtcgacgagaaccagtggaactccgcgaaggaggccgtggaggacgagcgcttctgggacctcgtgcaccgggagcgcgagctgcacaagcaggggaagtgcgccacgtgcgtctacaacatgatgggcaagcgggagaagaagctgggggagttcggcaaggccaaggggagccgcgccatctggtacatgtggctcggcgcgcggttcctggagttcgaggccctgggcttcatgaacgaggaccactggttctcccgcgagaacagcctctccggggtggagggcgaggggctgcacaagctgggctacatcctccgggacatcagcaagatccccgggggcaacatgtacgccgacgacaccgccggctgggacacccgcatcaccgaggacgacctgcagaacgaggccaagatcacggacatcatggagcccgagcacgcgctgctcgccaagtccatcttcaagctgacctaccagaacaaggtggtccgggtgcagcgcccggccaagaacgggaccgtgatggacgtcatcagccggcgcgaccagcgcggctccggccaggtgggcacctacggcctgaacacgttcaccaacatggaggcccagctcatccggcagatggagagcgaggggatcttctcccccagcgagctggagacccccaacctggccggccgcgtgctcgactggctggagaagcacggggtcgagcggctgaagcgcatggcgatctccggcgacgactgcgtggtgaagcccatcgacgaccggttcgccaccgccctcacggccctgaacgacatggggaaggtccgcaaggacatcccgcagtgggagcccagcaagggctggaacgactggcagcaggtccccttctgcagccaccacttccaccagctgatcatgaaggacggccgggagatcgtggtcccctgccgcaaccaggacgagctcgtggggcgggcccgcgtgtcccagggcgcggggtggagcctgcgggagaccgcctgcctgggcaagtcctacgcccagatgtggcagctcatgtacttccaccgccgggacctgcgcctggccgcgaacgccatctgcagcgccgtcccggtggactgggtgcccacctcccggaccacgtggagcatccacgcccaccaccagtggatgaccaccgaggacatgctctccgtctggaaccgcgtgtggatcgaggagaacccctggatggaggacaagacccacatcagctcctggggcgacgtgccctacctgggcaagcgggaggaccagtggtgcggcagcctgatcgggctcacggcccgcgcgacctgggccaccaacatccaggtcgccatcaaccaggtgcggcgcctgatcggcaacgagaactacctggactacatgacctccatgaagcgcttcaagaacgagagcgacccggagggggccctctggtga

SEQ ID NO: 8363 - RNA, 9879 nt, synthetic construct
  misc_feature 1..9879: note = derived and/or modified CDS sequence (opt1) from DENV-1__FJ432736__SS-prME
  source 1..9879: mol_type = other RNA
agcgtgaccatgctgctcatgctgatgcccaccgccctggccttccacctcaccacccgcggcggggagccgcacatgatcgtgagcaagcaggagcggggcaagagcctgctgttcaagacctccgcgggggtgaacatgtgcaccctcatcgccatggacctgggcgagctgtgcgaggacaccatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtggagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgccccacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgccgctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctgatccaccagatcttcggcaccgcctacggggtcctgttctccggcgtgagctggaccatgaagatcgggatcggcgtcctgctgacgtggctcggcctgaactcccgcagcacctccctgagcatgacctgcatcgccgtggggctcgtgaccctgtacctgggcgtcatggtgcaggccgactccgggtgcgtgatcaactggaagggccgggagctcaagtgcgggagcggcatcttcgtcacgaacgaggtgcacacctggaccgagcagtacaagttccaggcggacagcccgaagcgcctgtccgccgccatcggcaaggcctgggaggagggggtgtgcggcatccggagcgccacccgcctggagaacatcatgtggaagcagatctccaacgagctcaaccacatcctgctggagaacgacatgaagctcaccgtcgtggtgggggacgtcgcgggcatcctggggcagggcaagaagatgatccggccccagcccatggagtacaagtacagctggaagtcctggggcaaggccaagatcatcggggccgacgcccagaacacgaccttcatcatcgacggccccaacaccccggagtgccccgacgaccagcgcgcgtggaacatctgggaggtggaggactacgggttcggcatcttcaccacgaacatctggctgaagctccgggacagctacacccaggtgtgcgaccaccgcctgatgtccgccgccatcaaggacagcaaggccgtccacgccgacatgggctactggatcgagtccgagaagaacgagacctggaagctggcgcgggccagcttcatcgaggtgaagacctgcatctggcccaagtcccacacgctctggagcaacggggtgctggagtccgagatgatcatccccaagatctacggcgggccgatcagccagcacaactaccgccccggctacctgacccagaccgccgggccctggcacctcggcaagctggagctggacttcgacctctgcgagggcaccacggtcgtggtggacgagcactgcgggaaccggggcccgtccctgcgcaccaccaccgtcacggggaagatcatccacgagtggtgctgccggagctgcaccctgccgcccctgcgcttccggggcgaggacgggtgctggtacggcatggagatccgccccgtgaaggagaaggaggagaacctggtgaagtccatggtcagcgccggcccgggggaggtggacagcttctccctgggcctcctgtgcatcagcatcatgatcgaggaggtgatgcggtcccgctggagccggaagatgctgatgaccgggaccctcgccgtcttcttcctgctgatcatgggccagctcacgtggaacgacctgatccgcctgtgcatcatggtgggggcgaacgccttcgaccgcatgggcatgggcaccacctacctcgccctgatggccaccttcaagatgcggcccatgttcgccgtggggctcctcttccgccggctgacgtcccgcgaggtcctgctcctgaccatcggcctgagcctcgtggcgtccgtggagctgcccaacagcctggaggagctcggggacggcctggccatgggcatcatgatcctgaagctcctgaccgacttccagtcccaccagctgtgggccaccctcctgagcctgacgttcatcaagaccaccttctccctccactacgcctggaagaccatggcgatggtcctgagcatcgtgtccctgttccccctctgcctgagcacgacctcccagaagaccacctggctgccggtcctcctggggagcctgggctgcaagcccctcacgatgttcctgatcgccgagaacaagatctgggggcggaagtcctggcccctgaacgagggcatcatggccgtggggatcgtgagcatcctcctgtccagcctgctcaagaacgacgtccccctggccggcccgctgatcgccggcgggatgctcatcgcgtgctacgtgatcagcggctccagcgccgacctgtccctggagaaggccgccgaggtgagctgggaggaggaggccgagcactccggggcgagccacaacatcctcgtcgaggtgcaggacgacggcaccatgaagatcaaggacgaggagcgcgacgacaccctgaccatcctgctcaaggccaccctgctggccgtgtccggggtctaccccctcagcatccccgccacgctgttcgtgtggtacttctggcagaagaagaagcagcggtccggcgtgctgtgggacacccccagcccgcccgaggtcgagcgcgccgtgctggacgacggcatctaccggatcatgcagcgcgggctcctgggccggtcccaggtgggggtcggcgtgttccaggagaacgtgttccacaccatgtggcacgtcacccgcggggcggtgctgatgtaccagggcaagcggctcgagcccagctgggcctccgtgaagaaggacctgatcagctacggcgggggctggcgcctgcgggggtcctggaacacgggcgaggaggtccaggtgatcgccgtggagcccgggaagaacccgaagaacgtccagaccgcccccggcaccttcaagacccccgagggcgaggtgggggccatcgcgctcgacttcaagcccggcacgagcgggtccccgatcgtgaaccgcgagggcaagatcgtcggcctgtacgggaacggcgtggtgaccaccagcgggatctacgtctccgccatcgcccaggccaaggcgagccaggagggccccctgcccgagatcgaggacgaggtgttccggaagcgcaacctcaccatcatggacctgcacccggggagcggcaagacgcggcgctacctgcccgccatcgtgcgggaggccatcaagcgcaagctccgcaccctgatcctggcccccacccgggtcgtggcctccgagatggcggaggccctcaagggcatgcccatccgctaccagaccacggccgtcaagagcgagcacaccgggaaggagatcgtcgacctgatgtgccacgccaccttcaccatgcggctgctctccccggtgcgcgtgcccaactacaacatgatcatcatggacgaggcccacttcacggaccccagctccatcgcggcccggggctacatcagcacccgcgtcgggatgggcgaggccgccgccatcttcatgaccgcgacgccgcccgggtccgtggaggccttcccccagagcaacgccgtgatccaggacgaggagcgggacatccccgagcgctcctggaacagcggccacgagtggatcacggacttccccggcaagaccgtctggttcgtgccctccatcaagagcgggaacgacatcgccaactgcctgcggaagaacggcaagcgcgtgatccagctgtcccggaagaccttcgacaccgagtaccagaagacgaagaacaacgactgggactacgtcgtgaccaccgacatcagcgagatgggggcgaacttccgcgccgaccgggtgatcgacccccgccggtgcctcaagcccgtcatcctgaaggacggccccgagcgcgtgatcctggccgggccgatgcccgtgaccgtcgcctccgccgcgcagcggcgcggccggatcggccgcaaccacaacaaggagggggaccagtacatctacatgggccagcccctcaacaacgacgaggaccacgcccactggacggaggccaagatgctgctggacaacatcaacacccccgaggggatcatcccggccctcttcgagcccgagcgcgagaagtccgccgcggtggacggcgagtaccggctgcgcggggaggcccggaagaccttcgtcgagctgatgcgccggggcgacctccccgtgtggctgtcctacaaggtggccagcgagggcttccagtactccgaccgccggtggtgcttcgacggggagcgcaacaaccaggtcctggaggagaacatggacgtggagatctggaccaaggagggcgagcggaagaagctccgcccccggtggctggacgcccgcacgtacagcgacccgctggccctccgggagttcaaggagttcgcggccgggcgccggagcgtgtccggcgacctgatcctggagatcggcaagctcccccagcacctgacccagcgcgcccagaacgccctggacaacctcgtcatgctgcacaacagcgagcagggcgggcgggcgtaccgccacgccatggaggagctgcccgacaccatcgagaccctcatgctgctggccctcatcgccgtgctgaccgggggcgtgaccctgttcttcctctccgggcggggcctgggcaagaccagcatcgggctgctctgcgtcatggcctccagcgtgctgctgtggatggcgtccgtggagccccactggatcgccgccagcatcatcctcgagttcttcctgatggtcctgctcatcccggagcccgaccgccagcggacgccccaggacaaccagctggcctacgtggtgatcggcctcctcttcatgatcctgaccgtcgccgcgaacgagatggggctgctcgagacgaccaagaaggacctgggcatcgggcacgtggccgtggagaaccaccaccacgccgccatgctggacgtcgacctccacccggcctccgcgtggaccctgtacgccgtggccaccacgatcatcacccccatgatgcgccacaccatcgagaacaccacggccaacatcagcctgaccgccatcgcgaaccaggccgccatcctcatgggcctggacaagggctggcccatctccaagatggacatcggggtgcccctgctcgccctgggctgctacagccaggtcaacccgctgaccctcaccgcggccgtgctgatgctggtggcccactacgccatcatcgggcccggcctccaggccaaggcgacgcgcgaggcccagaagcggaccgccgccgggatcatgaagaaccccaccgtcgacggcatcgtggccatcgacctggaccccgtggtctacgacgcgaagttcgagaagcagctgggccagatcatgctcctgatcctgtgcacctcccagatcctcctgatgcgcacgacctgggccctgtgcgagagcatcaccctcgccaccgggccgctgacgaccctgtgggagggctcccccgggaagttctggaacaccaccatcgccgtgagcatggccaacatcttccggggctcctacctcgcgggcgccgggctggccttcagcctgatgaagtccctcggcgggggccgccgggggacgggcgcccagggcgagaccctgggggagaagtggaagcgccagctgaaccagctcagcaagagcgagttcaacacctacaagcggtccggcatcatggaggtggaccgcagcgaggcgaaggaggggctgaagcggggcgagaccacgaagcacgccgtctcccgcgggaccgccaagctgcggtggttcgtggagcgcaacctggtgaagcccgagggcaaggtcatcgacctcggctgcgggcggggcgggtggagctactactgcgccggcctgaagaaggtgaccgaggtgaaggggtacaccaagggcggccccgggcacgaggagccgatccccatggccacgtacggctggaacctggtcaagctccactccgggaaggacgtgttcttcatcccgcccgagaagtgcgacaccctgctgtgcgacatcggcgagagctccccgaaccccaccatcgaggaggggcgcaccctccgggtgctgaagatggtcgagccctggctgcgcggcaaccagttctgcatcaagatcctcaacccctacatgccgagcgtggtggagacgctggagcagatgcagcggaagcacggcgggatgctggtccgcaaccccctctcccggaacagcacccacgagatgtactgggtgtcctgcggcaccgggaacatcgtgagcgcggtcaacatgacctcccgcatgctgctgaaccgcttcaccatggcccaccggaagcccacgtacgagcgcgacgtggacctcggcaccggcacccggcacgtggccgtcgagcccgaggtggccaacctggacatcatcgggcagcgcatcgagaacatcaagcacgagcacaagagcacctggcactacgacgaggacaacccgtacaagacgtgggcctaccacggctcctacgaggtgaagcccagcgggtccgcgagctccatggtcaacggcgtggtcaagctgctcaccaagccctgggacgtgatccccatggtgacccagatcgccatgaccgacacgaccccgttcgggcagcagcgggtcttcaaggagaaggtggacacccgcacccccaaggccaagcggggcacggcccagatcatggaggtgaccgcccgctggctgtggggcttcctgagccggaacaagaagccccgcatctgcacccgggaggagttcacccgcaaggtccggagcaacgcggccatcggggccgtgttcgtggacgagaaccagtggaactccgccaaggaggcggtcgaggacgagcgcttctgggacctcgtgcaccgggagcgcgagctgcacaagcagggcaagtgcgccacgtgcgtgtacaacatgatggggaagcgggagaagaagctgggcgagttcgggaaggccaagggcagccgcgccatctggtacatgtggctcggcgcccggttcctggagttcgaggcgctggggttcatgaacgaggaccactggttctcccgcgagaacagcctctccggcgtcgagggggagggcctgcacaagctggggtacatcctccgggacatcagcaagatcccgggcggcaacatgtacgccgacgacaccgccgggtgggacacccgcatcaccgaggacgacctgcagaacgaggccaagatcacggacatcatggagcccgagcacgccctgctcgcgaaggccatcttcaagctgacctaccagaacaaggtggtgcgcgtccagcggcccgccaagaacggcaccgtgatggacgtgatctcccgccgggaccagcgcgggagcggccaggtcggcacctacgggctgaacacgttcaccaacatggaggcccagctcatccggcagatggagtccgagggcatcttcagcccctccgagctggagaccccgaacctggccgagcgcgcgctcgactggctggagaagtacggggtggagcggctgaagcgcatggccatcagcggcgacgactgcgtggtcaagcccatcgacgaccggttcgccaccgccctcacggccctgaacgacatggggaaggtgcgcaaggacatcccccagtgggagccctccaagggctggaacgactggcagcaggtcccgttctgcagccaccacttccaccagctgatcatgaaggacggccgggagatcgtcgtgccctgccgcaaccaggacgagctcgtggggcgggcgcgcgtctcccagggcgccgggtggagcctgcgggagaccgcctgcctgggcaagtcctacgcccagatgtggcagctcatgtacttccaccgccgggacctgcgcctggcggccaacgccatctgcagcgccgtgcccgtggactgggtccccaccagccggaccacgtggtccatccacgcccaccaccagtggatgaccaccgaggacatgctcagcgtgtggaaccgcgtgtggatcgaggagaacccgtggatggaggacaagacccacatctccagctgggaggacgtcccctacctggggaagcgcgaggaccagtggtgcggctccctgatcggcctcacggcgcgggccacctgggccaccaacatccaggtggccatcaaccaggtgcgccggctgatcgggaacgagaactacctggactacatgaccagcatgaagcgcttcaagaacgagtccgaccccgagggcgccctctggtga

SEQ ID NO: 8364 - RNA, 9879 nt, synthetic construct
  misc_feature 1..9879: note = derived and/or modified CDS sequence (opt1) from DENV-1__FJ410198__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgcgacaagcggtccgtggccctcgcgccccacgtgggcctggggctggagacccgcaccgagacctggatgagctccgagggcgcgtggaagcagatccagcgggtggagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtcgggaagctggtgcaccagatcttcggcaccgcctacggggtcctcttctccggcgtcagctggacgatgaagatcgggatcggcgtgctgctgacctggctcggcctgaactcccgcagcacctccctgagcatgacctgcatcgccgtggggctcgtcacgctgtacctgggcgtgatggtgcaggccgactccgggtgcgtcatcaactggaagggccgggagctcaagtgcgggagcggcatcttcgtgaccaacgaggtgcacacctggaccgagcagtacaagttccaggccgacagcccgaagcgcctgtccgcggccatcggcaaggcctgggaggagggggtctgcggcatccggagcgccacccgcctggagaacatcatgtggaagcagatctccaacgagctcaaccacatcctgctggagaacgacatgaagttcacggtggtggtcggggacgtggccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtcgaggactacggcttcgggatcttcacgaccaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacgtgcatctggcccaagtcccacaccctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcacgaccgtggtcgtggacgagcactgcggcaaccgggggccgtccctgcgcaccaccacggtgaccggcaagatcatccacgagtggtgctgccggagctgcaccctgccgcccctccgcttccgcggggaggacggctgctggtacgggatggagatccgccccgtcaaggagaaggaggagaacctggtgaagtccatggtgagcgccggcagcggcgaggtcgactccttcagcctcgggctgctgtgcatctccatcatgatcgaggaggtgatgcggagccgctggtcccggaagatgctcatgaccggcacgctggccgtgttcttcctgctcatcatggggcagctgacctggaacgacctgatccgcctctgcatcatggtcggcgccaacgcgagcgaccgcatggggatgggcaccacctacctggccctgatggccacgttcaagatgcggccgatgttcgccgtggggctcctgttccgccggctgacctcccgcgaggtgctcctgctgaccatcgggctcagcctggtcgcctccgtggagctgcccaacagcctcgaggagctgggcgacgggctggcgatgggcatcatgatcctcaagctgctgaccgacttccagtcccaccagctctgggccacgctgctgagcctcaccttcatcaagaccaccttctccctgcactacgcctggaagacgatggccatggtcctgagcatcgtgtccctcttccccctgtgcctgagcaccacctcccagaagaccacgtggctccccgtgctgctgggcagcctcgggtgcaagccgctgaccatgttcctgatcgcggagaacaagatctggggccggcgctcctggcccctcaacgaggggatcatggccgtcggcatcgtgagcatcctgctgagctccctcctgaagaacgacgtgcccctggccgggcccctcatcgccggcggcatgctgatcgcctgctacgtcatcagcgggtccagcgcggacctgtccctcgagaaggccgccgaggtgagctgggaggaggaggccgagcactccggcgccagccacaacatcctggtggaggtccaggacgacgggaccatgaagatcaaggacgaggagcgggacgacaccctgaccatcctcctgaaggcgacgctgctcgccgtgtccggcgtgtacccgctgagcatccccgccaccctgttcgtctggtacttctggcagaagaagaagcagcgctccggggtgctctgggacacccccagcccgcccgaggtgggccgggccgtcctggacgacggcatctaccgcatcatgcagcgggggctgctgggccgctcccaggtgggggtgggcgtcttccaggagaacgtgttccacaccatgtggcacgtgacgcgcggggccgtcctcatgtaccagggcaagcgcctggagcccagctgggcgtccgtgaagaaggacctgatcagctacggcgggggctggcggctccaggggtcctggaacaccggcgaggaggtgcaggtcatcgccgtggagcccgggaagaaccccaagaacgtgcagaccgcccccggcaccttcaagacgcccgagggcgaggtcggggccatcgccctggacttcaagcccggcaccagcgggtcccccatcgtgaaccgcgagggcaagatcgtgggcctgtacgggaacggcgtcgtgaccaccagcgggacgtacgtgagcgcgatcgcccaggccaaggcctcccaggagggcccgctccccgagatcgaggacgaggtcttccggaagcgcaacctgaccatcatggacctgcaccccgggagcggcaagacccggcgctacctcccggcgatcgtgcgggaggccatcaagcgcaagctgcgcaccctgatcctcgcccccacgcgggtggtcgcctccgagatggccgaggcgctgaagggcatgcccatccgctaccagaccaccgccgtcaagagcgagcacaccgggaaggagatcgtggacctgatgtgccacgccacgttcaccatgcggctcctgtcccccgtccgcgtgccgaactacaacatgatcatcatggacgaggcccacttcaccgaccccagctccatcgccgcgcggggctacatcagcacccgcgtggggatgggcgaggccgccgccatcttcatgacggccacgccgcccgggtccgtcgaggcgttcccgcagagcaacgccgtgatccaggacgaggagcgggacatccccgagcgctcctggaacagcggctacgagtggatcaccgacttccccggcaagaccgtgtggttcgtcccctccatcaagagcgggaacgacatcgccaactgcctgcggaagaacggcaagcgcgtgatccagctctcccggaagacgttcgacaccgagtaccagaagaccaagaacaacgactgggactacgtggtcaccacggacatcagcgagatgggggccaacttccgcgcggaccgggtgatcgacccgcgccggtgcctgaagcccgtgatcctgaaggacggccccgagcgcgtcatcctcgccgggcccatgccggtgaccgtcgcctccgccgcccagcggcgcggccggatcggccgcaaccacaacaaggagggggaccagtacatctacatgggccagcccctgaacaacgacgaggaccacgcgcactggaccgaggccaagatgctgctcgacaacatcaacacccccgaggggatcatccccgccctgttcgagccggagcgcgagaagtccgccgccatcgacggcgagtaccggctgcgcggggaggcgcggaagacgttcgtggagctcatgcgccggggcgacctgcccgtgtggctgtcctacaaggtcgccagcgagggcttccagtacagcgaccgccggtggtgcttcgacggggagcgcaacaaccaggtgctcgaggagaacatggacgtggagatctggaccaaggagggcgagcggaagaagctgcgcccccggtggctggacgcccgcacctactccgaccccctcgccctgcgggagttcaaggagttcgccgcggggcgccggagcgtctccggcgacctgatcctcgagatcggcaagctgccgcagcacctgacccagcgcgcccagaacgccctcgacaacctggtgatgctgcacaacagcgagcagggcgggcgggcctaccgccacgcgatggaggagctccccgacacgatcgagaccctgatgctgctcgccctgatcgccgtgctgaccgggggcgtcaccctcttcttcctgtccgggcggggcctgggcaagaccagcatcgggctcctgtgcgtgatggcctccagcgtgctgctctggatggcctccgtcgagccccactggatcgcggccagcatcatcctggagttcttcctgatggtgctcctgatccccgagccggaccgccagcggacgccccaggacaaccagctggcctacgtggtcatcggcctcctgttcatgatcctgaccgtggccgccaacgagatggggctcctggagaccaccaagaaggacctgggcatcgggcacgtggcggtcgagaaccaccaccacgccacgatgctcgacgtggacctgcaccccgcctccgcctggaccctgtacgccgtggcgaccaccatcatcacgccgatgatgcgccacaccatcgagaacaccaccgccaacatcagcctcacggccatcgccaaccaggccgcgatcctgatgggcctggacaagggctggcccatctccaagatggacatcggggtccccctcctggccctgggctgctacagccaggtgaaccccctcaccctgaccgccgccgtgctgatgctcgtcgcgcactacgccatcatcgggccgggcctgcaggccaaggccacccgcgaggcccagaagcggacggcggccgggatcatgaagaaccccaccgtggacggcatcgtggccatcgacctggaccccgtcgtgtacgacgccaagttcgagaagcagctcggccagatcatgctgctgatcctctgcacctcccagatcctgctgatgcgcaccacgtgggccctctgcgagagcatcaccctggcgaccgggcccctgaccacgctctgggagggctccccggggaagttctggaacaccaccatcgccgtgagcatggccaacatcttccggggctcctacctggccggcgccgggctggcgttcagcctcatgaagtccctgggcgggggccgccgggggaccggcgcccagggcgagacgctgggggagaagtggaagcgccagctcaaccagctgtccaagagcgagttcaacacctacaagcggtccggcatcatggaggtcgaccgcagcgaggccaaggaggggctgaagcggggcgagaccaccaagcacgccgtgtcccgcgggacggcgaagctccggtggttcgtggagcgcaacctggtcaagcccgagggcaaggtgatcgacctgggctgcgggcggggcgggtggagctactactgcgccggcctgaagaaggtgaccgaggtcaaggggtacaccaagggcggccccgggcacgaggagcccatcccgatggccacctacggctggaacctcgtgaagctgcactccgggaaggacgtgttcttcatcccgcccgagaagtgcgacacgctgctctgcgacatcggcgagagctcccccaacccgaccatcgaggaggggcgcaccctgcgggtcctgaagatggtggagccctggctccgcggcaaccagttctgcatcaagatcctgaacccctacatgcccagcgtggtcgagaccctggagcagatgcagcggaagcacggcgggatgctcgtgcgcaacccgctgtcccggaacagcacccacgagatgtactgggtgtcctgcggcacggggaacatcgtcagcgccgtgaacatgacctcccgcatgctgctcaaccgcttcaccatggcccaccggaagcccacctacgagcgcgacgtggacctgggcgcgggcacgcggcacgtcgccgtggagcccgaggtggccaacctggacatcatcgggcagcgcatcgagaacatcaagcacgagcacaagagcacctggcactacgacgaggacaacccctacaagacctgggcctaccacggctcctacgaggtcaagccgagcgggtccgccagcagcatggtgaacggcgtcgtgaagctcctgaccaagccctgggacgtgatccccatggtcacgcagatcgcgatgaccgacaccacccccttcgggcagcagcgggtgttcaaggagaaggtggacacgcgcaccccgaaggccaagcggggcaccgcccagatcatggaggtcaccgccaagtggctgtggggcttcctctcccgcaacaagaagccccggatctgcacgcgcgaggagttcacccggaaggtgcgcagcaacgccgcgatcggggccgtgttcgtcgacgagaaccagtggaactccgccaaggaggccgtggaggacgagcggttctgggacctggtgcaccgcgagcgggagctgcacaagcagggcaagtgcgcgacctgcgtctacaacatgatggggaagcgcgagaagaagctcggcgagttcgggaaggccaagggcagccgggccatctggtacatgtggctgggcgcccgcttcctggagttcgaggccctcgggttcatgaacgaggaccactggttctcccgggagaacagcctgtccggcgtggagggggagggcctgcacaagctcgggtacatcctgcgcgacatcagcaacatccccggcggcaacatgtacgcggacgacaccgccgggtgggacacgcggatcaccgaggacgacctgcagaacgaggcccgcatcaccgacatcatggagccggagcacgccctcctggccaagtccatcttcaagctgacctaccagaacaaggtggtccgcgtgcagcggcccgcgaagaacggcacggtgatggacgtcatcagccgccgggaccagcgcgggtccggccaggtgggcacctacgggctcaacaccttcaccaacatggaggcccagctgatccggcagatggagagcgagggcatcttctcccccagcgagctggagacgcccaacctcgccgagcgcgtgctggactggctggagaagtacggggtcgagcggctcaagcgcatggccatctccggcgacgactgcgtggtgaagccgatcgacgaccggttcgccaccgcgctgaccgccctgaacgacatggggaaggtccgcaaggacatcccccagtgggagcccagcaagggctggaacgactggcagcaggtccccttctgctcccaccacttccaccagctcatcatgaaggacggccgggagatcgtggtcccgtgccgcaaccaggacgagctggtggggcgggcccgcgtgagccagggcgccgggtggagcctgcgggagaccgcctgcctcggcaagtcctacgcgcagatgtggcagctgatgtacttccaccgccgggacctgcgcctcgccgccaacgccatctgcagcgcggtccccgtggactggatccccacgtcccggaccacctggagcatccacgcccaccaccagtggatgaccacggaggacatgctgtccgtgtggaaccgcgtctggatcgaggagaacccctggatggaggacaagacccacatcagctcctggggcgacgtgccgtacctgggcaagcgcgaggaccagtggtgcggcagcctcatcgggctgaccgcccgggccacctgggccaccaacatccaggtggcgatcaaccaggtccgccggctgatcggcaacgagaactacctcgactacatgacgtccatgaagcgcttcaagaacgagagcgaccccgagggggccctgtggtga

SEQ ID NO: 8365 - RNA, 9879 nt, synthetic construct
  misc_feature 1..9879: note = derived and/or modified CDS sequence (opt1) from DENV-1__FJ410199__SS-prME
  source 1..9879: mol_type = other RNA
agcgtgaccatgctgctcatgctgatgcccaccgccctggccttccacctcacgacccgcggcggggagccccacatgatcgtgagcaagcaggagcggggcaagagcctgctgttcaagaccagcgcgggggtgaacatgtgcaccctcatcgccatggacctgggcgagttctgcgaggacacgatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctggcgccccacgtgggcctcgggctggagacgcgcaccgagacctggatgagctccgagggcgcctggaagcagatccagcgggtcgagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagaccgtccagtacgagaacctgaagtacagcgtgatcgtgaccgtccacacgggcgaccagcaccaggtggggaacgagtccaccgagcacggcaccaccgcgaccatcacgccccaggcccccagcaccgagatccagctgaccgactacggggccctcaccctggactgcagcccccgcacgggcctggacttcaacgagatggtcctcctgaccatgaaggagaagtcctggctggtgcacaagcagtggttcctcgacctgccgctgccctggaccagcggggcctccaccagccaggagacgtggaaccggaaggacctcctggtgaccttcaagaccgcccacgcgaagaagcaggaggtcgtggtgctgggctcccaggagggcgccatgcacaccgccctcacgggggccaccgagatccagaccagcggcaccacgaccatcttcgccgggcacctgaagtgccgcctgaagatggacaagctcaccctgaagggcatgtcctacgtcatgtgcaccgggagcttcaagctggagaaggaggtggcggagacgcagcacggcaccgtgctcgtccagatcaagtacgagggcaccgacgccccctgcaagatccccttctccacccaggacgagaagggggtgacgcagaacggccggctgatcaccgccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacacggcctgggacttcgggagcatcggcggcgtgttcacctccgtcgggaagctggtgcaccagatcttcggcaccgcctacggggtgctgttcagcggcgtctcctggaccatgaagatcgggatcggcgtgctcctgacgtggctgggcctcaacagccgctccaccagcctgtccatgacctgcatcgccgtggggctggtcaccctctacctgggcgtgatggtgcaggccgacagcgggtgcgtcatcaactggaagggccgggagctgaagtgcgggagcggcatcttcgtgacgaacgaggtgcacacctggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagttcaccgtggtggtcggggacgtggcgggcatcctggcccaggggaagaagatgatccggccccagcccatggagtacaagtactcctggaagtcctggggcaaggccaagatcatcggcgccgacgtgcagaacacgaccttcatcatcgacgggcccaacaccccggagtgccccgacgaccagcgcgcgtggaacatctgggaggtcgaggactacggcttcgggatcttcaccacgaacatctggctcaagctgcgggactcctacacccaggtgtgcgaccaccgcctgatgagcgccgccatcaaggactccaaggccgtgcacgccgacatgggctactggatcgagagcgagaagaacgagacctggaagctcgcgcgggcctccttcatcgaggtcaagacctgcatctggcccaagagccacacgctgtggtccaacggcgtgctggagagcgagatgatcatccccaagaactacgggggcccgatctcccagcacaactaccgccccgggtacttcacccagaccgccggcccctggcacctcgggaagctggagctggacttcgacctctgcgagggcaccacggtggtcgtggacgagcactgcggcaaccgggggccgagcctgcgcaccaccaccgtgacgggcaagatcatccacgagtggtgctgccggtcctgcaccctgccgcccctgcgcttcaagggggaggacggctgctggtacgggatggagatccggcccgtcaaggagaaggaggagaacctggtcaagagcatggtgagcgccggctccggcgaggtcgacagcttctccctggggctcctgtgcatcagcatcatgatcgaggaggtgatgcgctcccggtggagccgcaagatgctgatgaccggcaccctcgccgtgctgttcctgctcatcatggggcagctgacgtggtccgacctgatccggctctgcatcatggtcggcgcgaacgccagcgaccgcatggggatgggcaccacctacctggccctgatggccaccttcaagatgcgcccgatgttcgccgtggggctcctgttccggcgcctgacgtcccgggaggtgctcctgctgaccatcgggctcagcctggtcgcgtccgtggagctgcccaacagcctcgaggagctgggcgacgggctggccatgggcatcatgatcctcaagctgctgaccgacttccagtcccaccagctctgggccaccctgctgagcctcacgttcatcaagaccaccttctccctgcactacgcctggaagaccatggcgatggtcctgagcatcgtgtccctcttccccctgtgcctgagcacgacctcccagaagaccacctggctccccgtgctgctgggcagcctcgggtgcaagccgctgacgatgttcctgatcgccgagaacaagatctggggccgcaagagctggcccctcaacgaggggatcatggccgtcggcatcgtgtccatcctgctgagctccctcctgaagaacgacgtgcccctggccgggcccctcatcgccggcggcatgctgatcgcgtgctacgtcatcagcgggtccagcgccgacctgtccctcgagaaggccgccgaggtgagctgggaggaggaggccgagcactccggcgcgagccacaacatcctggtggaggtccaggacgacgggaccatgaagatcaaggacgaggagcgggacgacaccctgaccatcctcctgaaggccaccctgctcgccgtgtccggcgtgtacccgctgagcatccccgccacgctgttcgtctggtacttctggcagaagaagaagcagcgctccggggtgctctgggacacccccagcccgcccgaggtggagcgggccgtcctggacgacggcatctaccgcatcatgcagcggggcctgctggggcgctcccaggtgggcgtgggggtcttccaggagaacgtgttccacaccatgtggcacgtgacccggggcgcggtcctcatgtaccaggggaagcgcctggagcccagctgggcctccgtgaagaaggacctgatcagctacggcggcgggtggcggctccagggctcctggaacacgggggaggaggtgcaggtcatcgccgtggagcccggcaagaaccccaagaacgtgcagaccgcccccgggaccttcaagaccagcgagggcgaggtcggcgccatcgcgctggacttcaagcccgggacgagcggctcccccatcgtgaaccgcgaggggaagatcgtgggcctgtacggcaacggggtcgtgaccaccagcggcacctacgtgtccgccatcgcccaggccaaggcgagccaggaggggcccctcccggagatcgaggacgaggtcttccggaagcgcaacctgacgatcatggacctgcaccccggctccgggaagacccggaagtacctccccgccatcgtgcgcgaggccatcaagcggaagctgcgcaccctgatcctcgccccgacccgggtggtcgccagcgagatggcggaggccctgaagggcatgcccatccgctaccagacgaccgccgtgaagtccgagcacaccggcaaggagatcgtggacctgatgtgccacgccaccttcacgatgcgcctcctgagccccgtccgggtgcccaactacaacatgatcatcatggacgaggcccacttcaccgacccgtccagcatcgcggcccgcgggtacatctccacccgggtgggcatgggggaggccgccgccatcttcatgaccgcgacgccgcccggcagcgtcgaggccttcccccagtccaacgccgtgatccaggacgaggagcgcgacatcccggagcggagctggaactccgggtacgagtggatcaccgacttccccggcaagaccgtgtggttcgtccccagcatcaagtccggcaacgacatcgccaactgcctgcgcaagaacgggaagcgggtgatccagctcagccgcaagaccttcgacacggagtaccagaagaccaagaacaacgactgggactacgtggtcaccaccgacatctccgagatgggcgcgaacttccgggccgaccgcgtgatcgacccccggcgctgcctgaagccggtgatcctgaaggacgggcccgagcgggtcatcctcgccggccccatgcccgtgacggtcgccagcgccgcgcagcgccgggggcgcatcggccggaaccacaacaaggagggcgaccagtacatctacatggggcagccgctgaacaacgacgaggaccacgcccactggaccgaggccaagatgctgctcgacaacatcaacacccccgagggcatcatccccgccctgttcgagcccgagcgcgagaagtccgccgcgatcgacggggagtaccggctgcgcggcgaggcccgcaagaccttcgtggagctcatgcggcgcggggacctgccggtgtggctgtcctacaaggtcgccagcgagggcttccagtactccgaccggcgctggtgcttcgacggcgagcggaacaaccaggtgctcgaggagaacatggacgtggagatctggacgaaggagggggagcgcaagaagctgcggccccgctggctggacgcccggacctacagcgaccccctcgccctgcgcgagttcaaggagttcgcggccggccggcgctccgtcagcggggacctgatcctcgagatcggcaagctgccccagcacctgacccagcgggcccagaacgccctcgacaacctggtgatgctgcacaactccgagcagggcgggcgcgcgtaccggcacgccatggaggagctcccggacaccatcgagacgctgatgctgctcgccctgatcgccgtgctgaccggcggggtcaccctcttcttcctgagcggccgcgggctgggcaagacctccatcggcctcctgtgcgtgatggccagctccgtgctgctctggatggcgagcgtcgagccccactggatcgccgcctccatcatcctggagttcttcctgatggtgctcctgatccccgagcccgaccggcagcgcaccccgcaggacaaccagctggcctacgtggtcatcgggctcctgttcatgatcctgacggtggccgcgaacgagatgggcctcctggagaccaccaagaaggacctggggatcggccacgtggccgtcgagaaccaccaccacgccgccatgctcgacgtggacctgcaccccgccagcgcgtggaccctgtacgccgtggccacgaccatcatcacccccatgatgcggcacaccatcgagaacacgaccgccaacatctccctcaccgccatcgcgaaccaggccgccatcctgatggggctggacaagggctggccgatcagcaagatggacatcggcgtccccctcctggccctggggtgctactcccaggtgaaccccctcaccctgacggcggccgtgctgatgctcgtcgcccactacgccatcatcggccccgggctgcaggccaaggcgacccgcgaggcccagaagcggaccgccgccggcatcatgaagaacccgaccgtggacgggatcgtggccatcgacctggaccccgtcgtgtacgacgcgaagttcgagaagcagctcggccagatcatgctgctgatcctctgcacgagccagatcctgctgatgcgcaccacctgggccctctgcgagtccatcaccctggccacgggccccctgaccaccctctgggaggggagccccggcaagttctggaacaccacgatcgccgtgagcatggccaacatcttccgcgggtcctacctggcgggcgccggcctggccttcagcctcatgaagtccctcgggggcgggcggcgcgggaccggggcccagggcgagaccctgggcgagaagtggaagcggcagctcaaccagctgagcaagtccgagttcaacacctacaagcgcagcgggatcatggaggtcgaccggtccgaggcgaaggagggcctgaagcgcggggagacgaccaagcacgccgtgagccggggcaccgccaagctccgctggttcgtggagcggaacctggtcaagccggaggggaaggtgatcgacctgggctgcggccgcgggggctggtcctactactgcgccgggctgaagaaggtgaccgaggtcaagggctacacgaagggcgggcccggccacgaggagcccatccccatggccacctacgggtggaacctcgtgaagctgcacagcggcaaggacgtgttcttcatcccgcccgagaagtgcgacaccctgctctgcgacatcggggagtccagccccaaccccaccatcgaggagggccggacgctgcgcgtcctgaagatggtggagccgtggctccgggggaaccagttctgcatcaagatcctgaacccctacatgccctccgtggtcgagaccctggagcagatgcagcgcaagcacggcggcatgctcgtgcggaaccccctgagccgcaactccacccacgagatgtactgggtgagctgcgggaccggcaacatcgtctccgcggtgaacatgaccagccggatgctgctcaaccgcttcacgatggcccaccggaagccgacctacgagcgcgacgtggacctgggggccggcacccgccacgtcgccgtggagcccgaggtggccaacctggacatcatcggccagcggatcgagaacatcaagcacgagcacaagtccacctggcactacgacgaggacaacccctacaagacgtgggcgtaccacgggagctacgaggtcaagcccagcggctccgccagctccatggtgaacggggtcgtgaagctcctgaccaagccgtgggacgtgatccccatggtcacccagatcgccatgaccgacacgacccccttcggccagcagcgcgtgttcaaggagaaggtggacacccggacccccaaggccaagcgcgggacggcccagatcatggaggtcaccgcgaagtggctgtggggcttcctcagccggaacaagaagccgcgcatctgcacccgggaggagttcacccgcaaggtgcggtccaacgccgccatcggcgccgtgttcgtcgacgagaaccagtggaacagcgcgaaggaggccgtggaggacgagcgcttctgggacctggtgcaccgggagcgcgagctgcacaagcaggggaagtgcgccacgtgcgtctacaacatgatgggcaagcgggagaagaagctcggggagttcggcaaggccaaggggtcccgcgccatctggtacatgtggctgggcgcgcggttcctggagttcgaggccctcggcttcatgaacgaggaccactggttcagccgcgagaactccctgagcggggtggagggcgaggggctgcacaagctcggctacatcctgcgggacatctccaagatccccgggggcaacatgtacgccgacgacaccgccggctgggacacccgcatcaccgaggacgacctgcagaacgaggccaagatcacggacatcatggagcccgagcacgcgctcctggccaagagcatcttcaagctgacctaccagaacaaggtggtccgggtgcagcgcccggccaagaacgggaccgtgatggacgtcatctcccggcgcgaccagcgcggcagcggccaggtgggcacctacggcctcaacacgttcaccaacatggaggcccagctgatccggcagatggagtccgaggggatcttcagcccctccgagctggagacccccaacctcgccggccgcgtgctggactggctggagaagcacggggtcgagcggctcaagcgcatggcgatcagcggcgacgactgcgtggtgaagcccatcgacgaccggttcgccaccgccctgacggccctgaacgacatggggaaggtccgcaaggacatcccgcagtgggagcccagcaagggctggaacgactggcagcaggtccccttctgctcccaccacttccaccagctcatcatgaaggacggccgggagatcgtggtcccctgccgcaaccaggacgagctggtggggcgggcccgcgtgagccagggcgcggggtggtccctgcgggagaccgcctgcctcggcaagagctacgcccagatgtggcagctgatgtacttccaccgccgggacctgcgcctcgccgcgaacgccatctgctccgccgtcccggtggactgggtgcccaccagccggaccacgtggtccatccacgcccaccaccagtggatgaccaccgaggacatgctgagcgtctggaaccgcgtgtggatcgaggagaacccctggatggaggacaagacccacatctccagctggggcgacgtgccctacctgggcaagcgggaggaccagtggtgcggctccctcatcgggctgacggcccgcgcgacctgggccaccaacatccaggtcgccatcaaccaggtgcggcgcctgatcggcaacgagaactacctcgactacatgaccagcatgaagcgcttcaagaacgagtccgacccggagggggccctgtggtga

SEQ ID NO: 8366 - RNA, 9879 nt, synthetic construct
  misc_feature 1..9879: note = derived and/or modified CDS sequence (opt1) from DENV-1__FJ432739__SS-prME
  source 1..9879: mol_type = other RNA
agcgtgaccatgctgctcatgctgatgcccaccgccctggccttccacctcaccacccggggcggggagccccacatgatcgtgtccaagcaggagcggggcaagagcctgctgttcaagacctccgcgggggtgaacatgtgcaccctcatcgccatggacctgggcgagttctgcgaggacacgatgacctacaagtgcccccgcatcaccgaggccgagcccgacgacgtggactgctggtgcaacgccaccgacacgtgggtcacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtcgagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagaccgtccagtacgagaacctgaagtacagcgtgatcgtgaccgtccacacgggcgaccagcaccaggtggggaacgagtccaccgagcacggcaccaccgcgaccatcacgccccaggcccccagcaccgagatccagctgaccgactacggggccctcaccctggactgcagcccccggacgggcctggacttcaacgagatggtcctcctgaccatgaaggagaaggcctggctggtgcacaagcagtggttcctcgacctgccgctgccctggaccagcggggccagcacctcccaggagacgtggaaccggaaggacctcctggtgaccttcaagaccgcgcacgccaagaagcaggaggtcgtggtgctgggcagccaggagggcgccatgcacaccgccctcacgggggccaccgagatccagacctccggcaccacgaccatcttcgcggggcacctgaagtgccgcctgaagatggacaagctcaccctgaagggcatgagctacgtcatgtgcaccgggtccttcaagctggagaaggaggtggccgagacgcagcacggcaccgtgctcgtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggcggagccgcccttcggggagtcctacatcgtgatcggcgccggcgagaaggccctgaagctgagctggttcaagaaggggtccagcatcggcaagatgttcgaggccaccgcccgcggggcgcggcgcatggccatcctcggcgacacggcctgggacttcgggtccatcggcggcgtgttcaccagcgtcgggaagctggtgcaccagatcttcggcaccgcctacggggtgctgttctccggcgtcagctggaccatgaagatcgggatcggcgtgctcctgacgtggctgggcctcaactcccgcagcacctccctgagcatgacctgcatcgccgtggggctggtcaccctctacctgggcgtgatggtgcaggcggactccgggtgcgtcatcaactggaagggccgggagctgaagtgcgggagcggcatcttcgtgacgaacgaggtgcacacctggaccgagcagtacaagttccaggccgacagcccgaagcgcctctccgccgccatcggcaaggcctgggaggagggggtctgcggcatccggagcgcgacccgcctggagaacatcatgtggaagcagatctccaacgagctgaaccacatcctcctggagaacgacatgaagttcaccgtggtggtcggggacgtggccggcatcctggcccaggggaagaagatgatccggccccagcccatggagtacaagtacagctggaagtcctggggcaaggccaagatcatcggcgcggacgtgcagaacgccacgttcatcatcgacgggcccaacaccccggagtgccccgacgaccagcgcgcctggaacatctgggaggtcgaggactacggcttcgggatcttcaccaccaacatctggctcaagctgcgggacagctacacccaggtgtgcgaccaccgcctgatgtccgccgccatcaaggacagcaaggcggtgcacgccgacatgggctactggatcgagtccgagaagaacgagacctggaagctcgcccgggccagcttcatcgaggtcaagacctgcatctggcccaagtcccacaccctgtggagcaacggcgtgctggagtccgagatgatcatccccaagatctacgggggcccgatcagccagcacaactaccgccccgggtacttcacgcagaccgccggcccctggcacctcgggaagctggagctggacttcgacctctgcgagggcaccaccgtggtcgtggacgagcactgcggcaaccgggggccgtccctgcgcacgaccaccgtgaccggcaagatcatccacgagtggtgctgccggagctgcacgctgccgcccctgcgcttcaagggggaggacggctgctggtacgggatggagatccggcccgtcaaggagaaggaggagaacctggtgaagtccatggtgagcgcgggcagcggcgaggtcgactccttcagcctggggctcctgtgcatctccatcatgatcgaggaggtgatgcgcagccggtggtcccgcaagatgctgatgaccggcatcctcgccgtgttcttcctgctgatcatggggcagctcacctggaacgacctgatccggctgtgcatcatggtcggcgccaacgccagcgaccgcatggggatgggcacgacgtacctcgccctgatggcgaccttcaagatgcgcccgatgttcgccgtggggctcctgttccggcgcctgacctcccgggaggtgctgctcctgaccatcgggctgagcctcgtcgcctccgtggagctgcccaacagcctggaggagctcggcgacgggctggccatgggcatcatgatcctgaagctcctgacggacttccagtcccaccagctgtgggcgaccctcctgagcctgaccttcatcaagaccacgttctccctccactacgcctggaagaccatggccatggtcctgagcatcgtgtccctgttccccctctgcctgagcaccacctcccagaagacgacctggctgcccgtgctcctgggcagcctggggtgcaagccgctcaccatgttcctgatcgccgagaacaagatctggggccgcaagtcctggcccctgaacgaggggatcatggccgtcggcatcgtgagcatcctcctgagctccctgctcaagaacgacgtgcccctggcggggcccctgatcgccggcggcatgctcatcgcctgctacgtcatcagcgggtccagcgccgacctgtccctggagaaggccgcggaggtgagctgggaggaggaggccgagcactccggcgccagccacaacatcctcgtggaggtccaggacgacgggaccatgaagatcaaggacgaggagcgggacgacacgctgaccatcctgctcaaggccaccctgctggccgtgtccggcgtgtacccgctcagcatccccgcgaccctgttcgtctggtacttctggcagaagaagaagcagcgctccggggtgctgtgggacaccccctccccgcccgaggtggagcgggccgtcctcgacgacggcatctaccgcatcatgcagcggggcctgctggggcgctcccaggtgggcgtgggggtcttccaggagaacgtgttccacacgatgtggcacgtgacccggggcgccgtcctgatgtaccaggggaagcgcctcgagcccagctgggcctccgtgaagaaggacctgatcagctacggcggcgggtggcggctgcagggctcctggaacaccggggaggaggtgcaggtcatcgccgtggagcccggcaagaaccccaagaacgtgcagaccgcgcccgggacgttcaagaccagcgagggcgaggtcggcgccatcgccctcgacttcaagcccgggacctccggcagccccatcgtgaaccgcgaggggaagatcgtgggcctgtacggcaacggggtcgtgaccacgagcggcacctacgtgtccgccatcgcgcaggccaaggccagccaggaggggcccctgccggagatcgaggacgaggtcttccggaagcgcaacctcaccatcatggacctgcaccccggctccgggaagacccggcgctacctgcccgccatcgtgcgggaggccatcaagcgcaagctccggacgctgatcctggcgccgacccgcgtggtcgccagcgagatggccgaggccctcaagggcatgcccatccgctaccagaccaccgccgtgaagtccgagcacacgggcaaggagatcgtggacctgatgtgccacgcgaccttcaccatgcggctgctcagccccgtccgcgtgcccaactacaacatgatcatcatggacgaggcccacttcaccgacccgtccagcatcgccgcccgggggtacatctccacgcgcgtgggcatgggggaggccgcggccatcttcatgaccgccacgccgcccggcagcgtcgaggccttcccccagtccaacgcggtgatccaggacgaggagcgggacatcccggagcgcagctggaactccgggtacgagtggatcaccgacttccccggcaagacggtgtggttcgtccccagcatcaagtccggcaacgacatcgccaactgcctgcggaagaacgggaagcgcgtgatccagctgagccggaagaccttcgacaccgagtaccagaagaccaagaacaacgactgggactacgtggtcacgaccgacatctccgagatgggcgccaacttccgcgccgaccgggtgatcgacccccgccggtgcctcaagccggtgatcctgaaggacgggcccgagcgcgtcatcctggccggccccatgcccgtgaccgtcgcgagcgccgcccagcggcgcgggcggatcggccgcaaccacaacaaggagggcgaccagtacatctacatggggcagccgctcaacaacgacgaggaccacgcccactggaccgaggccaagatgctgctggacaacatcaacacgcccgagggcatcatccccgccctcttcgagcccgagcgggagaagtccgccgccatcgacggggagtaccgcctgcgcggcgaggcccggaagaccttcgtggagctgatgcgccgcggggacctcccggtgtggctgagctacaaggtcgccagcgagggcttccagtactccgaccgccggtggtgcttcgacggcgagcgcaacaaccaggtgctggaggagaacatggacgtggagatctggaccaaggagggggagcggaagaagctccgcccccggtggctggacgcgcgcacctacagcgaccccctggccctccgggagttcaaggagttcgccgccggccgccggtccgtcagcggggacctgatcctggagatcggcaagctcccccagcacctgacgcagcgcgcgcagaacgccctggacaacctcgtgatgctgcacaactccgagcagggcgggcgggcctaccgccacgccatggaggagctgccggacaccatcgagaccctcatgctgctggccctcatcgcggtgctgaccggcggggtcacgctgttcttcctcagcggccgggggctgggcaagacctccatcggcctgctctgcgtgatggccagctccgtgctgctgtggatggccagcgtcgagccccactggatcgccgcctccatcatcctcgagttcttcctgatggtgctgctcatccccgagcccgaccgccagcggaccccgcaggacaaccagctggcgtacgtggtcatcgggctcctcttcatgatcctgaccgtggccgccaacgagatgggcctgctcgagaccacgaagaaggacctggggatcggccacgtggccgtcgagaaccaccaccacgccgcgatgctggacgtggacctccaccccgccagcgcctggaccctgtacgccgtggccaccaccatcatcacgcccatgatgcgccacaccatcgagaacaccaccgcgaacatctccctgacggccatcgccaaccaggccgcgatcctcatggggctggacaagggctggccgatcagcaagatggacatcggcgtccccctgctcgccctggggtgctactcccaggtgaaccccctgaccctcaccgccgccgtgctgatgctggtcgcccactacgcgatcatcggccccgggctccaggccaaggccacccgggaggcccagaagcgcacggccgcgggcatcatgaagaacccgaccgtggacgggatcgtggccatcgacctggaccccgtcgtgtacgacaccaagttcgagaagcagctgggccagatcatgctcctgatcctgtgcaccagccagatcctcctgatgcgcacgacctgggccctgtgcgagtccatcaccctcgccaccggccccctgacgaccctgtgggaggggagccccggcaagttctggaacaccaccatcgccgtgtccatggcgaacatcttccgggggagctacctcgccggcgccggcctggccttcagcctgatgaagtccctcgggggcgggcgccggggcacgggggcgcagggcgagaccctgggcgagaagtggaagcgccagctgaaccagctcagcaagtccgagttcaacacctacaagcggagcgggatcatggaggtcgaccgctccgaggccaaggagggcctgaagcgcggggagaccacgaagcacgccgtgagccgcggcaccgccaagctgcggtggttcgtggagcgcaacctcgtcaagccggaggggaaggtgatcgacctgggctgcggccgcggcgggtggtcctactactgcgccgggctgaagaaggtgaccgaggtcaaggggtacaccaagggcgggcccggccacgaggagcccatccccatggcgacgtacgggtggaacctggtgaagctccacagcggcaaggacgtgttcttcatcccgcccgagaagtgcgacaccctgctgtgcgacatcggggagtccagccccaaccccaccatcgaggagggccgcaccctccgggtcctgaagatggtggagccgtggctgcgcgggaaccagttctgcatcaagatcctcaacccctacatgccctccgtggtcgagacgctggagcagatgcagcggaagcacggcggcatgctggtgcgcaaccccctcagccggaactccacccacgagatgtactgggtgagctgcgggaccggcaacatcgtctccgccgtgaacatgaccagccgcatgctgctgaaccggttcaccatggcccaccgcaagccgacgtacgagcgcgacgtggacctcggggccggcacccggcacgtcgccgtggagcccgaggtggcgaacctggacatcatcggccagcgcatcgagaacatcaagcacgagcacaagtccacctggcactacgacgaggacaacccctacaagacctgggcctaccacgggagctacgaggtcaagccctccggcagcgccagctccatggtgaacggggtcgtgaagctgctcacgaagccgtgggacgtgatccccatggtcacccagatcgccatgaccgacaccacgcccttcggccagcagcgggtgttcaaggagaaggtggacacccgcacccccaaggccaagcgggggaccgcgcagatcatggaggtcacggccaagtggctgtggggcttcctgagccgcaacaagaagccgcggatctgcacccgcgaggagttcacccggaaggtgcgctccaacgccgccatcggcgcggtgttcgtcgacgagaaccagtggaacagcgccaaggaggccgtggaggacgagcggttctgggacctcgtgcaccgcgagcgggagctgcacaagcaggggaagtgcgcgacctgcgtctacaacatgatgggcaagcgcgagaagaagctgggggagttcggcaaggccaaggggtcccgggcgatctggtacatgtggctcggcgcccgcttcctggagttcgaggccctgggcttcatgaacgaggaccactggttcagccgggagaactccctcagcggggtggagggcgaggggctgcacaagctgggctacatcctccgcgacatctccaagatccccgggggcaacatgtacgccgacgacacggccggctgggacacccggatcaccgaggacgacctgcagaacgaggcgaagatcaccgacatcatggagcccgagcacgccctgctcgccaagagcatcttcaagctgacgtaccagaacaaggtggtccgcgtgcagcggccggccaagaacgggaccgtgatggacgtcatctcccgccgcgaccagcggggcagcggccaggtgggcacctacggcctgaacaccttcacgaacatggaggcccagctcatccgccagatggagtccgaggggatcttcagcccctccgagctggagacccccaacctggcgggccgggtgctcgactggctggagaagcacggggtcgagcgcctgaagcggatggccatcagcggcgacgactgcgtggtgaagcccatcgacgaccgcttcgccaccgccctcaccgccctgaacgacatggggaaggtccggaaggacatcccgcagtgggagccctccaagggctggaacgactggcagcaggtccccttctgcagccaccacttccaccagctgatcatgaaggacggccgcgagatcgtggtcccctgccggaaccaggacgagctcgtggggcgcgcgcgggtgagccagggcgccgggtggtccctgcgcgagacggcctgcctgggcaagagctacgcccagatgtggcagctcatgtacttccaccggcgcgacctgcggctggcggccaacgccatctgctccgccgtcccggtggactgggtgcccaccagccgcaccacctggtccatccacgcccaccaccagtggatgacgaccgaggacatgctcagcgtctggaaccgggtgtggatcgaggagaacccctggatggaggacaagacccacatctccagctggggcgacgtgccctacctgggcaagcgcgaggaccagtggtgcggctccctgatcgggctcaccgcgcgggccacgtgggccaccaacatccaggtcgccatcaaccaggtgcgccgcctgatcggcaacgagaactacctggactacatgaccagcatgaagcggttcaagaacgagatcgacccggagggggccctctggtga

SEQ ID NO: 8367 - RNA, 9879 nt, synthetic construct
  misc_feature 1..9879: note = derived and/or modified CDS sequence (opt1) from DENV-1__FJ410201__SS-prME
  source 1..9879: mol_type = other RNA
agcgtgaccatgctgctcatgctgatgcccaccgccctggccttccacctcaccacccgcggcggggagccccacatgatcgtgagcaagcaggagcggggcaagagcctgctgttcaagaccagcgccggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtcctcttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggccgactccgggtgcgtcatcaactggaagggccgggagctcaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctggagaacatcatgtggaagcagatctccaacgagctcaaccacatcctgctggagaacgacatgaagctcaccgtggtggtcggggacgtggcgggcatcctggggcagggcaagaagatgatccggccccagcccatggagtacaagtacagctggaagtcctggggcaaggccaagatcatcggggccgacgcccagaacacgaccttcatcatcgacggccccaacaccccggagtgccccgacgaccagcgcgcgtggaacatctgggaggtggaggactacgggttcggcatcttcaccacgaacatctggctgaagctccgggacagctacacccaggtctgcgaccaccgcctgatgtccgccgccatcaaggacagcaaggccgtgcacgccgacatgggctactggatcgagtccgagaagaacgagacctggaagctggcgcgggccagcttcatcgaggtgaagacctgcatctggcccaagtcccacacgctctggagcaacggggtcctggagtccgagatgatcatccccaagatctacggcgggccgatcagccagcacaactaccgccccggctacttcacccagaccgccgggccctggcacctgggcaagctcgagctggacttcgacctgtgcgagggcaccacggtggtggtcgacgagcactgcgggaaccggggcccgtccctccgcaccaccaccgtgacggggaagatcatccacgagtggtgctgccggagctgcaccctgccgcccctgcgcttccggggcgaggacgggtgctggtacggcatggagatccgccccgtgaaggagaaggaggagaacctcgtcaagtccatggtgagcgccggcagcggggaggtggactccttcagcctgggcctgctctgcatctccatcatgatcgaggaggtcatgcggagccgctggtcccggaagatgctgatgaccgggaccctggccgtgttcttcctcctgatcatgggccagctgacgtggaacgacctcatccgcctgtgcatcatggtgggggcgaacgccagcgaccgcatgggcatgggcaccacctacctggccctcatggccaccttcaagatgcggccgatgttcgccgtcgggctgctgttccgccggctcacgtcccgcgaggtgctgctgctcaccatcggcctgagcctggtggcgtccgtcgagctccccaacagcctggaggagctgggggacggcctcgccatgggcatcatgatcctgaagctgctcaccgacttccagtcccaccagctgtgggccaccctgctcagcctgacgttcatcaagaccaccttctccctgcactacgcctggaagaccatggcgatggtgctcagcatcgtctccctgttccccctgtgcctcagcacgacctcccagaagaccacctggctgcccgtgctgctcgggagcctgggctgcaagccgctgacgatgttcctcatcgccgagaacaagatctgggggcggaagtcctggcccctgaacgagggcatcatggccgtggggatcgtcagcatcctgctcagctccctgctgaagaacgacgtgcccctcgccggccccctgatcgccggcgggatgctgatcgcgtgctacgtgatcagcggctccagcgccgacctctccctggagaaggccgccgaggtcagctgggaggaggaggccgagcactccggggcgagccacaacatcctggtggaggtgcaggacgacggcaccatgaagatcaaggacgaggagcgcgacgacaccctcaccatcctgctgaaggccaccctcctggccgtctccggggtgtacccgctgagcatccccgccaccctcttcgtgtggtacttctggcagaagaagaagcagcggtccggcgtcctgtgggacacccccagcccgcccgaggtggagcgcgccgtgctggacgacggcatctaccggatcatgcagcgcgggctgctcggccggtcccaggtcggggtgggcgtgttccaggagaacgtcttccacaccatgtggcacgtgacccgcggggcggtgctgatgtaccagggcaagcggctggagcccagctgggcctccgtcaagaaggacctcatcagctacggcgggggctggcgcctgcgggggtcctggaacacgggcgaggaggtccaggtgatcgccgtcgagcccgggaagaaccccaagaacgtgcagaccgcccccggcaccttcaagacccccgagggcgaggtgggggccatcgcgctggacttcaagcccggcacgagcgggtcccccatcgtcaaccgcgagggcaagatcgtgggcctctacgggaacggcgtggtcaccaccagcgggacctacgtgagcgccatcgcccaggccaaggcgtcccaggagggcccgctgcccgagatcgaggacgaggtgttccggaagcgcaacctgacgatcatggacctccaccccgggagcggcaagacccggcgctacctgccggccatcgtccgggaggccatcaagcgcaagctgcgcaccctcatcctggcccccacccgggtggtggcctccgagatggcggaggccctgaagggcatgcccatccgctaccagacgaccgccgtcaagagcgagcacaccgggaaggagatcgtggacctcatgtgccacgccaccttcacgatgcggctgctgtcccccgtgcgcgtcccgaactacaacatgatcatcatggacgaggcccacttcaccgaccccagctccatcgcggcccggggctacatcagcacccgcgtggggatgggcgaggccgccgccatcttcatgaccgcgacgccgcccgggtccgtggaggccttcccgcagagcaacgccgtcatccaggacgaggagcgggacatccccgagcgctcctggaacagcggctacgagtggatcaccgacttccccggcaagaccgtgtggttcgtgccctccatcaagagcgggaacgacatcgccaactgcctccggaagaacggcaagcgcgtcatccagctgtcccggaagaccttcgacacggagtaccagaagaccaagaacaacgactgggactacgtggtgaccaccgacatcagcgagatgggggcgaacttccgcgccgaccgggtcatcgacccgcgccggtgcctgaagcccgtgatcctcaaggacggccccgagcgcgtgatcctggccgggcccatgccggtcacggtggcctccgccgcgcagcggcgcggccggatcggccgcaaccacaacaaggagggggaccagtacatctacatgggccagcccctgaacaacgacgaggaccacgcccactggaccgaggccaagatgctcctggacaacatcaacacccccgaggggatcatccccgccctgttcgagccggagcgcgagaagtccgccgcggtcgacggcgagtaccggctccgcggggaggcccggaagaccttcgtggagctgatgcgccggggcgacctgcccgtgtggctctcctacaaggtcgccagcgagggcttccagtacagcgaccgccggtggtgcttcgacggggagcgcaacaaccaggtgctggaggagaacatggacgtggagatctggacgaaggagggcgagcggaagaagctgcgcccccggtggctcgacgcccgcacctactccgaccccctggccctgcgggagttcaaggagttcgcggccgggcgccggagcgtctccggcgacctcatcctggagatcggcaagctgccgcagcacctcacccagcgcgcccagaacgccctggacaacctggtgatgctccacaacagcgagcagggcgggcgggcgtaccgccacgccatggaggagctgcccgacaccatcgagacgctgatgctcctggccctgatcgccgtgctcaccgggggcgtcaccctgttcttcctgtccgggcggggcctcggcaagaccagcatcgggctgctgtgcgtgatggcctccagcgtgctcctgtggatggcgtccgtcgagccccactggatcgccgccagcatcatcctggagttcttcctcatggtgctgctgatccccgagccggaccgccagcggacgccccaggacaaccagctcgcctacgtggtcatcggcctgctgttcatgatcctcacggtggccgcgaacgagatggggctgctggagaccaccaagaaggacctcggcatcgggcacgtggccgtcgagaaccaccaccacgccgccatgctggacgtggacctgcaccccgcctccgcgtggaccctctacgccgtggccacgaccatcatcaccccgatgatgcgccacaccatcgagaacacgaccgccaacatcagcctgaccgccatcgcgaaccaggccgccatcctgatgggcctcgacaagggctggcccatctccaagatggacatcggggtccccctgctggccctcggctgctacagccaggtgaaccccctgaccctgacggcggccgtgctcatgctggtcgcccactacgccatcatcgggccgggcctgcaggccaaggcgacccgcgaggcccagaagcggaccgccgccgggatcatgaagaaccccaccgtggacggcatcgtggccatcgacctcgaccccgtcgtgtacgacgcgaagttcgagaagcagctgggccagatcatgctgctcatcctgtgcacgtcccagatcctgctcatgcgcaccacctgggccctgtgcgagagcatcaccctggccacggggcccctcaccaccctgtgggagggctccccggggaagttctggaacaccacgatcgccgtgagcatggccaacatcttccggggctcctacctggcgggcgccgggctcgccttcagcctgatgaagtccctgggcgggggccgccgggggaccggcgcccagggcgagaccctcggggagaagtggaagcgccagctgaaccagctgtccaagagcgagttcaacacctacaagcggtccggcatcatggaggtcgaccgcagcgaggcgaaggaggggctcaagcggggcgagacgaccaagcacgccgtgtcccgcgggaccgccaagctgcggtggttcgtggagcgcaacctggtcaagcccgagggcaaggtgatcgacctgggctgcgggcggggcgggtggagctactactgcgccggcctcaagaaggtgaccgaggtcaaggggtacacgaagggcggccccgggcacgaggagcccatcccgatggccacctacggctggaacctggtgaagctgcactccgggaaggacgtgttcttcatcccgcccgagaagtgcgacaccctcctgtgcgacatcggcgagagctcccccaacccgaccatcgaggaggggcgcacgctgcgggtcctcaagatggtggagccctggctgcgcggcaaccagttctgcatcaagatcctgaacccctacatgcccagcgtggtcgagaccctcgagcagatgcagcggaagcacggcgggatgctggtgcgcaacccgctgtcccggaacagcacccacgagatgtactgggtgtcctgcggcaccgggaacatcgtcagcgcggtgaacatgacctcccgcatgctcctgaaccgcttcacgatggcccaccggaagcccacctacgagcgcgacgtggacctgggcaccggcacccggcacgtcgccgtggagcccgaggtggccaacctcgacatcatcgggcagcgcatcgagaacatcaagcacgagcacaagagcacgtggcactacgacgaggacaacccctacaagacctgggcctaccacggctcctacgaggtcaagccgagcgggtccgcgagcagcatggtgaacggcgtcgtgaagctgctgaccaagccctgggacgtgatccccatggtcacccagatcgccatgacggacaccacccccttcgggcagcagcgggtgttcaaggagaaggtggacacccgcacgccgaaggccaagcggggcaccgcccagatcatggaggtcaccgcccgctggctctggggcttcctgtcccggaacaagaagccccgcatctgcacccgggaggagttcacgcgcaaggtgcggagcaacgcggccatcggggccgtgttcgtcgacgagaaccagtggaactccgccaaggaggcggtggaggacgagcgcttctgggacctggtgcaccgggagcgcgagctccacaagcagggcaagtgcgcgacctgcgtctacaacatgatggggaagcgggagaagaagctgggcgagttcgggaaggccaagggcagccgcgccatctggtacatgtggctgggcgcccggttcctcgagttcgaggcgctggggttcatgaacgaggaccactggttctcccgcgagaacagcctgtccggcgtggagggggagggcctccacaagctggggtacatcctgcgggacatcagcaagatccccggcggcaacatgtacgccgacgacaccgccgggtgggacacccgcatcacggaggacgacctccagaacgaggccaagatcaccgacatcatggagccggagcacgccctgctggcgaaggccatcttcaagctcacctaccagaacaaggtggtccgcgtgcagcggcccgccaagaacggcaccgtgatggacgtcatctcccgccgggaccagcgcgggagcggccaggtgggcacgtacgggctgaacaccttcaccaacatggaggcccagctgatccggcagatggagtccgagggcatcttcagcccctccgagctcgagacccccaacctggccgagcgcgcgctggactggctcgagaagtacggggtggagcggctgaagcgcatggccatcagcggcgacgactgcgtcgtgaagccgatcgacgaccggttcgccacggccctgaccgccctcaacgacatggggaaggtgcgcaaggacatcccccagtgggagccctccaagggctggaacgactggcagcaggtccccttctgcagccaccacttccaccagctgatcatgaaggacggccgggagatcgtggtgccgtgccgcaaccaggacgagctggtcgggcgggcgcgcgtgtcccagggcgccgggtggagcctccgggagaccgcctgcctgggcaagagctacgcccagatgtggcagctgatgtacttccaccgccgggacctccgcctggcggccaacgccatctgctccgccgtgcccgtcgactgggtgcccaccagccggacgacctggtccatccacgcccaccaccagtggatgaccaccgaggacatgctgagcgtgtggaaccgcgtctggatcgaggagaacccctggatggaggacaagacgcacatctccagctgggaggacgtgccgtacctcgggaagcgcgaggaccagtggtgcggctccctgatcggcctgaccgcgcgggccacctgggccaccaacatccaggtggccatcaaccaggtccgccggctcatcgggaacgagaactacctgaactacatgaccagcatgaagcgcttcaagaacgagtccgaccccgagggcgccctgtggtga

SEQ ID NO: 8368 - RNA, 9879 nt, synthetic construct
  misc_feature 1..9879: note = derived and/or modified CDS sequence (opt1) from DENV-1__FJ410203__SS-prME
  source 1..9879: mol_type = other RNA
agcgtgaccatgctgctcatgctgatgcccaccgccctggccttccacctcaccacccgcggcggggagccccacatgatcgtgagcaagcaggagcggggcaagagcctgctgttcaagacctccgccggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctgatccaccagatcttcggcaccgcctacggggtcctcttctccggcgtgagctggaccatgaagatcgggatcggcgtcctgctgacgtggctcggcctgaactcccgcagcacctccctgagcatgacctgcatcgccgtggggctcgtgaccctgtacctgggcgtcatggtgcaggccgactccgggtgcgtgatcaactggaagggccgggagctcaagtgcgggagcggcatcttcgtcacgaacgaggtgcacacctggaccgagcagtacaagttccaggcggacagcccgaagcgcctgtccgccgccatcggcaaggcctgggaggagggggtgtgcggcatccggagcgccacccgcctggagaacatcatgtggaagcagatctccaacgagctcaaccacatcctgctggagaacgacatgaagctcaccgtcgtggtgggggacgtcgcgggcatcctggggcagggcaagaagatgatccggccccagcccatggagtacaagtacagctggaagtcctggggcaaggccaagatcatcggggccgacgcccagaacacgaccttcatcatcgacggccccaacaccccggagtgccccgacgaccagcgcgcgtggaacatctgggaggtggaggactacgggttcggcatcttcaccacgaacatctggctgaagctccgggacagctacacccaggtgtgcgaccaccgcctgatgtccgccgccatcaaggacagcaaggccgtccacgccgacatgggctactggatcgagtccgagaagaacgagacctggaagctggcgcgggccagcttcatcgaggtgaagacctgcatctggcccaagtcccacacgctctggagcaacggggtgctggagtccgagatgatcatccccaagatctacggcgggccgatcagccagcacaactaccgccccggctacttcacccagaccgccgggccctggcacctgggcaagctcgagctggacttcgacctgtgcgagggcaccacggtcgtggtggacgagcactgcgggaaccggggcccgtccctccgcaccaccaccgtcacggggaagatcatccacgagtggtgctgccggagctgcaccctgccgcccctgcgcttccggggcgaggacgggtgctggtacggcatggagatccgccccgtgaaggagaaggaggagaacctcgtgaagtccatggtcagcgccggcagcggggaggtggactccttcagcctgggcctgctctgcatctccatcatgatcgaggaggtgatgcggagccgctggtcccggaagatgctgatgaccgggaccctggccgtcttcttcctcctgatcatgggccagctgacgtggaacgacctcatccgcctgtgcatcatggtgggggcgaacgccttcgaccgcatgggcatgggcaccacctacctggccctcatggccaccttcaagatgcggccgatgttcgccgtggggctgctgttccgccggctcacgagccgcgaggtcctgctgctcaccatcggcctgtccctggtggcgagcgtggagctccccaactccctggaggagctgggggacggcctcgccatgggcatcatgatcctgaagctgctcaccgacttccagagccaccagctgtgggccaccctgctctccctgacgttcatcaagaccaccttcagcctgcactacgcctggaagaccatggcgatggtcctctccatcgtgagcctgttccccctgtgcctctccacgaccagccagaagaccacctggctgcccgtcctgctcgggtccctgggctgcaagccgctgacgatgttcctcatcgccgagaacaagatctgggggcggaagtcctggcccctgaacgagggcatcatggccgtggggatcgtgtccatcctgctcagcagcctgctgaagaacgacgtccccctcgccggccccctgatcgccggcgggatgctgatcgcgtgctacgtgatctccggcagctccgccgacctcagcctggagaaggccgccgaggtgtcctgggaggaggaggccgagcacagcggggcgtcccacaacatcctggtcgaggtgcaggacgacggcaccatgaagatcaaggacgaggagcgcgacgacaccctcaccatcctgctgaaggccaccctcctggccgtgagcggggtctacccgctgtccatccccgccaccctcttcgtgtggtacttctggcagaagaagaagcagcggagcggcgtgctgtgggacacccccagcccgcccgaggtcgagcgcgccgtgctggacgacggcatctaccggatcatgcagcgcgggctgctcggccggagccaggtgggggtcggcgtgttccaggagaacgtgttccacaccatgtggcacgtcacccgcggggcggtgctgatgtaccagggcaagcggctggagccctcctgggccagcgtgaagaaggacctcatctcctacggcgggggctggcgcctgcgggggagctggaacacgggcgaggaggtccaggtgatcgccgtggagcccgggaagaaccccaagaacgtccagaccgcccccggcaccttcaagacccccgagggcgaggtgggggccatcgcgctggacttcaagcccggcacgtccgggagccccatcgtgaaccgcgagggcaagatcgtcggcctctacgggaacggcgtggtgaccacctccgggacctacgtcagcgccatcgcccaggccaaggcgagccaggagggcccgctgcccgagatcgaggacgaggtgttccggaagcgcaacctgacgatcatggacctccaccccgggtccggcaagacccggcgctacctgccggccatcgtgcgggaggccatcaagcgcaagctgcgcaccctcatcctggcccccacccgggtcgtggccagcgagatggcggaggccctgaagggcatgcccatccgctaccagacgaccgccgtgaagtccgagcacaccgggaaggagatcgtcgacctcatgtgccacgccaccttcacgatgcggctgctgagccccgtgcgcgtgccgaactacaacatgatcatcatggacgaggcccacttcaccgacccctccagcatcgcggcccggggctacatctccacccgcgtcgggatgggcgaggccgccgccatcttcatgaccgcgacgccgcccgggagcgtggaggccttcccgcagtccaacgccgtgatccaggacgaggagcgggacatccccgagcgcagctggaactccggccacgagtggatcaccgacttccccggcaagaccgtctggttcgtgcccagcatcaagtccgggaacgacatcgccaactgcctccggaagaacggcaagcgcgtgatccagctgagccggaagaccttcgacacggagtaccagaagaccaagaacaacgactgggactacgtcgtgaccaccgacatctccgagatgggggcgaacttccgcgccgaccgggtgatcgacccgcgccggtgcctgaagcccgtcatcctcaaggacggccccgagcgcgtgatcctggccgggcccatgccggtgacggtcgccagcgccgcgcagcggcgcggccggatcggccgcaaccacaacaaggagggggaccagtacatctacatgggccagcccctgaacaacgacgaggaccacgcccactggaccgaggccaagatgctcctggacaacatcaacacccccgaggggatcatccccgccctgttcgagccggagcgcgagaagtccgccgcggtggacggcgagtaccggctccgcggggaggcccggaagaccttcgtcgagctgatgcgccggggcgacctgcccgtgtggctcagctacaaggtggcctccgagggcttccagtacagcgaccgccggtggtgcttcgacggggagcgcaacaaccaggtcctggaggagaacatggacgtggagatctggacgaaggagggcgagcggaagaagctgcgcccccggtggctcgacgcccgcacctacagcgaccccctggccctgcgggagttcaaggagttcgcggccgggcgccggtccgtgagcggcgacctcatcctggagatcggcaagctgccgcagcacctcacccagcgcgcccagaacgccctggacaacctggtcatgctccacaactccgagcagggcgggcgggcgtaccgccacgccatggaggagctgcccgacaccatcgagacgctgatgctcctggccctgatcgccgtgctcaccgggggcgtgaccctgttcttcctgagcgggcggggcctcggcaagacctccatcgggctgctgtgcgtcatggccagctccgtgctcctgtggatggcgagcgtggagccccactggatcgccgcctccatcatcctggagttcttcctcatggtcctgctgatccccgagccggaccgccagcggacgccccaggacaaccagctcgcctacgtggtgatcggcctgctgttcatgatcctcacggtcgccgcgaacgagatggggctgctggagaccaccaagaaggacctcggcatcgggcacgtggccgtggagaaccaccaccacgccgccatgctggacgtcgacctgcaccccgccagcgcgtggaccctctacgccgtggccacgaccatcatcaccccgatgatgcgccacaccatcgagaacacgaccgccaacatctccctgaccgccatcgcgaaccaggccgccatcctgatgggcctcgacaagggctggcccatcagcaagatggacatcggggtgcccctgctggccctcggctgctactcccaggtcaaccccctgaccctgacggcggccgtgctcatgctggtggcccactacgccatcatcgggccgggcctgcaggccaaggcgacccgcgaggcccagaagcggaccgccgccgggatcatgaagaaccccaccgtcgacggcatcgtggccatcgacctcgaccccgtggtctacgacgcgaagttcgagaagcagctgggccagatcatgctgctcatcctgtgcacgagccagatcctgctcatgcgcaccacctgggccctgtgcgagtccatcaccctggccacggggcccctcaccaccctgtgggagggcagcccggggaagttctggaacaccacgatcgccgtgtccatggccaacatcttccggggcagctacctggcgggcgccgggctcgccttctccctgatgaagtccctgggcgggggccgccgggggaccggcgcccagggcgagaccctcggggagaagtggaagcgccagctgaaccagctgagcaagtccgagttcaacacctacaagcggagcggcatcatggaggtggaccgctccgaggcgaaggaggggctcaagcggggcgagacgaccaagcacgccgtcagccgcgggaccgccaagctgcggtggttcgtggagcgcaacctggtgaagcccgagggcaaggtcatcgacctgggctgcgggcggggcgggtggtcctactactgcgccggcctcaagaaggtgaccgaggtgaaggggtacacgaagggcggccccgggcacgaggagcccatcccgatggccacctacggctggaacctggtcaagctgcacagcgggaaggacgtgttcttcatcccgcccgagaagtgcgacaccctcctgtgcgacatcggcgagtccagccccaacccgaccatcgaggaggggcgcacgctgcgggtgctcaagatggtcgagccctggctgcgcggcaaccagttctgcatcaagatcctgaacccctacatgccctccgtggtggagaccctcgagcagatgcagcggaagcacggcgggatgctggtccgcaacccgctgagccggaactccacccacgagatgtactgggtgagctgcggcaccgggaacatcgtgtccgcggtcaacatgaccagccgcatgctcctgaaccgcttcacgatggcccaccggaagcccacctacgagcgcgacgtggacctgggcaccggcacccggcacgtggccgtcgagcccgaggtggccaacctcgacatcatcgggcagcgcatcgagaacatcaagcacgagcacaagtccacgtggcactacgacgaggacaacccctacaagacctgggcctaccacggcagctacgaggtgaagccgtccgggagcgcgtccagcatggtcaacggcgtggtcaagctgctgaccaagccctgggacgtgatccccatggtgacccagatcgccatgacggacaccacccccttcgggcagcagcgggtcttcaaggagaaggtggacacccgcacgccgaaggccaagcggggcaccgcccagatcatggaggtgaccgcccgctggctctggggcttcctgagccggaacaagaagccccgcatctgcacccgggaggagttcacgcgcaaggtccggtccaacgcggccatcggggccgtgttcgtggacgagaaccagtggaacagcgccaaggaggcggtcgaggacgagcgcttctgggacctggtgcaccgggagcgcgagctccacaagcagggcaagtgcgcgacctgcgtgtacaacatgatggggaagcgggagaagaagctgggcgagttcgggaaggccaagggctcccgcgccatctggtacatgtggctgggcgcccggttcctcgagttcgaggcgctggggttcatgaacgaggaccactggttcagccgcgagaactccctgagcggcgtcgagggggagggcctccacaagctggggtacatcctgcgggacatctccaagatccccggcggcaacatgtacgccgacgacaccgccgggtgggacacccgcatcacggaggacgacctccagaacgaggccaagatcaccgacatcatggagccggagcacgccctgctggcgaaggccatcttcaagctcacctaccagaacaaggtggtgcgcgtccagcggcccgccaagaacggcaccgtgatggacgtgatcagccgccgggaccagcgcgggtccggccaggtcggcacgtacgggctgaacaccttcaccaacatggaggcccagctgatccggcagatggagagcgagggcatcttctcccccagcgagctcgagacccccaacctggccgagcgcgcgctggactggctcgagaagtacggggtggagcggctgaagcgcatggccatctccggcgacgactgcgtggtcaagccgatcgacgaccggttcgccacggccctgaccgccctcaacgacatggggaaggtgcgcaaggacatcccccagtgggagcccagcaagggctggaacgactggcagcaggtccccttctgctcccaccacttccaccagctgatcatgaaggacggccgggagatcgtcgtgccgtgccgcaaccaggacgagctggtggggcgggcgcgcgtcagccagggcgccgggtggtccctccgggagaccgcctgcctgggcaagagctacgcccagatgtggcagctgatgtacttccaccgccgggacctccgcctggcggccaacgccatctgcagcgccgtgcccgtggactgggtccccacctcccggacgacctggagcatccacgcccaccaccagtggatgaccaccgaggacatgctgtccgtgtggaaccgcgtgtggatcgaggagaacccctggatggaggacaagacgcacatcagctcctgggaggacgtcccgtacctcgggaagcgcgaggaccagtggtgcggcagcctgatcggcctgaccgcgcgggccacctgggccaccaacatccaggtggccatcaaccaggtgcgccggctcatcgggaacgagaactacctggactacatgacctccatgaagcgcttcaagaacgagagcgaccccgagggcgccctgtggtga

SEQ ID NO: 8369 - RNA, 9879 nt, synthetic construct
  misc_feature 1..9879: note = derived and/or modified CDS sequence (opt1) from DENV-1__FJ410204__SS-prME
  source 1..9879: mol_type = other RNA
agcgtgaccatgctgctcatgctgatgcccaccgccctggccttccacctcaccacccgcggcggggagccccacatgatcgtgagcaagcaggagcggggcaagagcctgctgttcaagacctccgcgggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtcacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctgatccaccagatcttcggcaccgcctacggggtgctgttctccggcgtgagctggaccatgaagatcgggatcggcgtcctgctgacgtggctcggcctgaactcccgcagcacctccctgagcatgacctgcatcgccgtggggctcgtgaccctgtacctgggcgtcatggtgcaggccgactccgggtgcgtgatcaactggaagggccgggagctcaagtgcgggagcggcatcttcgtcacgaacgaggtgtacacctggaccgagcagtacaagttccaggcggacagcccgaagcgcctgtccgccgccatcggcaaggcctgggaggagggggtgtgcggcatccggagcgccacccgcctggagaacatcatgtggaagcagatctccaacgagctcaaccacatcctgctggagaacgacatgaagctcaccgtcgtggtgggggacgtcgcgggcatcctggggcagggcaagaagatgatccggccccagcccatggagtacaagtacagctggaagtcctggggcaaggccaagatcatcggggccgacgcccagaacacgaccttcatcatcgacggccccaacaccccggagtgccccgacgaccagcgcgcgtggaacatctgggaggtggaggactacgggttcggcatcttcaccacgaacatctggctgaagctccgggacagctacacccaggtgtgcgaccaccgcctgatgtccgccgccatcaaggacagcaaggccgtccacgccgacatgggctactggatcgagtccgagaagaacgagacctggaagctggcgcgggccagcttcatcgaggtgaagacctgcatctggcccaagtcccacacgctctggagcaacggggtgctggagtccgagatgatcatccccaagatctacggcgggccgatcagccagcacaactaccgccccggctacttcacccagaccgccgggccctggcacctgggcaagctcgagctggacttcgacctgtgcgagggcaccacggtcgtggtggacgagcactgcgggaaccggggcccgtccctccgcaccaccaccgtcacggggaagatcatccacgagtggtgctgccggagctgcaccctgccgcccctgcgcttccggggcgaggacgggtgctggtacggcatggagatccgccccgtgaaggagaaggaggagaacctcgtgaagtccatggtcagcgccggcagcggggaggtggactccttcagcctgggcctgctctgcatctccatcatgatcgaggaggtgatgcggagccgctggtcccggaagatgctgatgaccgggaccctggccgtcttcttcctcctgatcatgggccagctgacgtggaacgacctcatccgcctgtgcatcatggtgggggcgaacgccttcgaccgcatgggcatgggcaccacctacctggccctcatggccaccttcaagatgcggccgatgttcgccgtggggctgctgttccgccggctcacgagccgcgaggtcctgctgctcaccatcggcctgtccctggtggcgagcgtggagctccccaactccctggaggagctgggggacggcctcgccatgggcatcatgatcctgaagctgctcaccgacttccagagccaccagctgtgggccaccctgctctccctgacgttcatcaagaccaccttcagcctgcactacgcctggaagaccatggcgatggtcctctccatcgtgagcctgttccccctgtgcctctccacgaccagccagaagaccacctggctgcccgtcctgctcgggtccctgggctgcaagccgctgacgatgttcctcatcgccgagaacaagatctgggggcggaagtcctggcccctgaacgagggcatcatggccgtggggatcgtgtccatcctgctcagcagcctgctgaagaacgacgtccccctcgccggccccctgatcgccggcgggatgctgatcgcgtgctacgtgatctccggcagctccgccgacctcagcctggagaaggccgccgaggtgtcctgggaggaggaggccgagcacagcggggcgtcccacaacatcctggtcgaggtgcaggacgacggcaccatgaagatcaaggacgaggagcgcgacgacaccctcaccatcctgctgaaggccaccctcctggccgtgagcggggtctacccgctgtccatccccgccaccctcttcgtgtggtacttctggcagaagaagaagcagcggagcggcgtgctgtgggacacccccagcccgcccgaggtcgagcgcgccgtgctggacgacggcatctaccggatcatgcagcgcgggctgctcggccggagccaggtgggggtcggcgtgttccaggagaacgtgttccacaccatgtggcacgtcacccgcggggcggtgctgatgtaccagggcaagcggctggagccctcctgggccagcgtgaagaaggacctcatctcctacggcgggggctggcgcctgcgggggagctggaacacgggcgaggaggtccaggtgatcgccgtggagcccgggaagaaccccaagaacgtccagaccgcccccggcaccttcaagacccccgagggcgaggtgggggccatcgcgctggacttcaagcccggcacgtccgggagccccatcgtgaaccgcgagggcaagatcgtcggcctctacgggaacggcgtggtgaccacctccgggacctacgtcagcgccatcgcccaggccaaggcgagccaggagggcccgctgcccgagatcgaggacgaggtgttccggaagcgcaacctgacgatcatggacctccaccccgggtccggcaagacccggcgctacctgccggccatcgtgcgggaggccatcaagcgcaagctgcgcaccctcatcctggcccccacccgggtcgtggccagcgagatggcggaggccctgaagggcatgcccatccgctaccagacgaccgccgtgaagtccgagcacaccgggaaggagatcgtcgacctcatgtgccacgccaccttcacgatgcggctgctgagccccgtgcgcgtgccgaactacaacatgatcatcatggacgaggcccacttcaccgacccctccagcatcgcggcccggggctacatctccacccgcgtcgggatgggcgaggccgccgccatcttcatgaccgcgacgccgcccgggagcgtggaggccttcccgcagtccaacgccgtgatccaggacgaggagcgggacatccccgagcgcagctggaactccggccacgagtggatcaccgacttccccggcaagaccgtctggttcgtgcccagcatcaagtccgggaacgacatcgccaactgcctccggaagaacggcaagcgcgtgatccagctgagccggaagaccttcgacacggagtaccagaagaccaagaacaacgactgggactacgtcgtgaccaccgacatctccgagatgggggcgaacttccgcgccgaccgggtgatcgacccgcgccggtgcctgaagcccgtcatcctcaaggacggccccgagcgcgtgatcctggccgggcccatgccggtgacggtcgccagcgccgcgcagcggcgcggccggatcggccgcaaccacaacaaggagggggaccagtacatctacatgggccagcccctgaacaacgacgaggaccacgcccactggaccgaggccaagatgctcctggacaacatcaacacccccgaggggatcatccccgccctgttcgagccggagcgcgagaagtccgccgcggtggacggcgagtaccggctccgcggggaggcccggaagaccttcgtcgagctgatgcgccggggcgacctgcccgtgtggctcagctacaaggtggcctccgagggcttccagtacagcgaccgccggtggtgcttcgacggggagcgcaacaaccaggtcctggaggagaacatggacgtggagatctggacgaaggagggcgagaccaagaagctgcggcaccgctggcccgacgcccggcagtacagcgaccccctcgggctgcgcgagttcaaggagttcgccgcgggccggcgctccgtgagcggcgacctgatcctcgagatcgggaagctgccgcagcacctgacccagcgggcccagaacgccctcgacaacctggtcatgctgcacaactccgagcagggcgggcgcgcctaccggcacgcgatggaggagctccccgacaccatcgagacgctgatgctgctcgccctgatcgccgtgctgaccggcggggtgaccctcttcttcctgagcggccgcggcctggggaagacctccatcggcctcctgtgcgtcatggccagctccgtgctgctctggatggccagcgtggagccccactggatcgcggcctccatcatcctggagttcttcctgatggtcctcctgatccccgagccggaccggcagcgcacgccccaggacaaccagctggcctacgtggtgatcgggctcctgttcatgatcctgacggtcgccgccaacgagatgggcctcctggagaccaccaagaaggacctggggatcggccacgtggcggtggagaaccaccaccacgccgccatgctcgacgtcgacctgcaccccgccagcgcctggaccctgtacgcggtggccacgaccatcatcaccccgatgatgcggcacaccatcgagaacacgaccgccaacatctccctcaccgccatcgccaaccaggcggccatcctgatgggcctggacaaggggtggcccatcagcaagatggacatcggcgtgcccctcctggccctggggtgctactcccaggtcaaccccctcaccctgacggccgcggtgctgatgctcgtggcccactacgccatcatcggcccggggctgcaggccaaggccacccgcgaggcgcagaagcgcaccgccgccggcatcatgaagaaccccaccgtcgacggcatcgtggccatcgacctggaccccgtggtctacgacgccaagttcgagaagcagctcgggcagatcatgctgctgatcctctgcacgagccagatcctgctgatgcggaccacctgggcgctctgcgagtccatcaccctggccacgggccccctgaccaccctctgggaggggagcccgggcaagttctggaacaccacgatcgccgtgtccatggccaacatcttccgcggcagctacctggccggggcgggcctggccttctccctcatgaagtccctcgggggcgggcggcgcgggaccggcgcccagggggagaccctgggcgagaagtggaagcggcagctcaaccagctgagcaagtccgagttcaacacctacaagcgcagcgggatcatggaggtggaccggtccgaggccaaggagggcctgaagcgcggggagacgaccaagcacgcggtcagccggggcaccgccaagctccgctggttcgtggagcggaacctggtgaagcccgagggcaaggtcatcgacctggggtgcggccgcgggggctggtcctactactgcgccgggctgaagaaggtgaccgaggtgaagggctacacgaagggcgggcccggccacgaggagcccatcccgatggccacctacgggtggaacctcgtcaagctgcacagcggcaaggacgtgttcttcatcccgcccgagaagtgcgacaccctgctctgcgacatcggggagtccagccccaacccgaccatcgaggagggccggacgctgcgcgtgctgaagatggtcgagccctggctccggggcaaccagttctgcatcaagatcctgaacccctacatgccctccgtggtggagaccctggagcagatgcagcgcaagcacgggggcatgctcgtccggaacccgctgagccgcaactccacccacgagatgtactgggtgagctgcgggaccggcaacatcgtgtccgccgtcaacatgaccagccggatgctgctcaaccgcttcacgatggcgcaccgcaagcccacctacgagcgggacgtggacctgggcaccgggacccgccacgtggccgtcgagcccgaggtggccaacctggacatcatcggccagcggatcgagaacatcaagcacgagcacaagtccacgtggcactacgacgaggacaacccctacaagacctgggcctaccacgggagctacgaggtgaagccgtccggcagcgcctccagcatggtcaacggggtggtcaagctcctgaccaagccctgggacgtgatccccatggtgacccagatcgcgatgacggacaccacccccttcggccagcagcgcgtcttcaaggagaaggtggacacccggacgccgaaggccaagcgcggcaccgcccagatcatggaggtgaccgcccggtggctgtgggggttcctcagccgcaacaagaagccccggatctgcacccgcgaggagttcacgcggaaggtccgctccaacgccgcgatcggcgccgtgttcgtggacgagaaccagtggaacagcgccaaggaggccgtcgaggacgagcggttctgggacctggtgcaccgcgagcgggagctgcacaagcaggggaagtgcgcgacctgcgtgtacaacatgatgggcaagcgcgagaagaagctcggggagttcggcaaggccaagggctcccgggccatctggtacatgtggctgggggcccgcttcctggagttcgaggccctcggcttcatgaacgaggaccactggttcagccgggagaactccctgagcggggtcgagggcgaggggctgcacaagctcggctacatcctgcgcgacatctccaagatccccggcgggaacatgtacgcggacgacaccgccggctgggacacccggatcacggaggacgacctgcagaacgaggccaagatcaccgacatcatggagccggagcacgccctcctggccaaggcgatcttcaagctgacctaccagaacaaggtggtgcgcgtccagcgccccgccaagaacgggaccgtgatggacgtgatcagccggcgcgaccagcggggctccggccaggtcgggacgtacggcctcaacaccttcaccaacatggaggcccagctgatccgccagatggagagcgaggggatcttctcccccagcgagctggagacccccaacctcgccgagcgggccctggactggctggagaagtacggcgtggagcgcctcaagcggatggcgatctccggggacgactgcgtggtcaagccgatcgacgaccgcttcgccacggccctgaccgccctgaacgacatgggcaaggtgcggaaggacatcccccagtgggagcccagcaagggctggaacgactggcagcaggtccccttctgctcccaccacttccaccagctcatcatgaaggacgggcgcgagatcgtcgtgccgtgccggaaccaggacgagctggtgggccgcgcccgggtcagccagggggcgggctggtccctgcgcgagaccgcctgcctcggcaagagctacgcccagatgtggcagctgatgtacttccaccggcgcgacctgcggctcgccgcgaacgccatctgcagcgccgtgcccgtggactgggtccccacctcccgcacgacctggagcatccacgcccaccaccagtggatgaccaccgaggacatgctgtccgtgtggaaccgggtgtggatcgaggagaacccctggatggaggacaagacgcacatcagctcctgggaggacgtcccgtacctgggcaagcgcgaggaccagtggtgcggcagcctcatcgggctgaccgcccgcgcgacctgggccaccaacatccaggtggccatcaaccaggtgcggcgcctgatcggcaacgagaactacctcgactacatgacctccatgaagcggttcaagaacgagagcgaccccgagggggccctgtggtga

SEQ ID NO: 8370 - RNA, 9879 nt, synthetic construct
  misc_feature 1..9879: note = derived and/or modified CDS sequence (opt1) from DENV-1__FJ432742__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgccggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtgacctacgggacctgcagccagacgggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccgtgggcggcgtgttcaccagcgtcgggaagctggtgcaccagatcttcggcaccgcctacggggtcctgttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggccgactccgggtgcgtcatcaactggaagggccgggagctcaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctggagaacatcatgtggaagcagatctccaacgagctcaaccacatcctgctggagaacgacatgaagttcaccgtggtggtcggggacgtggtgggcatcctcgcgcaggggaagaagatgatccggccccagcccatggagcacaagtacagctggaagtcctggggcaaggccaagatcatcggcgccgacgtccagaacacgaccttcatcatcgacgggcccaacaccccggagtgccccgacgaccagcgcgcctggaacatctgggaggtggaggactacggcttcgggatcttcaccacgaacatctggctgaagctgcgggacagctacacccaggtgtgcgaccaccgcctcatgtccgcggccatcaaggacagcaaggccgtccacgccgacatgggctactggatcgagtccgagaagaacgagacctggaagctggcccgggcgagcttcatcgaggtgaagacctgcatctggcccaagtcccacacgctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcaccacggtcgtggtggacgagcactgcggcaaccgggggccgtccctgcgcaccaccaccgtcacgggcaagatcatccacgagtggtgctgccggagctgcaccctgccgcccctccgcttcaagggggaggacggctgctggtacgggatggagatccggcccgtgaaggagaaggaggagaacctggtgaagtccatggtcagcgccggcagcggcgaggtggactccttcagcctcgggctgctgtgcatctccatcatgatcgaggaggtgatgcgcagccggtggtcccgcaagatgctcatgaccggcaccctggccgtcttcctgctcctgatcatggggcagctgacgtggaacgacctcatccggctgtgcatcatggtgggcgccaacgcgagcgaccgcatggggatgggcaccacctacctggccctcatggccaccttcaagatgcgcccgatgttcgccgtggggctgctgttccggcgcctcacgtcccgggaggtcctgctgctcaccatcgggctgagcctggtggcctccgtcgagctccccaacagcctggaggagctgggcgacgggctcgcgatgggcatcatgatcctgaagctgctcaccgacttccagtcccaccagctgtgggccaccctgctcagcctgacgttcatcaagaccaccctgtccctccactacgcctggaagaccatggccatggtgctgagcatcgtgtccctgttccccctctgcctgagcacgacctcccagaagaccacctggctgcccgtcctcctgggcagcctggggtgcaagccgctcacgatgttcctgatcaccgagaacaagatctggggccgcaagtcctggcccctgaacgaggggatcatggcggtgggcgtggtcagcatcctcctgagctccctgctcaagaacgacgtgcccctggccgggcccctgatcgccggcggcatgctcatcgcctgctacgtgatcagcgggtccagcgccgacctgtccctggagaaggcggccgaggtcagctgggaggaggaggccgagcactccggcgccagccacaacatcctcgtggaggtgcaggacgacgggaccatgaagatcaaggacgaggagcgggacgacaccctgaccatcctgctcaaggccacgctgctggcggtctccggcgtgtacccgctcagcatccccgccaccctgttcgtgtggtacttctggcagaagaagaagcagcgctccggggtcctgtgggacacccccagcccgcccgaggtggagcgggccgtgctggacgacggcatctaccgcatcatgcagcggggcctcctggggcgctcccaggtcggcgtgggggtgttccaggagaacgtcttccacaccatgtggcacgtgacgcggggcgccgtgctgatgtaccaggggaagcgcctcgagcccagctgggcctccgtcaagaaggacctgatcagctacggcggcgggtggcggctgcagggctcctggaacaccggggaggaggtccaggtgatcgcggtcgagcccggcaagaaccccaagaacgtgcagaccgcccccgggaccttcaagacgcccgagggcgaggtgggcgccatcgccctcgacttcaagcccgggaccagcggctcccccatcgtcaaccgcgaggggaagatcgtgggcctgtacggcaacggggtggtcaccaccagcggcacgtacgtgagcgccatcgcgcaggccaaggcctcccaggaggggccgctgcccgagatcgaggacgaggtgttccggaagcgcaacctcaccatcatggacctgcaccccggcagcgggaagacccggcgctacctgccggccatcgtccgggaggcgatcaagcgcaagctccggaccctgatcctggcccccacgcgcgtggtggcctccgagatggccgaggccctcaagggcatgcccatccgctaccagaccaccgcggtcaagagcgagcacaccggcaaggagatcgtggacctgatgtgccacgccacgttcaccatgcggctgctctcccccgtgcgcgtcccgaactacaacatgatcatcatggacgaggcccacttcaccgaccccagctccatcgccgcccgggggtacatcagcacccgcgtgggcatgggggaggcggccgccatcttcatgacggccacgccgcccggctccgtggaggccttcccgcagagcaacgcggtcatccaggacgaggagcgggacatccccgagcgctcctggaacagcgggtacgagtggatcaccgacttccccggcaagaccgtgtggttcgtgccctccatcaagagcggcaacgacatcgccaactgcctgcggaagaacgggaagcgcgtcatccagctgtcccggaagacgttcgacaccgagtaccagaagaccaagaacaacgactgggactacgtggtgaccacggacatcagcgagatgggcgccaacttccgcgccgaccgggtcatcgacccgcgccggtgcctcaagcccgtgatcctgaaggacgggcccgagcgcgtcatcctggcgggccccatgccggtgaccgtggcctccgccgcccagcggcgcgggcggatcggccgcaaccacaacaaggagggcgaccagtacatctacatggggcagcccctcaacaacgacgaggaccacgcccactggaccgaggcgaagatgctgctggacaacatcaacacccccgagggcatcatccccgccctcttcgagccggagcgggagaagtccgccgccatcgacggggagtaccgcctgcgcggcgaggcccggaagacgttcgtcgagctgatgcgccgcggggacctccccgtgtggctgtcctacaaggtggcgagcgagggcttccagtacagcgaccgccggtggtgcttcgacggcgagcgcaacaaccaggtcctggaggagaacatggacgtggagatctggaccaaggagggggagcggaagaagctccgcccccggtggctggacgcccgcacctactccgaccccctggccctccgggagttcaaggagttcgccgccggccgccggagcgtgtccggggacctgatcctggagatcggcaagctcccgcagcacctgacccagcgcgcgcagaacgccctggacaacctcgtcatgctgcacaacagcgagcagggcgggcgggcctaccgccacgccatggaggagctgcccgacacgatcgagaccctcatgctgctggcgctcatcgccgtgctgaccggcggggtgaccctgttcttcctctccggccgggggctgggcaagaccagcatcggcctgctctgcgtcatggcctccagcgtgctgctgtggatggcctccgtggagccccactggatcgccgcgagcatcatcctcgagttcttcctgatggtcctgctcatccccgagccggaccgccagcggacgccccaggacaaccagctggcctacgtggtgatcgggctcctcttcatgatcctgaccgtcgccgccaacgagatgggcctgctcgagaccaccaagaaggacctggggatcggccacgtggccgtggagaaccaccaccacgcgacgatgctggacgtcgacctccaccccgcctccgcctggaccctgtacgccgtggccaccaccatcatcacgccgatgatgcgccacaccatcgagaacaccaccgcgaacatcagcctgacggccatcgccaaccaggccgccatcctcatggggctggacaagggctggcccatctccaagatggacatcggcgtgcccctgctcgcgctggggtgctacagccaggtcaaccccctgaccctcaccgccgccgtgctgatgctggtggcccactacgcgatcatcggcccggggctccaggccaaggccacccgggaggcccagaagcgcacggccgcgggcatcatgaagaaccccaccgtcgacgggatcgtggccatcgacctggaccccgtggtctacgacgccaagttcgagaagcagctgggccagatcatgctcctgatcctgtgcacctcccagatcctcctgatgcgcaccacgtgggccctgtgcgagagcatcaccctcgccaccggccccctgaccacgctgtgggaggggtccccgggcaagttctggaacaccaccatcgcggtgagcatggccaacatcttccgggggtcctacctcgccggcgccggcctggccttcagcctgatgaagtccctcgggggcgggcgccggggcaccggggcgcagggcgagacgctgggcgagaagtggaagcgccagctgaaccagctctccaagagcgagttcaacatctacaagcggtccgggatcatggaggtggaccgcagcgaggccaaggagggcctgaagcgcggggagaccacccgccacgccgtctcccggggcaccgccaagctgcgctggttcgtggagcggaacctggtgaagcccgaggggaaggtcatcgacctcggctgcggccgcgggggctggagctactactgcgcggggctgaagaaggtgacggaggtgaagggctacaccaagggcgggcccggccacgaggagcccatcccgatggccacctacgggtggaacctggtcaagctccactccggcaaggacgtgttcttcacgccgcccgagaagtgcgacacgctgctgtgcgacatcggggagagctcccccaacccgaccatcgaggagggccggaccctccgcgtgctgaagatggtcgagccctggctgcgggggaaccagttctgcatcaagatcctcaacccctacatgcccagcgtggtggagaccctggagcagatgcagcgcaagcacggcggcatgctggtccggaacccgctctcccgcaacagcacccacgagatgtactgggtgtcctgcgggacgggcaacatcgtgagcgccgtcaacatgacctcccggatgctgctgaaccgcttcaccatggcccaccgcaagcccacctacgagcgggacgtggacctcggggccggcacgcgccacgtggcggtcgagcccgaggtggccaacctggacatcatcggccagcggatcgagaacatcaagcacgagcacaagagcacctggcactacgacgaggacaacccctacaagacctgggcctaccacgggtcctacgaggtcaagccgagcggctccgccagcagcatggtgaacggggtggtcaagctgctcaccaagccctgggacgtgatccccatggtgacgcagatcgccatgaccgacaccacccccttcggccagcagcgcgtcttcaaggagaaggtggacacgcggaccccgaaggcgaagcgcgggaccgcccagatcatggaggtgaccgcccggtggctgtggggcttcctgtcccgcaacaagaagccccggatctgcacgcgcgaggagttcacccggaaggtccgcagcaacgccgccatcggcgcggtgttcgtggacgagaaccagtggaactccgccaaggaggccgtcgaggacgagcggttctgggacctcgtgcagaaggagcgcgagctgcacaagcaggggaagtgcgcgacctgcgtgtacaacatgatgggcaagcgggagaagaagctgggggagttcggcaaggcgaaggggagccgcgccatctggtacatgtggctcggcgcccggttcctggagttcgaggccctgggcttcatgaacgaggaccactggttctcccgcgagaacagcctctccggggtcgagggcgaggggctgcacaagctgggctacatcctccgggacatcagcaagatccccgggggcaacatgtacgccgacgacaccgcgggctgggacacgcgcatcaccgaggacgacctgcagaacgaggccaagatcaccgacatcatggagccggagcacgccctgctcgccacctccatcttcaagctgacgtaccagaacaaggtggtgcgggtccagcgccccgccaagaacgggaccgtgatggacgtgatcagccgccgggaccagcgcggctccgggcaggtcggcacctacggcctgaacaccttcacgaacatggaggcgcagctcatccggcagatggagagcgaggggatcttcctgccctccgagctggagacccccaacctcgccgagcgcgtgctggactggctggagaagtacggcgtggagcggctcaagcgcatggccatcagcggggacgactgcgtcgtgaagccgatcgacgaccggttcgccaccgccctgaccgcgctgaacgacatgggcaaggtgcgcaaggacatcccccagtgggagccctccaaggggtggaacgactggcagcaggtccccttctgcagccaccacttccaccagctcatcatgaaggacggccgggagatcgtggtgccgtgccgcaaccaggacgagctggtcggccgggcccgcgtgtcccagggggccggctggagcctgcgggagacggcctgcctcggcaagagctacgcccagatgtggcagctgatgtacttccaccgccgggacctgcgcctcgcggccaacgccatctgctccgccgtgcccgtcgactgggtgcccaccagccggaccacctggtccatccacgcgcaccaccagtggatgacgaccgaggacatgctgagcgtgtggaaccgcgtctggatcgaggagaacccctggatggaggacaagacccacgtgtccagctggggcgacgtgccgtacctggggaagcgggaggaccagtggtgcggctccctcatcggcctgaccgcccgcgccacctgggccagcaacatccaggtcgccatcaaccaggtgcgccggctgatcgggaacgagaactacctcgactacatgacgtccatgaagcgcttcaagaacgagggcgaccccgagggggcgctgtggtga

SEQ ID NO: 8371 - RNA, 9879 nt, synthetic construct
  misc_feature 1..9879: note = derived and/or modified CDS sequence (opt1) from DENV-1__FJ410205__SS-prME
  source 1..9879: mol_type = other RNA
agcgtgaccatgctgctgatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgggacaagcggtccgtggccctcgcgccccacgtgggcctggggctggagacccgcaccgagacctggatgagctccgagggcgcctggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggagctggccgagacccagcacggcaccgtgctggtgcagatcaagtacgagggcaccgacgcgccctgcaagatccccttcagcacgcaggacgagaagggggtcacccagaacggccggctgatcaccgccaacccgatcgtgaccgacaaggagaagcccgtgaacatcgaggccgagccgcccttcggggagtcctacatcgtcatcggcgccggcgagaaggcgctcaagctgagctggttcaagaaggggtccagcatcggcaagatgttcgaggccacggcccgcggggcccggcgcatggccatcctgggcgacaccgcgtgggacttcgggtccatcggcggcgtgttcaccagcgccgggaagctcgtgcaccagatcttcggcaccgcctacggggtcctgttctccggcgtgagctggacgatgaagatcgggatcggcgtgctgctcacctggctgggcctgaactcccgcagcacctccctcagcatgacctgcatcgccgtcgggctggtgacgctgtacctcggcgtgatggtccaggccgactccgggtgcgtgatcaactggaagggccgggagctgaagtgcgggagcggcatcttcgtgaccaacgaggtccacacctggaccgagcagtacaagttccaggcggacagcccgaagcgcctgtccgccgccatcggcaaggcctgggaggagggggtgtgcggcatccggagcgccacccgcctcgagaacatcatgtggaagcagatctccaacgagctgaaccacatcctgctcgagaacgacatgaagttcacggtggtcgtgggggacgtggcgggcatcctggcccaggggaagaagatgatccggccccagcccatggagtacaagtacagctggaagtcctggggcaaggccaagatcatcggcgccgacgtccagaacaccaccttcatcatcgacgggcccaacaccccggagtgccccgacgaccagcgcgcgtggaacatctgggaggtggaggactacggcttcgggatcttcacgaccaacatctggctgaagctccgggacagctacacccaggtgtgcgaccaccgcctgatgtccgccgccatcaaggacagcaaggccgtccacgccgacatgggctactggatcgagtccgagaagaacgagacctggaagctggcgcgggccagcttcatcgaggtgaagacgtgcatctggcccaagtcccacaccctctggagcaacggcgtgctggagtccgagatgatcatccccaagatctacgggggcccgatcagccagcacaactaccgccccgggtacttcacccagaccgccggcccctggcacctggggaagctcgagctggacttcgacctgtgcgagggcacgaccgtcgtggtggacgagcactgcggcaaccgggggccgtccctccgcaccaccacggtcaccggcaagatcatccacgagtggtgctgccggagctgcaccctgccgcccctgcgcttccgcggggaggacggctgctggtacgggatggagatccgccccgtgaaggagaaggaggagaacctcgtgaagtccatggtcagcgccggcagcggcgaggtggactccttcagcctggggctgctctgcatctccatcatgatcgaggaggtgatgcggagccgctggtcccggaagatgctgatgaccggcacgctggccgtcttcttcctcctgatcatggggcagctgacctggaacgacctcatccgcctgtgcatcatggtgggcgcgaacgccagcgaccgcatggggatgggcaccacctacctggccctcatggccacgttcaagatgcggccgatgttcgccgtgggcctgctgttccgccggctcacctcccgcgaggtcctgctgctcaccatcgggctgagcctggtggcgtccgtggagctccccaacagcctggaggagctgggcgacgggctcgccatgggcatcatgatcctgaagctgctcaccgacttccagtcccaccagctgtgggccacgctgctcagcctgaccttcatcaagaccaccttctccctgcactacgcctggaagacgatggcgatggtcctcagcatcgtgtccctgttccccctgtgcctcagcaccacctcccagaagaccacgtggctgcccgtcctgctcggcagcctggggtgcaagccgctgaccatgttcctcatcgccgagaacaagatctggggccggcgctcctggcccctgaacgaggggatcatggccgtgggcatcgtgagcatcctgctcagctccctgctgaagaacgacgtccccctcgccgggcccctgatcgccggcggcatgctgatcgcgtgctacgtgatcagcgggtccagcgccgacctctccctggagaaggccgccgaggtgagctgggaggaggaggccgagcactccggcgcgagccacaacatcctggtcgaggtgcaggacgacgggaccatgaagatcaaggacgaggagcgggacgacaccctcaccatcctgctgaaggccacgctcctggccgtgtccggcgtctacccgctgagcatccccgccaccctcttcgtgtggtacttctggcagaagaagaagcagcgctccggggtgctgtgggacacccccagcccgcccgaggtcgagcgggccgtgctggacgacggcatctaccgcatcatgcagcggggcctgctcgggcgctcccaggtgggcgtcggggtgttccaggagaacgtgttccacaccatgtggcacgtcacgcggggcgcggtgctgatgtaccaggggaagcgcctggagcccagctgggcctccgtgaagaaggacctcatcagctacggcggcgggtggcggctgcagggctcctggaacaccggggaggaggtccaggtgatcgccgtggagcccggcaagaaccccaagaacgtccagaccgcccccgggaccttcaagacgcccgagggcgaggtgggcgccatcgcgctggacttcaagcccgggaccagcggctcccccatcgtgaaccgcgaggggaagatcgtcggcctctacggcaacggggtggtgaccaccagcggcacgtacgtcagcgccatcgcccaggccaaggcgtcccaggaggggccgctgcccgagatcgaggacgaggtgttccggaagcgcaacctgaccatcatggacctccaccccggcagcgggaagacccggcgctacctgccggccatcgtgcgggaggccatcaagcgcaagctgcgcaccctcatcctggcccccacgcgggtcgtggcctccgagatggcggaggccctgaagggcatgcccatccgctaccagaccaccgccgtcaagagcgagcacaccggcaaggagatcgtcgacctcatgtgccacgccacgttcaccatgcggctgctgtcccccgtgcgcgtgccgaactacaacatgatcatcatggacgaggcccacttcaccgaccccagctccatcgcggcccgggggtacatcagcacccgcgtcggcatgggggaggccgccgccatcttcatgacggcgacgccgcccggctccgtggaggccttcccgcagagcaacgccgtgatccaggacgaggagcgggacatccccgagcgctcctggaacagcgggtacgagtggatcaccgacttccccggcaagaccgtctggttcgtgccctccatcaagagcggcaacgacatcgccaactgcctccggaagaacgggaagcgcgtgatccagctgtcccggaagacgttcgacaccgagtaccagaagaccaagaacaacgactgggactacgtcgtgaccacggacatcagcgagatgggcgcgaacttccgcgccgaccgggtgatcgacccgcgccggtgcctgaagcccgtcatcctcaaggacgggcccgagcgcgtgatcctggccggccccatgccggtgaccgtcgcctccgccgcgcagcggcgcgggcggatcggccgcaaccacaacaaggagggcgaccagtacatctacatggggcagcccctgaacaacgacgaggaccacgcccactggaccgaggccaagatgctcctggacaacatcaacacccccgagggcatcatccccgccctgttcgagccggagcgcgagaagtccgccgcgatcgacggggagtaccggctccgcggcgaggcccggaagacgttcgtggagctgatgcgccgcggggacctgcccgtctggctctcctacaaggtggccagcgagggcttccagtacagcgaccgccggtggtgcttcgacggcgagcgcaacaaccaggtgctggaggagaacatggacgtcgagatctggaccaaggagggggagcggaagaagctgcgcccccggtggctcgacgcccgcacctactccgaccccctggccctgcgggagttcaaggagttcgcggccggccgccggagcgtgtccggggacctcatcctggagatcggcaagctgccgcagcacctcacccagcgcgcccagaacgccctggacaacctggtgatgctccacaacagcgagcagggcgggcgggcgtaccgccacgccatggaggagctgcccgacacgatcgagaccctgatgctcctggccctgatcgccgtcctcaccggcggggtgaccctgttcttcctgtccggccgggggctcggcaagaccagcatcggcctgctgtgcgtgatggcctccagcgtcctcctgtggatggcgtccgtggagccccactggatcgccgccagcatcatcctggagttcttcctcatggtgctgctgatccccgagccggaccgccagcggacgccccaggacaaccagctcgcctacgtcgtgatcgggctgctgttcatgatcctcaccgtggccgcgaacgagatgggcctgctggagaccaccaagaaggacctcgggatcggccacgtcgccgtggagaaccaccaccacgccgccatgctggacgtggacctgcaccccgcctccgcgtggacgctctacgccgtcgccaccaccatcatcaccccgatgatgcgccacacgatcgagaacaccaccgccaacatcagcctgaccgccatcgcgaaccaggccgccatcctgatggggctcgacaagggctggcccatctccaagatggacatcggcgtgcccctgctggccctcgggtgctacagccaggtgaaccccctgacgctgaccgcggccgtcctcatgctggtggcccactacgccatcatcggcccggggctgcaggccaaggcgacccgcgaggcccagaagcggaccgccgccggcatcatgaagaaccccacggtggacgggatcgtcgccatcgacctcgaccccgtggtgtacgacgcgaagttcgagaagcagctgggccagatcatgctgctcatcctgtgcacctcccagatcctgctcatgcgcaccacctgggccctgtgcgagagcatcacgctggccaccggccccctcaccaccctgtgggaggggtccccgggcaagttctggaacacgaccatcgccgtcagcatggccaacatcttccgggggtcctacctggcgggcgccggcctcgccttcagcctgatgaagtccctcgggggcgggcgccgggggaccggggcccagggcgagaccctcggcgagaagtggaagcgccagctgaaccagctgtccaagagcgagttcaacacgtacaagcggtccgggatcatggaggtggaccgcagcgaggcgaaggagggcctcaagcgcggggagaccaccaagcacgccgtgtcccgcggcaccgccaagctgcggtggttcgtcgagcgcaacctggtgaagcccgaggggaaggtgatcgacctgggctgcggccgcgggggctggagctactactgcgccgggctcaagaaggtcacggaggtgaagggctacaccaagggcggccccggccacgaggagcccatcccgatggccacctacgggtggaacctggtgaagctgcactccggcaaggacgtcttcttcatcccgcccgagaagtgcgacaccctcctgtgcgacatcggggagagctcccccaacccgacgatcgaggagggccgcaccctgcgggtgctcaagatggtggagccctggctgcgcgggaaccagttctgcatcaagatcctgaacccctacatgcccagcgtcgtggagaccctcgagcagatgcagcggaagcacggcggcatgctggtgcgcaacccgctgtcccggaacagcacccacgagatgtactgggtctcctgcgggaccggcaacatcgtgagcgcggtgaacatgacgtcccgcatgctcctgaaccgcttcaccatggcccaccggaagcccacctacgagcgcgacgtcgacctgggggccggcacccggcacgtggccgtggagcccgaggtcgccaacctcgacatcatcggccagcgcatcgagaacatcaagcacgagcacaagagcacgtggcactacgacgaggacaacccctacaagacctgggcgtaccacgggtcctacgaggtgaagccgagcggctccgccagcagcatggtgaacggggtcgtgaagctgctgaccaagccctgggacgtcatccccatggtgacccagatcgccatgacggacaccacccccttcggccagcagcgggtgttcaaggagaaggtcgacacccgcacgccgaaggccaagcgggggaccgcccagatcatggaggtgaccgcgaagtggctctggggcttcctgtcccgcaacaagaagccccggatctgcacccgcgaggagttcacgcggaaggtgcgcagcaacgccgccatcggcgccgtcttcgtggacgagaaccagtggaactccgcgaaggaggccgtggaggacgagcggttctgggacctggtccaccgcgagcgggagctccacaagcaggggaagtgcgcgacctgcgtgtacaacatgatgggcaagcgcgagaagaagctgggggagttcggcaaggccaaggggagccgggccatctggtacatgtggctgggcgcgcgcttcctcgagttcgaggccctgggcttcatgaacgaggaccactggttctcccgggagaacagcctgtccggggtggagggcgaggggctccacaagctgggctacatcctgcgcgacatcagcaagatccccgggggcaacatgtacgccgacgacaccgccggctgggacacccggatcacggaggacgacctccagaacgaggcccgcatcaccgacatcatggagccggagcacgcgctgctggccaagtccatcttcaagctcacctaccagaacaaggtcgtgcgcgtgcagcggcccgccaagaacgggaccgtcatggacgtgatcagccgccgggaccagcgcggctccggccaggtggggacgtacggcctgaacaccttcaccaacatggaggcccagctgatccggcagatggagagcgaggggatcttctcccccagcgagctcgagacccccaacctggccgagcgcgtcctggactggctcgagaagtacggcgtggagcggctgaagcgcatggcgatctccggggacgactgcgtggtcaagccgatcgacgaccggttcgccacggccctgaccgccctcaacgacatgggcaaggtgcgcaaggacatcccccagtgggagcccagcaaggggtggaacgactggcagcaggtccccttctgctcccaccacttccaccagctgatcatgaaggacggccgggagatcgtcgtgccgtgccgcaaccaggacgagctggtgggccgggcccgcgtcagccagggggcgggctggagcctccgggagaccgcctgcctggggaagtcctacgcccagatgtggcagctgatgtacttccaccgccgggacctccgcctggccgcgaacgccatctgcagcgccgtgcccgtggactggatccccacctcccggacgacctggagcatccacgcccaccaccagtggatgaccaccgaggacatgctgtccgtctggaaccgcgtgtggatcgaggagaacccctggatggaggacaagacgcacatcagctcctggggcgacgtgccgtacctcgggaagcgcgaggaccagtggtgcggcagcctgatcggcctgaccgcccgggcgacctgggccaccaacatccaggtcgccatcaaccaggtgcgccggctcatcgggaacgagaactacctggactacatgacctccatgaagcgcttcaagaacgagagcgaccccgagggcgccctgtggtga

SEQ ID NO: 8372 - RNA, 9879 nt, synthetic construct
  misc_feature 1..9879: note = derived and/or modified CDS sequence (opt1) from DENV-1__FJ410207__SS-prME
  source 1..9879: mol_type = other RNA
agcgtgaccatgctgctcatgctgatgcccaccgccctggccttccacctcaccacccgcggcggggagccgcacatgatcgtgagcaagcaggagcggggcaagagcctgctgttcaagaccagcgcgggggtgaacatgtgcaccctcatcgccatggacctgggcgagttctgcgaggacaccatgacctacaagtgcccccgcatcaccgaggccgagcccgacgacgtggactgctggtgcaacgccaccgacacctgggtgacctacgggacctgcagccagaccggcgagcaccggcgcgacaagcggtccgtggccctggcgccccacgtgggcctcgggctggagacgcgcaccgagacctggatgagctccgagggcgcctggaagcagatccagcgggtcgagacctgggccctgcgccacccggggttcatggtgatcgccctcttcctggcgcacgccatcggcacgagcatcacccagaaggggatcatcttcatcctgctcatgctggtgaccccctccatggccatgcggtgcgtcggcatcggcagccgcgacttcgtggaggggctgtccggcgccacctgggtggacgtcgtgctcgagcacgggagctgcgtgacgaccatggccaaggacaagcccaccctggacatcgagctgctcaagaccgaggtcacgaaccccgcggtgctgcggaagctgtgcatcgaggccaagatctccaacaccaccaccgacagccgctgcccgacgcagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgacgaagctcgagggcaagaccgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggaccagcggggcctccaccagccaggagacctggaaccggaaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctcgtccagatcaagtacgagggcaccgacgccccctgcaagatccccttctccacccaggacgagaagggggtgacccagaacggccggctgatcacggccaacccgatcgtgaccgacaaggagaagctggtcaacatcgaggccgagccgcccttcggggagagctacatcgtgatcggcgcgggcgagaaggccctgaagctctcctggttcaagaaggggagctccatcggcaagatgttcgaggccaccgcccgcggggcccggcgcatggcgatcctgggcgacaccgcctgggacttcgggagcatcggcggcgtgttcacgtccgtcgggaagctggtgcaccagatcttcggcaccgcctacggggtgctgttcagcggcgtctcctggaccatgaagatcgggatcggcgtgctgctgacctggctcggcctgaacagccgctccacgagcctgtccatgacctgcatcgccgtggggctcgtcaccctgtacctgggcgtgatggtgcaggccgacagcgggtgcgtcatcaactggaagggccgggagctcaagtgcgggagcggcatcttcgtgaccaacgaggtgcacacgtggaccgagcagtacaagttccaggcggactcccccaagcgcctgagcgccgccatcggcaaggcctgggaggagggggtctgcggcatccggtccgccacccgcctggagaacatcatgtggaagcagatcagcaacgagctcaaccacatcctgctggagaacgacatgaagttcaccgtggtggtcggggacgtggcgggcatcctcgcccaggggaagaagatgatccggccgcagcccatggagtacaagtactcctggaagtcctggggcaaggccaagatcatcggcgccgacgtgcagaacaccacgttcatcatcgacgggcccaacacccccgagtgcccggacgaccagcgcgcgtggaacatctgggaggtcgaggactacggcttcgggatcttcaccaccaacatctggctgaagctgcgggacagctacacccaggtgtgcgaccaccgcctcatgagcgccgccatcaaggactccaaggccgtgcacgccgacatgggctactggatcgagagcgagaagaacgagacctggaagctggcgcgggcctccttcatcgaggtcaagacctgcatctggcccaagagccacaccctgtggtccaacggcgtgctcgagagcgagatgatcatccccaagatctacgggggccccatctcccagcacaactaccgcccggggtacttcacgcagaccgccggcccctggcacctggggaagctggagctcgacttcgacctgtgcgagggcaccaccgtggtcgtggacgagcactgcggcaaccgggggcccagcctgcgcacgaccaccgtgaccggcaagatcatccacgagtggtgctgccggtcctgcacgctcccgcccctgcgcttcaagggggaggacggctgctggtacgggatggagatccggcccgtcaaggagaaggaggagaacctggtgaagtccatggtgagcgccggctccggcgaggtcgacagcttctccctcgggctgctgtgcatcagcatcatgatcgaggaggtgatgcgctcccggtggagccgcaagatgctcatgaccggcaccctggccgtgttcttcctgctcatcatggggcagctgacctggaacgacctgatccggctctgcatcatggtcggcgcgaacgcctccgaccgcatggggatgggcacgacctacctggccctgatggccaccttcaagatgcgccccatgttcgccgtgggcctcctgttccggcgcctgaccagccgggaggtgctcctgctgacgatcgggctctccctggtcgcgagcgtggagctgccgaactccctcgaggagctgggcgacgggctggccatgggcatcatgatcctcaagctgctgaccgacttccagagccaccagctctgggccaccctgctgtccctcaccttcatcaagacgaccttcagcctgcactacgcctggaagaccatggcgatggtcctgtccatcgtgagcctcttccccctgtgcctgtccaccacgagccagaagaccacctggctccccgtgctgctgggctccctcgggtgcaagcccctgaccatgttcctgatcgccgagaaccgcatctggggccgcaagagctggccgctcaacgaggggatcatggccgtcggcatcgtgagcatcctgctgtccagcctcctgaagaacgacgtgcccctggccgggcccctcatcgccggcggcatgctgatcgcgtgctacgtcatctccgggagctccgccgacctgagcctcgagaaggccgccgaggtgtcctgggaggaggaggccgagcacagcggcgcgtcccacaacatcctggtggaggtccaggacgacgggacgatgaagatcaaggacgaggagcgcgacgacaccctgaccatcctcctgaaggccaccctgctcgccgtgagcggcgtgtaccccctgtccatcccggccaccctgttcgtctggtacttctggcagaagaagaagcagcggagcggggtgctctgggacacgcccagcccgcccgaggtggagcgcgccgtcctggacgacggcatctaccggatcatgcagcgcggcctgctggggcggagccaggtgggcgtgggggtcttccaggagaacgtgttccacaccatgtggcacgtgacccgcggcgcggtcctcatgtaccaggggaagcggctggagccgtcctgggccagcgtgaagaaggacctgatctcctacggcggcgggtggcgcctccagggcagctggaacaccggggaggaggtgcaggtcatcgccgtggagcccggcaagaaccccaagaacgtgcagacggcccccgggaccttcaagacctccgagggcgaggtcggcgccatcgcgctggacttcaagccggggaccagcggcagccccatcgtgaaccgggaggggaagatcgtgggcctgtacggcaacggggtcgtgacgacctccggcacctacgtgagcgccatcgcccaggccaaggcgtcccaggaggggcccctccccgagatcgaggacgaggtcttccgcaagcggaacctgaccatcatggacctgcacccgggcagcgggaagacgcgccggtacctccccgccatcgtgcgcgaggccatcaagcggaagctgcgcaccctgatcctcgcccccacccgcgtggtcgcctccgagatggcggaggccctgaagggcatgccgatccggtaccagaccacggccgtcaagagcgagcacaccggcaaggagatcgtggacctgatgtgccacgccaccttcaccatgcgcctcctgtcccccgtccgggtgcccaactacaacatgatcatcatggacgaggcccacttcacggaccccagctccatcgcggcccgcgggtacatcagcacccgggtgggcatgggggaggccgccgccatcttcatgaccgcgaccccgcccggctccgtcgaggccttcccccagagcaacgccgtgatccaggacgaggagcgcgacatccccgagcggtcctggaacagcgggtacgagtggatcacggacttcccgggcaagaccgtgtggttcgtcccctccatcaagagcggcaacgacatcgccaactgcctgcgcaagaacgggaagcgggtgatccagctctcccgcaagaccttcgacaccgagtaccagaagacgaagaacaacgactgggactacgtggtcaccaccgacatcagcgagatgggcgcgaacttccgggccgaccgcgtgatcgacccccggcgctgcctgaagcccgtgatcctgaaggacgggccggagcgggtcatcctcgccggccccatgcccgtgaccgtcgcctccgccgcgcagcgccgggggcgcatcggccggaaccacaacaaggagggcgaccagtacatctacatggggcagcccctgaacaacgacgaggaccacgcccactggacggaggccaagatgctgctcgacaacatcaacaccccggagggcatcatccccgccctgttcgagcccgagcgcgagaagtccgccgcgatcgacggggagtaccgcctgcggggcgaggcccgcaagaccttcgtggagctcatgcggcgcggggacctgcccgtgtggctgagctacaaggtcgcctccgagggcttccagtacagcgaccggcgctggtgcttcgacggcgagcggaacaaccaggtgctcgaggagaacatggacgtggagatctggaccaaggagggggagcgcaagaagctgcggccgcgctggctggacgcccggacgtactccgaccccctcgccctgcgcgagttcaaggagttcgcggccggccggcgcagcgtctccggggacctgatcctcgagatcggcaagctgccccagcacctgacccagcgggcccagaacgccctcgacaacctggtgatgctgcacaacagcgagcagggcgggcgcgcgtaccggcacgccatggaggagctccccgacaccatcgagaccctgatgctgctcgccctgatcgccgtgctgacgggcggggtcaccctcttcttcctgtccggccgcgggctgggcaagaccagcatcggcctcctgtgcgtgatggcctccagcgtgctgctctggatggcgtccgtcgagccgcactggatcgccgccagcatcatcctggagttcttcctgatggtgctcctgatccccgagcccgaccggcagcgcacgccccaggacaaccagctggcctacgtggtcatcgggctcctgttcatgatcctgaccgtggccgcgaacgagatgggcctcctggagacgaccaagaaggacctggggatcggccacgtggccgtcgagaaccaccaccacgccgccatgctcgacgtggacctgcacccggcctccgcgtggaccctgtacgccgtggccaccacgatcatcacccccatgatgcggcacaccatcgagaacaccacggccaacatcagcctcaccgccatcgcgaaccaggccgccatcctgatggggctggacaagggctggcccatctccaagatggacatcggcgtcccgctcctggccctggggtgctacagccaggtgaaccccctcaccctgaccgcggccgtgctgatgctcgtcgcccactacgccatcatcggccccgggctgcaggccaaggcgacgcgcgaggcccagaagcgcaccgccgccggcatcatgaagaaccccaccgtggacgggatcgtggccatcgacctggacccggtcgtgtacgacgcgaagttcgagaagcagctcggccagatcatgctgctgatcctctgcacctcccagatcctgctgatgcggacgacctgggccctctgcgagagcatcaccctggccaccggccccctgacgaccctctgggaggggtcccccggcaagttctggaacaccaccatcgccgtgagcatggccaacatcttccgcgggagctacctggcgggcgccggcctggccttctccctcatgaagtccctcgggggcgggcggcgcgggacgggggcccagggcgagaccctgggcgagaagtggaagcggcagctcaaccagctgtccaagagcgagttcaacacctacaagcgctccgggatcatggaggtcgaccggagcgaggcgaaggagggcctgaagcgcggggagaccacgaagcacgccgtgtcccggggcaccgccaagctccgctggttcgtggagcggaacctggtcaagcccgaggggaaggtgatcgacctgggctgcggccgcgggggctggagctactactgcgccgggctgaagaaggtgaccgaggtcaagggctacaccaagggcgggccgggccacgaggagcccatccccatggccacgtacgggtggaacctcgtgaagctgcactccggcaaggacgtgttcttcacgccgcccgagaagtgcgacaccctgctctgcgacatcggggagagctcccccaaccccaccatcgaggagggccggacgctgcgcgtcctgaagatggtggagccctggctccgggggaaccagttctgcatcaagatcctgaacccctacatgcccagcgtggtcgagaccctggagcagatgcagcgcaagcacggcggcatgctcgtgcggaaccccctgtcccgcaacagcacccacgagatgtactgggtgtcctgcgggaccggcaacatcgtcagcgcggtgaacatgacctcccggatgctgctcaaccgcttcacgatggcccaccgcaagcccacctacgagcgggacgtggacctgggggccggcacccgccacgtcgccgtggagccggaggtggccaacctggacatcatcggccagcggatcgagaacatcaagcacgagcacaagagcacctggcactacgacgaggacaacccctacaagacgtgggcgtaccacgggtcctacgaggtcaagcccagcggcagcgcctccagcatggtgaacggggtcgtgaagctcctgaccaagccctgggacgtgatcccgatggtcacccagatcgccatgaccgacacgacccccttcggccagcagcgcgtgttcaaggagaaggtggacacccggacccccaaggccaagcgcgggacggcccagatcatggaggtcaccgcgaagtggctgtggggcttcctctcccggaacaagaagccccgcatctgcacccgggaggagttcacccgcaaggtgcggagcaacgccgccatcggcgccgtgttcgtcgacgagaaccagtggaactccgcgaaggaggccgtggaggacgagcgcttctgggacctggtgcaccgggagcgcgagctgcacaagcaggggaagtgcgccacgtgcgtctacaacatgatgggcaagcgggagaagaagctcggggagttcggcaaggccaaggggagccgcgccatctggtacatgtggctgggcgcgcggttcctggagttcgaggccctcggcttcatgaacgaggaccactggttctcccgcgagaacagcctgtccggggtggagggcgaggggctgcacaagctcggctacatcctgcgggacatcagcaagatccccggcgggaacatgtacgccgacgacaccgccgggtgggacacccgcatcaccgaggacgacctgcagaacgaggccaagatcacggacatcatggagcccgagcacgcgctcctggccaagtccatcttcaagctgacctaccagaacaaggtggtccgggtgcagcgccccgccaagaacgggaccgtgatggacgtcatcagccgccgggaccagcgcggctccggccaggtgggcacctacggcctcaacacgttcaccaacatggaggcccagctgatccggcagatggagagcgaggggatcttctccccgagcgagctggagacccccaacctcgccggccgcgtgctggactggctggagaagcacggggtcgagcggctcaagcgcatggcgatctccggcgacgactgcgtggtgaagcccatcgacgaccggttcgccaccgccctgacggccctgaacgacatggggaaggtccgcaaggacatcccccagtgggagccgagcaagggctggaacgactggcagcaggtccccttctgcagccaccacttccaccagctcatcatgaaggacggccgggagatcgtggtcccctgccgcaaccaggacgagctggtggggcgggcccgcgtgtcccagggcgcggggtggagcctgcgggagaccgcctgcctcggcaagtcctacgcccagatgtggcagctgatgtacttccaccgccgggacctgcgcctcgccgcgaacgccatctgcagcgccgtccccgtggactgggtgccgacctcccggaccacgtggagcatccacgcccaccaccagtggatgaccaccgaggacatgctgtccgtctggaaccgcgtgtggatcgaggagaacccctggatggaggacaagacccacatcagctcctggggcgacgtgccctacctgggcaagcgggaggaccagtggtgcggcagcctcatcgggctgacggcccgcgcgacctgggccaccaacatccaggtcgccatcaaccaggtgcgccggctgatcggcaacgagaactacctcgactacatgacctccatgaagcgcttcaagaacgagagcgaccccgagggggccctgtggtga

SEQ ID NO: 8373 - RNA, 9879 nt, synthetic construct
  misc_feature 1..9879: note = derived and/or modified CDS sequence (opt1) from DENV-1__FJ432744__SS-prME
  source 1..9879: mol_type = other RNA
agcgtgaccatgctgctcatgctgatgcccaccgccctggccttccacctcaccacccgcggcggggagccccacatgatcgtgtccaagcaggagcggggcaagagcctgctgttcaagacctccgcgggggtgaacatgtgcaccctcatcgccatggacctgggggagttctgcgaggacacgatgacctacaagtgcccccgcatcaccgaggccgagcccgacgacgtggactgctggtgcaacgccaccgacacgtgggtcacctacgggacctgcagccagaccggggagcaccggcgcgacaagcggtccgtggccctggcgccccacgtgggcctcgggctggagacgcgcaccgagacctggatgagctccgagggcgcctggaagcagatccagcgggtcgagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagaccgtccagtacgagaacctgaagtacagcgtgatcgtgaccgtccacacgggcgaccagcaccaggtggggaacgagtccaccgagcacggcaccaccgcgaccatcacgccccaggcccccagcaccgagatccagctgaccgactacggggccctcaccctggactgcagcccccgcacgggcctggacttcaacgagatggtcctcctgaccatgaaggagaaggcctggctggtgcacaagcagtggttcctcgacctgccgctgccctggaccagcggggccagcacctcccaggagacgtggaaccggaaggacctcctggtgaccttcaagaccgcgcacgccaagaagcaggaggtcgtggtgctgggcagccaggagggcgccatgcacaccgccctcacgggggccaccgagatccagacctccggcaccacgaccatcttcgcggggcacctgaagtgccgcctgaagatggacaagctcaccctgaagggcatgagctacgtcatgtgcaccgggtccttcaagctggagaaggaggtggccgagacgcagcacggcaccgtgctcgtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggcggagccgcccttcggggagtcctacatcgtgatcggcgccggcgagaaggccctgaagctgagctggttcaagaaggggtccagcatcggcaagatgttcgaggccaccgcccgcggggcgcggcgcatggccatcctcggcgacacggcctgggacttcgggtccatcggcggcgtgttcaccagcgtcgggaagctggtgcaccagatcttcggcaccgcctacggggtgctgttctccggcgtcagctggaccatgaagatcgggatcggcgtgctcctgacgtggctgggcctcaactcccgcagcacctccctgagcatgacctgcatcgccgtggggctggtcaccctctacctgggcgtgatggtgcaggcggactccgggtgcgtcatcaactggaagggccgggagctgaagtgcgggagcggcatcttcgtgacgaacgaggtgcacacctggaccgagcagtacaagttccaggccgacagcccgaagcgcctctccgccgccatcggcaaggcctgggaggagggggtctgcggcatccggagcgcgacccgcctggagaacatcatgtggaagcagatctccaacgagctgaaccacatcctcctggagaacgacatgaagttcaccgtggtggtcggggacgtggccggcatcctggcccaggggaagaagatgatccggccccagcccatggagtacaagtacagctggaagtcctggggcaaggccaagatcatcggcgcggacgtgcagaacgccacgttcatcatcgacgggcccaacaccccggagtgccccgacgaccagcgcgcctggaacatctgggaggtcgaggactacggcttcgggatcttcaccaccaacatctggctcaagctgcgggacagctacacccaggtgtgcgaccaccgcctgatgtccgccgccatcaaggacagcaaggcggtgcacgccgacatgggctactggatcgagtccgagaagaacgagacgtggaagctcgcccgggccagcttcatcgaggtcaagacctgcatctggcccaagtcccacaccctgtggagcaacggcgtgctggagtccgagatgatcatccccaagatctacgggggcccgatcagccagcacaactaccgccccgggtacttcacgcagaccgccggcccctggcacctcgggaagctggagctggacttcgacctctgcgagggcaccaccgtggtcgtggacgagcactgcggcaaccgggggccgtccctgcgcacgaccaccgtgaccggcaagatcatccacgagtggtgctgccggagctgcacgctgccgcccctgcgcttcaagggggaggacggctgctggtacgggatggagatccggcccgtcaaggagaaggaggagaacctggtgaagtccatggtgagcgcgggcagcggcgaggtcgactccttcagcctggggctcctgtgcatctccatcatgatcgaggaggtgatgcgcagccggtggtcccgcaagatgctgatgaccggcatcctcgccgtgttcttcctgctgatcatggggcagctcacctggaacgacctgatccggctgtgcatcatggtcggcgccaacgccagcgaccgcatggggatgggcaccacgtacctcgccctgatggcgaccttcaagatgcgcccgatgttcgccgtgggcctcctgttccggcgcctgacctcccgggaggtgctgctcctgaccatcgggctgagcctcgtcgcctccgtggagctgcccaacagcctggaggagctcggcgacgggctggccatgggcatcatgatcctgaagctcctgacggacttccagtcccaccagctgtgggcgaccctcctgagcctgaccttcatcaagaccacgttctccctccactacgcctggaagaccatggccatggtcctgagcatcgtgtccctgttccccctctgcctgagcaccacctcccagaagacgacctggctgcccgtgctcctgggcagcctggggtgcaagccgctcaccatgttcctgatcgccgagaacaagatctggggccgcaagtcctggcccctgaacgaggggatcatggccgtcggcatcgtgagcatcctcctgagctccctgctcaagaacgacgtgcccctggcggggcccctgatcgccggcggcatgctcatcgcctgctacgtcatcagcgggtccagcgccgacctgtccctggagaaggccgcggaggtgagctgggaggaggaggccgagcactccggcgccagccacaacatcctcgtggaggtccaggacgacgggaccatgaagatcaaggacgaggagcgggacgacacgctgaccatcctgctcaaggccaccctgctggccgtgtccggcgtgtacccgctcagcatccccgcgaccctgttcgtctggtacttctggcagaagaagaagcgccggtccggggtgctgtgggacaccccctccccgcccgaggtggagcgcgccgtcctcgacgacggcatctaccggatcatgcagcgcggcctgctggggcggtcccaggtgggcgtgggggtcttccaggagaacgtgttccacacgatgtggcacgtgacccgcggcgccgtcctgatgtaccaggggaagcggctcgagcccagctgggcctccgtgaagaaggacctgatcagctacggcggcgggtggcgcctgcagggctcctggaacaccggggaggaggtgcaggtcatcgccgtggagcccggcaagaaccccaagaacgtgcagaccgcgcccgggacgttcaagaccagcgagggcgaggtcggcgccatcgccctcgacttcaagcccgggacctccggcagccccatcgtgaaccgggaggggaagatcgtgggcctgtacggcaacggggtcgtgaccacgagcggcacctacgtgtccgccatcgcgcaggccaaggccagccaggaggggcccctgccggagatcgaggacgaggtcttccgcaagcggaacctcaccatcatggacctgcaccccggctccgggaagacccgccggtacctgcccgccatcgtgcgcgaggccatcaagcggaagctccgcacgctgatcctggcgccgacccgcgtggtcgccagcgagatggccgaggccctcaagggcatgcccatccggtaccagaccaccgccgtgaagtccgagcacacgggcaaggagatcgtggacctgatgtgccacgcgaccttcaccatgcgcctgctcagccccgtccgggtgcccaactacaacatgatcatcatggacgaggcccacttcaccgacccgtccagcatcgccgcccgcgggtacatctccacgcgggtgggcatgggggaggccgcggccatcttcatgaccgccacgccgcccggcagcgtcgaggccttcccccagtccaacgcggtgatccaggacgaggagcgcgacatcccggagcggagctggaactccgggtacgagtggatcaccgacttccccggcaagacggtgtggttcgtccccagcatcaagtccggcaacgacatcgccaactgcctgcgcaagaacgggaagcgggtgatccagctgagccgcaagaccttcgacaccgagtaccagaagaccaagaacaacgactgggactacgtggtcacgaccgacatctccgagatgggcgccaacttccgggccgaccgcgtgatcgacccccggcgctgcctcaagccggtgatcctgaaggacgggcccgagcgggtcatcctggccggccccatgcccgtgaccgtcgcgagcgccgcccagcgccgggggcgcatcggccggaaccacaacaaggagggcgaccagtacatctacatggggcagccgctcaacaacgacgaggaccacgcccactggaccgaggccaagatgctgctggacaacatcaacacgcccgagggcatcatccccgccctcttcgagcccgagcgcgagaagtccgccgccatcgacggggagtaccgcctgcggggcgaggcccgcaagaccttcgtggagctgatgcggcgcggggacctcccggtgtggctgagctacaaggtcgccagcgagggcttccagtactccgaccggcgctggtgcttcgacggcgagcggaacaaccaggtgctggaggagaacatggacgtggagatctggaccaaggagggggagcgcaagaagctccggccccgctggctggacgcgcggacctacagcgaccccctggccctccgcgagttcaaggagttcgccgccggccggcgctccgtcagcggggacctgatcctggagatcggcaagctcccccagcacctgacgcagcgggcgcagaacgccctggacaacctcgtgatgctgcacaactccgagcagggcgggcgcgcctaccggcacgccatggaggagctgccggacaccatcgagaccctcatgctgctggccctcatcgcggtgctgaccggcggggtcacgctgttcttcctcagcggccgcgggctgggcaagacctccatcggcctgctctgcgtgatggccagctccgtgctgctgtggatggccagcgtcgagccccactggatcgccgcctccatcatcctcgagttcttcctgatggtgctgctcatccccgagcccgaccggcagcgcaccccgcaggacaaccagctggcgtacgtggtcatcgggctcctcttcatgatcctgaccgtggccgccaacgagatgggcctgctcgagaccacgaagaaggacctggggatcggccacgtggccgtcgagaaccaccaccacgccgcgatgctggacgtggacctccaccccgccagcgcctggaccctgtacgccgtggccaccaccatcatcacgcccatgatgcggcacaccatcgagaacaccaccgcgaacatctccctgacggccatcgccaaccaggccgcgatcctcatggggctggacaagggctggccgatcagcaagatggacatcggcgtccccctgctcgccctggggtgctactcccaggtgaaccccctgaccctcaccgccgccgtgctgatgctggtcgcccactacgcgatcatcggccccgggctccaggccaaggccacccgcgaggcccagaagcgcacggccgcgggcatcatgaagaacccgaccgtggacgggatcgtggccatcgacctggaccccgtcgtgtacgacaccaagttcgagaagcagctgggccagatcatgctcctgatcctgtgcaccagccagatcctcctgatgcggacgacctgggccctgtgcgagtccatcaccctcgccaccggccccctgacgaccctgtgggaggggagccccggcaagttctggaacaccaccatcgccgtgtccatggcgaacatcttccgcgggagctacctcgccggcgccggcctggccttcagcctgatgaagtccctcgggggcgggcggcgcggcacgggggcgcagggcgagaccctgggcgagaagtggaagcggcagctgaaccagctcagcaagtccgagttcaacacctacaagcgcagcgggatcatggaggtcgaccggtccgaggccaaggagggcctgaagcgcggggagaccacgaagcacgccgtgagccggggcaccgccaagctgcgctggttcgtggagcggaacctcgtcaagccggaggggaaggtgatcgacctgggctgcggccgcgggggctggtcctactactgcgccgggctgaagaaggtgaccgaggtcaagggctacaccaagggcgggcccggccacgaggagcccatccccatggcgacgtacgggtggaacctggtgaagctccacagcggcaaggacgtgttcttcatcccgcccgagaagtgcgacaccctgctgtgcgacatcggggagtccagccccaaccccaccatcgaggagggccggaccctccgcgtcctgaagatggtggagccgtggctgcgggggaaccagttctgcatcaagatcctcaacccctacatgccctccgtggtcgagacgctggagcagatgcagcgcaagcacggcggcatgctggtgcggaaccccctcagccgcaactccacccacgagatgtactgggtgagctgcgggaccggcaacatcgtctccgccgtgaacatgaccagccggatgctgctgaaccgcttcaccatggcccaccgcaagccgacgtacgagcgggacgtggacctcggggccggcacccgccacgtcgccgtggagcccgaggtggcgaacctggacatcatcggccagcggatcgagaacatcaagcacgagcacaagtccacctggcactacgacgaggacaacccctacaagacctgggcctaccacgggagctacgaggtcaagccctccggcagcgccagctccatggtgaacggggtcgtgaagctgctcacgaagccgtgggacgtgatccccatggtcacccagatcgccatgaccgacaccacgcccttcggccagcagcgcgtgttcaaggagaaggtggacacccggacccccaaggccaagcgcgggaccgcgcagatcatggaggtcacggccaagtggctgtggggcttcctgagccggaacaagaagccgcgcatctgcacccgggaggagttcacccgcaaggtgcggtccaacgccgccatcggcgcggtgttcgtcgacgagaaccagtggaacagcgccaaggaggccgtggaggacgagcgcttctgggacctcgtgcaccgggagcgcgagctgcacaagcaggggaagtgcgcgacctgcgtctacaacatgatgggcaagcgggagaagaagctgggggagttcggcaaggccaaggggtcccgcgcgatctggtacatgtggctcggcgcccggttcctggagttcgaggccctgggcttcatgaacgaggaccactggttcagccgcgagaactccctcagcggggtggagggcgaggggctgcacaagctgggctacatcctccgggacatctccaagatccccgggggcaacatgtacgccgacgacacggccggctgggacacccgcatcaccgaggacgacctgcagaacgaggcgaagatcaccgacatcatggagcccgagcacgccctgctcgccaagagcatcttcaagctgacgtaccagaacaaggtggtccgggtgcagcgcccggccaagaacgggaccgtgatggacgtcatctcccgccgggaccagcgcggcagcggccaggtgggcacctacggcctgaacaccttcacgaacatggaggcccagctcatccggcagatggagtccgaggggatcttcagcccctccgagctggagacccccaacctggcgggccgcgtgctcgactggctggagaagcacggggtcgagcggctgaagcgcatggccatcagcggcgacgactgcgtggtgaagcccatcgacgaccggttcgccaccgccctcaccgccctgaacgacatggggaaggtccgcaaggacatcccgcagtgggagccctccaagggctggaacgactggcagcaggtccccttctgcagccaccacttccaccagctgatcatgaaggacggccgggagatcgtggtcccctgccgcaaccaggacgagctcgtggggcgggcgcgcgtgagccagggcgccgggtggtccctgcgggagacggcctgcctgggcaagagctacgcccagatgtggcagctcatgtacttccaccgccgggacctgcgcctggcggccaacgccatctgctccgccgtcccggtggactgggtgcccaccagccggaccacctggtccatccacgcccaccaccagtggatgacgaccgaggacatgctcagcgtctggaaccgcgtgtggatcgaggagaacccctggatggaggacaagacccacatctccagctggggcgacgtgccctacctgggcaagcgggaggaccagtggtgcggctccctgatcgggctcaccgcgcgcgccacgtgggccaccaacatccaggtcgccatcaaccaggtgcgccggctgatcggcaacgagaactacctggactacatgaccagcatgaagcgcttcaagaacgagatcgacccggagggggccctctggtga

SEQ ID NO: 8374 - RNA, 9879 nt, synthetic construct
  misc_feature 1..9879: note = derived and/or modified CDS sequence (opt1) from DENV-1__FJ547060__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgccggggtgaacatgtgcaccctcatcgccatggacctgggggagctgtgcgaggacaccatgacctacaagtgcccccggatcaccgaggccgagcccgacgacgtggactgctggtgcaacgccaccgacacctgggtgacctacgggacctgcagccagacgggggagcaccggcgcgacaagcggagcgtggccctcgcgccccacgtgggcctggggctggagacccgcaccgagacctggatgtccagcgagggcgcctggaagcagatccagcgggtggagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtggggaagctggtccaccagatcttcggcaccgcctacggggtcctgttctccggcgtgagctggaccatgaagatcgggatcggcgtcctgctgacgtggctcggcctgaactcccgcagcacctccctgagcatgacctgcatcgccgtggggctcgtgaccctgtacctgggcgtcatggtgcaggccgactccgggtgcgtgatcaactggaagggccgggagctcaagtgcgggagcggcatcttcgtcacgaacgaggtgcacacctggaccgagcagtacaagttccaggcggacagcccgaagcgcctgtccgccgccatcggcaaggcctgggaggagggggtgtgcggcatccggagcgccacccgcctggagaacatcatgtggaagcagatctccaacgagctcaaccacatcctgctggagaacgacatgaagttcaccgtcgtggtgggggacgtcgtgggcatcctcgcgcaggggaagaagatgatccggccccagcccatggagcacaagtacagctggaagtcctggggcaaggccaagatcatcggcgccgacgtgcagaacacgaccttcatcatcgacgggcccaacaccccggagtgccccgacgaccagcgcgcctggaacatctgggaggtcgaggactacggcttcgggatcttcaccacgaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacctgcatctggcccaagtcccacacgctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcaccacggtggtcgtggacgagcactgcggcaaccgggggccgtccctgcgcaccaccaccgtgacgggcaagatcatccacgagtggtgctgccggagctgcaccctgccgcccctccgcttcaagggggaggacggctgctggtacgggatggagatccggcccgtcaaggagaaggaggagaacctggtgaagtccatggtgagcgccggcagcggcgaggtcgactccttcagcctcgggctgctgtgcatctccatcatgatcgaggaggtgatgcgcagccggtggtcccgcaagatgctcatgaccggcaccctggccgtgttcctgctcctgatcatggggcagctgacgtggaacgacctcatccggctgtgcatcatggtcggcgccaacgcgagcgaccgcatggggatgggcaccacctacctggccctcatggccaccttcaagatgcgcccgatgttcgccgtgggcctgctgttccggcgcctcacgtcccgggaggtgctgctgctcaccatcgggctgagcctggtcgcctccgtggagctccccaacagcctggaggagctgggcgacgggctcgcgatgggcatcatgatcctgaagctgctcaccgacttccagtcccaccagctgtgggccaccctgctcagcctgacgttcatcaagaccaccctgtccctccactacgcctggaagaccatggccatggtcctgagcatcgtgtccctgttccccctctgcctgagcacgacctcccagaagaccacctggctgcccgtgctcctgggcagcctggggtgcaagccgctcacgatgttcctgatcgcggagaacaagatctggggccgcaagtcctggcccctgaacgaggggatcatggccgtcggcgtggtgagcatcctcctgagctccctgctcaagaacgacgtccccctggccgggcccctgatcgccggcggcatgctcatcgcctgctacgtgatcagcgggtccagcgcggacctgtccctggagaaggccgccgaggtgagctgggaggaggaggccgagcactccggcgccagccacaacatcctcgtcgaggtgcaggacgacgggaccatgaagatcaaggacgaggagcgggacgacaccctgaccatcctgctcaaggcgaccctgctggccgtgtccggcgtctacccgctcagcatccccgccacgctgttcgtgtggtacttctggcagaagaagaagcagcgctccggggtgctgtgggacacccccagcccgcccgaggtcgagcgggccgtgctggacgacggcatctaccgcatcatgcagcggggcctcctggggcgctcccaggtgggcgtcggggtgttccaggagaacgtgttccacaccatgtggcacgtcacccggggcgccgtgctgatgtaccaggggaagcgcctcgagcccagctgggcgtccgtgaagaaggacctgatcagctacggcggcgggtggcggctgcagggctcctggaacacgggggaggaggtccaggtgatcgccgtggagcccggcaagaaccccaagaacgtccagaccgcccccgggaccttcaagacccccgagggcgaggtgggcgccatcgccctcgacttcaagcccgggacgagcggctcccccatcgtgaaccgcgaggggaagatcgtcggcctgtacggcaacggggtggtgaccaccagcggcacctacgtcagcgcgatcgcccagacgaaggcctcccaggaggggccgctgcccgagatcgaggacgaggtgttccggaagcgcaacctcaccatcatggacctgcaccccggcagcgggaagacccggcgctacctgccggccatcgtgcgggaggcgatcaagcgcaagctccggaccctgatcctggcccccacgcgcgtcgtggcctccgagatggccgaggccctcaagggcatgcccatccgctaccagaccaccgcggtcaagagcgagcacaccggcaaggagatcgtcgacctgatgtgccacgccacgttcaccatgcggctgctctcccccgtgcgcgtgccgaactacaacatgatcatcatggacgaggcccacttcaccgaccccagctccatcgccgcccgggggtacatcagcacccgcgtcggcatgggggaggcggccgccatcttcatgacggccacgccgcccggctccgtggaggccttcccgcagagcaacgcggtgatccaggacgaggagcgggacatccccgagcgctcctggaacagcgggtacgagtggatcaccgacttccccggcaagaccgtctggttcgtgccctccatcaagagcggcaacgacatcgccaactgcctgcggaagaacgggaagcgcgtgatccagctgtcccggaagacgttcgacaccgagtaccagaagaccaagaacaacgactgggactacgtcgtgaccacggacatcagcgagatgggcgccaacttccgcgccgaccgggtgatcgacccgcgccggtgcctcaagcccgtcatcctgaaggacgggcccgagcgcgtgatcctggcgggccccatgccggtcaccgtggcctccgccgcccagcggcgcgggcggatcggccgcaaccacaacaaggagggcgaccagtacatctacatggggcagcccctcaacaacgacgaggaccacgcccactggaccgaggcgaagatgctgctggacaacatcaacacccccgagggcatcatccccgccctcttcgagccggagcgggagaagtccgccgccatcgacggggagtaccgcctgcgcggcgaggcccggaagacgttcgtggagctgatgcgccgcggggacctccccgtctggctgtcctacaaggtggcgagcgagggcttccagtacagcgaccgccggtggtgcttcgacggcgagcgcaacaaccaggtgctggaggagaacatggacgtcgagatctggaccaaggagggggagcggaagaagctccgcccccggtggctggacgcccgcacctactccgaccccctggccctccgggagttcaaggagttcgccgccggccgccggagcgtgtccggggacctgatcctggagatcggcaagctcccgcagcacctgacccagcgcgcgcagaacgccctggacaacctcgtgatgctgcacaacagcgagcagggcgggcgggcctaccgccacgccatggaggagctgcccgacacgatcgagaccctcatgctgctggcgctcatcgccgtcctgaccggcggggtgaccctgttcttcctctccggccgggggctgggcaagaccagcatcggcctgctctgcgtgatggcctccagcgtcctgctgtggatggcctccgtggagccccactggatcgccgcgagcatcatcctcgagttcttcctgatggtgctgctcatccccgagccggaccgccagcggacgccccaggacaaccagctggcctacgtcgtgatcgggctcctcttcatgatcctgaccgtggccgccaacgagatgggcctgctcgagaccaccaagaaggacctggggatcggccacgtcgccgtggagaaccaccaccacgcgacgatgctggacgtggacctccaccccgcctccgcctggaccctgtacgccgtcgccaccaccatcatcacgccgatgatgcgccacaccatcgagaacaccaccgcgaacatcagcctgacggccatcgccaaccaggccgccatcctcatggggctggacaagggctggcccatctccaagatggacatcggcgtgcccctgctcgcgctggggtgctacagccaggtgaaccccctgaccctcaccgccgccgtcctgatgctggtggcccactacgcgatcatcggcccggggctccaggccaaggccacccgggaggcccagaagcgcacggccgcgggcatcatgaagaaccccaccgtggacgggatcgtcgccatcgacctggaccccgtggtgtacgacgccaagttcgagaagcagctgggccagatcatgctcctgatcctgtgcacctcccagatcctcctgatgcgcaccacgtgggccctgtgcgagagcatcaccctcgccaccggccccctgaccacgctgtgggaggggtccccgggcaagttctggaacaccaccatcgcggtcagcatggccaacatcttccgggggtcctacctcgccggcgccggcctggccttcagcctgatgaagtccctcgggggcgggcgccggggcaccggggcgcagggcgagacgctgggcgagaagtggaagcgccagctgaaccagctctccaagagcgagttcaacatctacaagcggtccgggatcatggaggtggaccgcagcgaggccaaggagggcctgaagcgcggggagaccacccgccacgccgtgtcccggggcaccgccaagctgcgctggttcgtcgagcggaacctggtgaagcccgaggggaaggtgatcgacctcggctgcggccgcgggggctggagctactactgcgcggggctgaagaaggtcacggaggtgaagggctacaccaagggcgggcccggccacgaggagcccatcccgatggccacctacgggtggaacctggtgaagctccactccggcaaggacgtcttcttcacgccgcccgagaagtgcgacacgctgctgtgcgacatcggggagagctcccccaacccgaccatcgaggagggccggaccctccgcgtgctgaagatggtggagccctggctgcgggggaaccagttctgcatcaagatcctcaacccctacatgcccagcgtcgtggagaccctggagcagatgcagcgcaagcacggcggcatgctggtgcggaacccgctctcccgcaacagcacccacgagatgtactgggtctcctgcgggacgggcaacatcgtgagcgccgtgaacatgacctcccggatgctgctgaaccgcttcaccatggcccaccgcaagcccacctacgagcgggacgtcgacctcggggccggcacgcgccacgtggcggtggagcccgaggtcgccaacctggacatcatcggccagcggatcgagaacatcaagcacgagcacaagagcacctggcactacgacgaggacaacccctacaagacctgggcctaccacgggtcctacgaggtgaagccgagcggctccgccagcagcatggtcaacggggtggtgaagctgctcaccaagccctgggacgtcatccccatggtgacgcagatcgccatgaccgacaccacccccttcggccagcagcgcgtgttcaaggagaaggtcgacacgcggaccccgaaggcgaagcgcgggaccgcccagatcatggaggtgaccgcccggtggctgtggggcttcctgtcccgcaacaagaagccccggatctgcacgcgcgaggagttcacccggaaggtgcgcagcaacgccgccatcggcgcggtcttcgtggacgagaaccagtggaactccgccaaggaggccgtggaggacgagcggttctgggacctcgtccagaaggagcgcgagctgcacaagcaggggaagtgcgcgacctgcgtgtacaacatgatgggcaagcgggagaagaagctgggggagttcggcaaggcgaaggggagccgcgccatctggtacatgtggctcggcgcccggttcctggagttcgaggccctgggcttcatgaacgaggaccactggttctcccgcgagaacagcctctccggggtggagggcgaggggctgcacaagctgggctacatcctccgggacatcagcaagatccccgggggcaacatgtacgccgacgacaccgcgggctgggacacgcgcatcaccgaggacgacctgcagaacgaggccaagatcaccgacatcatggagccggagcacgccctgctcgccacctccatcttcaagctgacgtaccagaacaaggtcgtgcgggtgcagcgccccgccaagaacgggaccgtcatggacgtgatcagccgccgggaccagcgcggctccggccaggtgggcacctacggcctgaacaccttcacgaacatggaggcgcagctcgtccggcagatggagagcgaggggatcttctccccctgcgagctggagatccccaacctggccgagcgcgtgctcgactggctggagaagtacggcgtggagcggctgaagcgcatggccatcagcggggacgactgcgtcgtgaagccgatcgacgaccggttcgccaccgccctcaccgcgctgaacgacatgggcaaggtgcgcaaggacgtcccccagtgggagccctccaaggggtggaacgactggcagcaggtccccttctgcagccaccacttccaccagctgatcatgaaggacggccgggagatcgtggtcccgtgccgcaaccaggacgagctcgtgggccgggcccgcgtgtcccagggggccggctggagcctgcgggagaccgcctgcctgggcaagagctacgcccagatgtggcagctcatgtacttccaccgccgggacctgcgcctggcggccaacgccatctgctccgccgtccccgtggactgggtgcccacgagccggaccacctggtccatccacgcgcaccaccagtggatgaccacggaggacatgctcagcgtctggaaccgcgtgtggatcgaggagaacccctggatggaggacaagacccacgtgtccagctggggcgacgtcccgtacctggggaagcgggaggaccagtggtgcggctccctgatcggcctcaccgcccgcgccacctgggccagcaacatccaggtggccatcaaccaggtgcgccggctgatcgggaacgagaactacctggactacatgacctccatgaagcgcttcaagaacgagggcgaccccgagggggcgctctggtga

SEQ ID NO: 8375 - RNA, 9879 nt, synthetic construct
  misc_feature 1..9879: note = derived and/or modified CDS sequence (opt1) from DENV-1__FJ432745__SS-prME
  source 1..9879: mol_type = other RNA
agcgtgaccatgctgctcatgctgatgcccaccgccctggccttccacctcaccacccggggcggggagccccacatggtggtgagcaagcaggagcggggcaagagcctgctgttcaagaccagcgcgggggtgaacatgtgcaccctcatcgccatggacctgggcgagctgtgcgaggacaccatgacctacaagtgcccccggatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtggagacctgggccctccgccaccccgggttcacggtgatcgccctgttcctggcgcacgccatcggcaccagcatcacccagaaggggatcatcttcatcctcctgatgctggtcaccccctccatggccatgcggtgcgtgggcatcggcagccgcgacttcgtggaggggctctccggcgccacgtgggtcgacgtggtgctggagcacgggagctgcgtcaccaccatggccaaggacaagcccaccctggacatcgagctcctgaagacggaggtgaccaaccccgcgatcctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtcctgttctccggcgtcagctggaccatgaagatcgggctgggcgtgctgctcacgtggctgggcctgaactcccgcagcacctccctcagcatgacctgcatcgccgtggggctggtcaccctgtacctcggcgtgatggtgcaggccgactccgggtgcgtcatcaactggaagggccgggagctgaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctcgagaacgtgatgtggaagcagatctccaacgagctgaaccacatcctgctcgagaacgacatgaagttcaccgtggtcgtgggggacgtggcgggcatcctggcccaggggaagaagatgatccggccccagcccatggagtacaagtacagctggaagtcctggggcaaggccaagatcatcggcgccgacgtccagaacacgaccttcatcatcgacgggcccaacaccccggagtgccccgacgaccagcgcgcgtggaacatctgggaggtggaggactacggcttcgggatcttcaccacgaacatctggctgaagctccgggacagctacacccaggtgtgcgaccaccgcctgatgtccgccgccatcaaggacagcaaggccgtccacgccgacatgggctactggatcgagtccgagaagaacgagacctggaagctggcgcgggccagcttcatcgaggtgaagacctgcatctggcccaagtcccacacgctctggagcaacggcgtgctggagtccgagatgatcatccccaagatctacgggggcccgatcagccagcacaactaccgccccgggtacttcacccagaccgccggcccctggcacctggggaagctcgagctggacttcgacctgtgcgagggcaccacggtcgtggtggacgagcactgcggcaaccgggggccgtccctccgcaccaccaccgtcacgggcaagatcatccacgagtggtgctgccggagctgcaccctgccgcccctgcgcttccgcggggaggacggctgctggtacgggatggagatccgccccgtgaaggagaaggaggagaacctcgtgaagtccatggtcagcgccggcagcggcgaggtggactccttcagcctggggctgctctgcatctccatcatgatcgaggaggtgatgcggagccgctggtcccggaagatgctgatgaccggcaccctggccgtcttcctcctgctgatcatggggcagctcacgtggaacgacctgatccgcctgtgcatcatggtgggcgcgaacgccagcgaccgcatggggatgggcaccacctacctcgccctgatggccaccttcaagatgcggccgatgttcgccgtggggctcctgttccgccggctgacgtcccgcgaggtcctgctcctgaccatcgggctgagcctcgtggcgtccgtcgagctgcccaacagcctggaggagctcggcgacgggctggccatgggcatcatgatcctgaagctcctgaccgacttccagtcccaccagctgtgggccaccctcctgagcctgacgttcatcaagaccaccttctccctccactacgcctggaagaccatggcgatggtgctgagcatcgtgtccctgttccccctctgcctgagcacgacctcccagaagaccacctggctgcccgtcctcctgggcagcctggggtgcaagccgctcacgatgttcctgatcgccgagaacaagatctggggccggcgctcctggcccctgaacgaggggatcatggccgtgggcatcgtgagcatcctcctgagctccctgctcaagaacgacgtccccctggccgggcccctgatcgccggcggcatgctcatcgcgtgctacgtgatcagcgggtccagcgccgacctgtccctggagaaggccgccgaggtgagctgggaggaggaggccgagcactccggcgcgagccacaacatcctcgtcgaggtgcaggacgacgggaccatgaagatcaaggacgaggagcgggacgacaccctgaccatcctgctcaaggccaccctgctggccgtgtccggcgtctacccgctcagcatccccgccacgctgttcgtgtggtacttctggcagaagaagaagcagcgctccggggtgctgtgggacacccccagcccgcccgaggtcgagcgggccgtgctggacgacggcatctaccgcatcatgcagcggggcctcctggggcgctcccaggtgggcgtcggggtgttccaggagaacgtgttccacaccatgtggcacgtcacccggggcgcggtgctgatgtaccaggggaagcgcctcgagcccagctgggcctccgtgaagaaggacctgatcagctacggcggcgggtggcggctgcagggctcctggaacacgggggaggaggtccaggtgatcgccgtggagcccggcaagaaccccaagaacgtccagaccgcccccgggaccttcaagacccccgagggcgaggtgggcgccatcgcgctcgacttcaagcccgggacgagcggctcccccatcgtgaaccgcgaggggaagatcgtcggcctgtacggcaacggggtggtgaccaccagcggcacctacgtcagcgccatcgcccaggccaaggcgtcccaggaggggccgctgcccgagatcgaggacgaggtgttccggaagcgcaacctcacgatcatggacctgcaccccggcagcgggaagacccggcgctacctgccggccatcgtgcgggaggccatcaagcgcaagctccgcaccctgatcctggcccccacccgggtcgtggcctccgagatggcggaggccctcaagggcatgcccatccgctaccagacgaccgccgtcaagagcgagcacaccggcaaggagatcgtcgacctgatgtgccacgccaccttcacgatgcggctgctctcccccgtgcgcgtgccgaactacaacatgatcatcatggacgaggcccacttcaccgaccccagctccatcgcggcccgggggtacatcagcacccgcgtcggcatgggggaggccgccgccatcttcatgaccgcgacgccgcccggctccgtggaggccttcccgcagagcaacgccgtgatccaggacgaggagcgggacatccccgagcgctcctggaacagcgggtacgagtggatcaccgacttccccggcaagaccgtctggttcgtgccctccatcaagagcggcaacgacatcgccaactgcctgcggaagaacgggaagcgcgtgatccagctgtcccggaagaccttcgacacggagtaccagaagaccaagaacaacgactgggactacgtcgtgaccaccgacatcagcgagatgggcgcgaacttccgcgccgaccgggtgatcgacccgcgccggtgcctcaagcccgtcatcctgaaggacgggcccgagcgcgtgatcctggccggccccatgccggtcacggtggcctccgccgcgcagcggcgcgggcggatcggccgcaaccacaacaaggagggcgaccagtacatctacatggggcagcccctcaacaacgacgaggaccacgcccactggaccgaggccaagatgctgctggacaacatcaacacccccgagggcatcatccccgccctcttcgagccggagcgcgagaagtccgccgcgatcgacggggagtaccggctgcgcggcgaggcccggaagaccttcgtggagctgatgcgccgcggggacctccccgtctggctgtcctacaaggtggccagcgagggcttccagtacagcgaccgccggtggtgcttcgacggcgagcgcaacaaccaggtgctggaggagaacatggacgtcgagatctggacgaaggagggggagcggaagaagctccgcccccggtggctggacgcccgcacctactccgaccccctggccctccgggagttcaaggagttcgcggccggccgccggagcgtgtccggggacctgatcctggagatcggcaagctcccgcagcacctgacccagcgcgcccagaacgccctggacaacctcgtgatgctgcacaacagcgagcagggcgggcgggcgtaccgccacgccatggaggagctgcccgacaccatcgagacgctcatgctgctggccctcatcgccgtcctgaccggcggggtgaccctgttcttcctctccggccgggggctgggcaagaccagcatcggcctgctctgcgtgatggcctccagcgtcctgctgtggatggcgtccgtggagccccactggatcgccgccagcatcatcctcgagttcttcctgatggtgctgctcatccccgagccggaccgccagcggacgccccaggacaaccagctggcctacgtcgtgatcgggctcctcttcatgatcctgacggtggccgcgaacgagatgggcctgctcgagaccaccaagaaggacctggggatcggccacgccgccgtcgggaaccaccaccacgccgccatgctggacgtggacctccaccccgcgtccgcctggaccctgtacgccgtggccacgaccatcatcaccccgatgatgcgccacaccatcgagaacacgaccgccaacatcagcctgaccgcgatcgccaaccaggccgccatcctcatgggcctggacaagggctggcccatctccaagatggacatcggggtccccctgctcgcgctgggctgctacagccaggtgaaccccctgaccctcacggccgccgtgctgatgctggtcgcccactacgccatcatcgggccgggcctccaggcgaaggccacccgcgaggcccagaagcggaccgccgccgggatcatgaagaaccccaccgtggacggcatcgtggcgatcgacctggaccccgtcgtgtacgacgccaagttcgagaagcagctgggccagatcatgctcctgatcctgtgcacgtcccagatcctcctgatgcgcaccacctgggccctgtgcgagagcatcaccctcgccacggggcccctgaccaccctgtgggagggctccccggggaagttctggaacaccacgatcgccgtgagcatggcgaacatcttccggggctcctacctcgccggcgccgggctggccttcagcctgatgaagtccctcggcgggggccgccgggggaccggcgcgcagggcgagaccctgggggagaagtggaagcgccagctgaaccagctctccaagagcgagttcaacacctacaagcggtccggcatcatggaggtcgaccgcagcgaggccaaggaggggctgaagcggggcgagacgaccaagcacgccgtgtcccgcgggaccgccaagctgcggtggttcgtggagcgcaacctggtcaagcccgagggcaaggtgatcgacctcggctgcgggcggggcgggtggagctactactgcgccggcctgaagaaggtgaccgaggtcaaggggtacacgaagggcggccccgggcacgaggagcccatcccgatggcgacctacggctggaacctggtgaagctccactccgggaaggacgtgttcttcatcccgcccgagaagtgcgacaccctgctgtgcgacatcggcgagagctcccccaacccgaccatcgaggaggggcgcacgctccgggtcctgaagatggtggagccctggctgcgcggcaaccagttctgcatcaagatcctcaacccctacatgcccagcgtggtcgagaccctggagcagatgcagcggaagcacggcgggatgctggtgcgcaacccgctctcccggaacagcacccacgagatgtactgggtgtcctgcggcaccgggaacatcgtcagcgccgtgaacatgacctcccgcatgctgctgaaccgcttcacgatggcccaccggaagcccacctacgagcgcgacgtggacctcggcgccggcacccggcacgtcgccgtggagcccgaggtggcgaacctggacatcatcgggcagcgcatcgagaacatcaagcacgagcacaagagcacctggcactacgacgaggacaacccctacaagacgtgggcctaccacggctcctacgaggtcaagccgagcgggtccgccagcagcatggtgaacggcgtcgtgaagctgctcaccaagccctgggacgtgatccccatggtcacccagatcgccatgaccgacacgacccccttcgggcagcagcgggtgttcaaggagaaggtggacacccgcaccccgaaggccaagcggggcacggcgcagatcatggaggtcaccgccaagtggctgtggggcttcctgtcccgcaacaagaagccccggatctgcacccgcgaggagttcacccggaaggtgcgcagcaacgccgccatcggggcggtgttcgtcgacgagaaccagtggaactccgccaaggaggccgtggaggacgagcggttctgggacctcgtgcaccgcgagcgggagctgcacaagcagggcaagtgcgccacgtgcgtctacaacatgatggggaagcgcgagaagaagctgggcgagttcgggaaggccaagggcagccgggcgatctggtacatgtggctcggcgcccgcttcctggagttcgaggccctggggttcatgaacgaggaccactggttctcccgggagaacagcctctccggcgtggagggggagggcctgcacaagctggggtacatcctccgcgacatcagcaagatccccggcggcaacatgtacgccgacgacaccgccgggtgggacacccggatcaccgaggacgacctgcagaacgaggcgcgcatcacggacatcatggagccggagcacgccctgctcgccaagtccatcttcaagctgacctaccagaacaaggtggtccgcgtgcagcggcccgccaagaacggcaccgtgatggacgtcatcagccgccgggaccagcgcgggtccggccaggtgggcacctacgggctgaacacgttcaccaacatggaggcccagctcatccggcagatggagagcgagggcatcttctcccccagcgagctggagacccccaacctggcggagcgcgtgctcgactggctggagaagtacggggtcgagcggctgaagcgcatggccatctccggcgacgactgcgtggtgaagccgatcgacgaccggttcgccaccgccctcacggccctgaacgacatggggaaggtccgcaaggacatcccccagtgggagcccagcaagggctggaacgactggcagcaggtccccttctgctcccaccacttccaccagctgatcatgaaggacggccgggagatcgtggtcccgtgccgcaaccaggacgagctcgtggggcgggcgcgcgtgagccagggcgccgggtggagcctgcgggagaccgcctgcctgggcaagtcctacgcccagatgtggcagctcatgtacttccaccgccgggacctgcgcctggcggccaacgccatctgcagcgccgtccccgtggactggatccccacctcccggaccacgtggagcatccacgcccaccaccagtggatgaccaccgaggacatgctctccgtgtggaaccgcgtctggatcgaggagaacccctggatggaggacaagacccacatcagctcctggggcgacgtgccgtacctgggcaagcgcgaggaccagtggtgcggcagcctgatcgggctcacggcgcgggccacctgggccaccaacatccaggtggccatcaaccaggtccgccggctgatcggcaacgagaactacctggactacatgacctccatgaagcgcttcaagaacgagagcgaccccgagggggccctctggtga

SEQ ID NO: 8376 - RNA, 9879 nt, synthetic construct
  misc_feature 1..9879: note = derived and/or modified CDS sequence (opt1) from DENV-1__FJ432746__SS-prME
  source 1..9879: mol_type = other RNA
agcgtgaccatgctgctgatgctgatgcccaccgccctggccttccacctcacgacccgcggcggggagccccacatgatcgtgagcaagcaggagcggggcaagagcctgctgttcaagacctccgcgggggtgaacatgtgcaccctcatcgccatggacctgggcgagttctgcgaggacacgatgacctacaagtgcccccgcatcaccgaggccgagcccgacgacgtggactgctggtgcaacgccaccgacacgtgggtcacctacgggacctgcagccagaccggcgagcaccggcgcgacaagcggtccgtggccctggcgccccacgtgggcctcgggctggagacgcgcaccgagacctggatgagctccgagggcgcctggaagcagatccagcgggtcgagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccgcaccggcctggacttcaacgagatggtcctcctgacgatgaaggagaagtcctggctggtgcacaagcagtggttcctcgacctgccgctgccctggaccagcggggcctccaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctcgtccagatcaagtacgagggcaccgacgccccctgcaagatccccttctccacccaggacgagaagggggtgacccagaacggccggctgatcacggccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacaccgcctgggacttcgggagcatcggcggcgtgttcacgtccgtcgggaagctggtgcaccagatcttcggcaccgcctacggggtgctgttcagcggcgtctcctggaccatgaagatcgggatcggcgtgctcctgacctggctgggcctcaacagccgctccacgagcctgtccatgacctgcatcgccgtggggctggtcaccctctacctgggcgtgatggtgcaggccgacagcgggtgcgtcatcaactggaagggccgggagctgaagtgcgggagcggcatcttcgtgaccaacgaggtgcacacgtggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaactacatcctcctggagaacgacatgaagctgaccgtggtggtcggggacgtggcgggcatcctcgcccaggggaagaagatgatccggccccagcccatggagtacaagtactcctggaagtcctggggcaaggccaagatcatcggcgccgacgtgcagaacaccacgttcatcatcgacgggcccaacaccccggagtgccccgacgaccagcgcgcgtggaacatctgggaggtcgaggactacggcttcgggatcttcaccaccaacatctggctgaagctgcgggactcctacacccaggtgtgcgaccaccgcctcatgagcgccgccatcaaggacaccaaggccgtgcacgccgacatgggctactggatcgagtccgagaagaacgagacctggaagctggcgcgggccagcttcatcgaggtcaagacctgcatctggcccaagtcccacacgctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcaccacggtggtcgtggacgagcactgcggcaaccgggggccgtccctgcgcaccaccaccgtgacgggcaagatcatccacgagtggtgctgccggagctgcaccctgccgcccctccgcttcaagggggaggacggctgctggtacgggatggagatccggcccgtcaaggagaaggaggagaacctggtgaagtccatggtgagcgccggcagcggcgaggtcgactccttcagcctcgggctgctgtgcatctccatcatgatcgaggaggtgatgcgcagccggtggtcccgcaagatgctcatgaccggcaccctggccgtgttcttcctgctcatcatggggcagctgacgtggaacgacctgatccggctctgcatcatggtcggcgcgaacgccagcgaccgcatggggatgggcaccacctacctggccctgatggccaccttcaagatgcgcccgatgttcgccgtgggcctcctgttccggcgcctgacgtcccgggaggtgctcctgctgaccatcgggctcagcctggtcgcgtccgtggagctgcccaacagcctcgaggagctgggcgacgggctggccatgggcatcatgatcctcaagctgctgaccgacttccagtcccaccagctctgggccaccctgctgagcctcacgttcgtccgcaccaccttctccctgcactacgcctggaagaccatggcgatggtgctgagcatcgtgtccctcttccccctgtgcctgagcacgacctcccagaagaccacctggctccccgtcctgctgggcagcctcgggtgcaagccgctgacgatgttcctgatcgccgagaacaagatctggggccggaagtcctggcccctcaacgaggggatcatggccgtgggcatcgtgagcatcctgctgagctccctcctgaagaacgacgtccccctggccgggcccctcatcgccggcggcatgctgatcgcgtgctacgtgatcagcgggtccagcgccgacctgtccctcgagaaggccgccgtggtcagctgggaggaggaggccgagcactccggcgcgagccacaacatcctggtggaggtgcaggacgacgggaccatgaagatcaaggacgaggagcgcgacgacaccctgaccatcctcctgaaggccaccctgctcgccgtctccggcgtgtacccgctgagcatccccgccacgctgttcgtgtggtacttctggcagaagaagaagcagcggtccggggtcctctgggacacccccagcccgcccgaggtggagcgcgccgtgctggacgacggcatctaccggatcatgcagcgcggcctgctggggcggtcccaggtcggcgtgggggtgttccaggagaacgtcttccacaccatgtggcacgtgacccgcggcgcggtgctcatgtaccaggggaagcggctggagcccagctgggcctccgtcaagaaggacctgatcagctacggcggcgggtggcgcctccagggctcctggaacacgggggaggaggtccaggtgatcgccgtcgagcccggcaagaaccccaagaacgtgcagaccgcccccgggaccttcaagaccagcgagggcgaggtgggcgccatcgcgctggacttcaagcccgggacgtccggcagccccatcgtcaaccgggaggggaagatcgtgggcctgtacggcaacggggtggtcaccaccagcggcacctacgtgtccgccatcgcccaggccaaggcgagccaggaggggcccctcccggagatcgaggacgaggtgttccgcaagcggaacctgacgatcatggacctgcaccccggctccgggaagacccgccggtacctccccgccatcgtccgcgaggccatcaagcggaagctgcgcaccctgatcctcgccccgacccgcgtggtggccagcgagatggcggaggccctgaagggcatgcccatccggtaccagacgaccgccgtcaagtccgagcacaccggcaaggagatcgtggacctgatgtgccacgccaccttcacgatgcgcctcctgagccccgtgcgggtccccaactacaacatgatcatcatggacgaggcccacttcaccgacccgtccagcatcgcggcccgcgggtacatctccacccgggtgggcatgggggaggccgccgccatcttcatgaccgcgacgccgcccggcagcgtggaggccttcccccagtccaacgccgtcatccaggacgaggagcgcgacatcccggagcggagctggaactccgggtacgagtggatcaccgacttccccggcaagaccgtgtggttcgtgcccagcatcaagtccggcaacgacatcgccaactgcctgcgcaagaacgggaagcgggtcatccagctcagccgcaagaccttcgacacggagtaccagaagaccaagaacaacgactgggactacgtggtgaccaccgacatctccgagatgggcgcgaacttccgggccgaccgcgtcatcgacccccggcgctgcctgaagccggtgatcctgaaggacgggcccgagcgggtcatcctcgccggccccatgcccgtgacggtggccagcgccgcgcagcgccgggggcgcatcggccggaaccacaacaaggagggcgaccagtacatctacatggggcagccgctgaacaacgacgaggaccacgcccactggaccgaggccaagatgctgctcgacaacatcaacacccccgagggcatcatccccgccctgttcgagcccgagcgcgagaagtccgccgcgatcgacggggagtaccgcctgcggggcgaggcccgcaagaccttcgtcgagctcatgcggcgcggggacctgccggtgtggctgagctacaaggtggccagcgagggcttccagtactccgaccggcgctggtgcttcgacggcgagcggaacaaccaggtcctcgaggagaacatggacgtggagatctggacgaaggagggggagcgcaagaagctgcggccccgctggctggacgcccggacctacagcgaccccctcgccctgcgcgagttcaaggagttcgcggccggccggcgctccgtgagcggggacctgatcctcgagatcggcaagctgccccagcacctgacccagcgggcccagaacgccctcgacaacctggtcatgctgcacaactccgagcagggcgggcgcgcgtaccggcacgccatggaggagctcccggacaccatcgagacgctgatgctgctcgccctgatcgccgtgctgaccggcggggtgaccctcttcttcctgagcggccgcgggctgggcaagacctccatcggcctcctgtgcgtcatggccagctccgtgctgctctggatggcgagcgtggagccccactggatcgccgcctccatcatcctggagttcttcctgatggtcctcctgatccccgagcccgaccggcagcgcaccccgcaggacaaccagctggcctacgtggtgatcgggctcctgttcatgatcctgacggtcgccgcgaacgagatgggcctcctggagaccaccaagaaggacctggggatcggccacgtggccgtggagaaccaccaccacgccgccatgctcgacgtcgacctgcaccccgccagcgcgtggaccctgtacgccgtggccacgaccatcatcacccccatgatgcggcacaccatcgagaacacgaccgccaacatctccctcaccgccatcgcgaaccaggccgccatcctgatggggctggacaagggctggccgatcagcaagatggacatcggcgtgcccctcctggccctggggtgctactcccaggtcaaccccctcaccctgacggcggccgtgctgatgctcgtggcccactacgccatcatcggccccgggctgcaggccaaggcgacccgcgaggcccagaagcgcaccgccgccggcatcatgaagaacccgaccgtcgacgggatcgtggccatcgacctggaccccgtggtctacgacgcgaagttcgagaagcagctcggccagatcatgctgctgatcctctgcacgagccagatcctgctgatgcggaccacctgggccctctgcgagtccatcaccctggccacgggccccctgaccaccctctgggaggggagccccggcaagttctggaacaccacgatcgccgtgtccatggccaacatcttccgcgggagctacctggcgggcgccggcctggccttcagcctcatgaagtccctcgggggcgggcggcgcgggaccggggcccagggcgagaccctgggcgagaagtggaagcggcagctcaaccagctgagcaagtccgagttcaacacctacaagcgcagcgggatcatggaggtggaccggtccgaggcgaaggagggcctgaagcgcggggagacgaccaagcacgccgtcagccggggcaccgccaagctccgctggttcgtggagcggaacctggtgaagccggaggggaaggtcatcgacctgggctgcggccgcgggggctggtcctactactgcgccgggctgaagaaggtgaccgaggtgaagggctacacgaagggcgggcccggccacgaggagcccatccccatggccacctacgggtggaacctcgtcaagctgcacagcggcaaggacgtgttcttcatcccgcccgagaagtgcgacaccctgctctgcgacatcggggagtccagccccaaccccaccatcgaggagggccggacgctgcgcgtgctgaagatggtcgagccgtggctccgggggaaccagttctgcatcaagatcctgaacccctacatgccctccgtggtggagaccctggagcagatgcagcgcaagcacggcggcatgctcgtccggaaccccctgagccgcaactccacccacgagatgtactgggtgagctgcgggaccggcaacatcgtgtccgcggtcaacatgaccagccggatgctgctcaaccgcttcacgatggcccaccgcaagccgacctacgagcgggacgtggacctgggggccggcacccgccacgtggccgtcgagcccgaggtggccaacctggacatcatcggccagcggatcgagaacatcaagcacgagcacaagtccacctggcactacgacgaggacaacccctacaagacgtgggcgtaccacgggagctacgaggtcaagccctccggcagcgccagctccatggtgaacggggtggtcaagctcctgaccaagccgtgggacgtgatccccatggtgacccagatcgccatgaccgacacgacccccttcggccagcagcgcgtcttcaaggagaaggtggacacccggacccccaaggccaagcgcgggacggcccagatcatggaggtgaccgcgaagtggctgtggggcttcctcagccggaacaagaagccgcgcatctgcacccgggaggagttcacccgcaaggtccggtccaacgccgccatcggcgccgtgttcgtggacgagaaccagtggaacagcgcgaaggaggccgtcgaggacgagcgcttctgggacctggtgcaccgggagcgcgagctgcacaagcaggggaagtgcgccacgtgcgtgtacaacatgatgggcaagcgggagaagaagctcggggagttcggcaaggccaaggggtcccgcgccatctggtacatgtggctgggcgcgcggttcctggagttcgaggccctcggcttcatgaacgaggaccactggttcagccgcgagaactccctgagcggggtcgagggcgaggggctgcacaagctcggctacatcctgcgggacatctccaagatccccgggggcaacatgtacgccgacgacaccgccggctgggacacccgcatcaccgaggacgacctgcagaacgaggccaagatcacggacatcatggagcccgagcacgcgctcctggccaagagcatcttcaagctgacctaccagaacaaggtggtgcgggtccagcgcccggccaagaacgggaccgtgatggacgtgatctcccgccgggaccagcgcggcagcgggcaggtcggcacctacggcctcaacacgttcaccaacatggaggcccagctgatccggcagatggagtccgaggggatcttcagcccctccgagctggagacccccaacctcgccggccgcgtgctggactggctggagaagcacggggtggagcggctcaagcgcatggcgatcagcggcgacgactgcgtcgtgaagcccatcgacgaccggttcgccaccgccctgacggccctgaacgacatggggaaggtgcgcaaggacatcccgcagtgggagccctccaagggctggaacgactggcagcaggtccccttctgcagccaccacttccaccagctcatcatgaaggacggccgggagatcgtggtgccctgccgcaaccaggacgagctggtcgggcgggcccgcgtgagccagggcgcggggtggtccctgcgggagaccgcctgcctcggcaagagctacgcccagatgtggcagctgatgtacttccaccgccgggacctgcgcctcgccgcgaacgccatctgctccgccgtgccggtcgactgggtgcccaccagccggaccacgtggtccatccacgcccaccaccagtggatgaccaccgaggacatgctgagcgtgtggaaccgcgtctggatcgaggagaacccctggatggaggacaagacccacatctccagctggggcgacgtgccctacctgggcaagcgggaggaccagtggtgcggctccctcatcgggctgacggcccgcgcgacctgggccaccaacatccaggtggccatcaaccaggtccgccggctgctcggcaacgagaactacctggactacatgaccagcatgaagcgcttcaagaacgagtccgacccggagggggccctgtggtga

SEQ ID NO: 8377 - RNA, 9879 nt, synthetic construct
  misc_feature 1..9879: note = derived and/or modified CDS sequence (opt1) from DENV-1__FJ432748__SS-prME
  source 1..9879: mol_type = other RNA
agcgtgaccatgctgctgatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgcgacaagcggtccgtggccctcgcgccccacgtgggcctggggctggagacccggaccgagacctggatgagctccgagggcgcgtggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaaggtgcccttcagcacgcaggacgagaagggggtgacccagaacggccggctgatcaccgccaacccgatcgtcaccgacaaggagaagcccgtgaacatcgaggccgagccgcccttcggggagtcctacatcgtgatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtcttcaccagcgtggggaagctggtgcaccagatcttcggcaccgcctacggggtcctcttctccggcgtgagctggacgatgaagatcgggatcggcgtgctgctgacctggctcggcctgaactcccgcagcacctccctgagcatgacctgcatcgccgtcgggctcgtgacgctgtacctgggcgtgatggtccaggccgactccgggtgcgtgatcaactggaagggccgggagctcaagtgcgggagcggcatcttcgtgaccaacgaggtccacacctggaccgagcagtacaagttccaggccgacagcccgaagcgcctgtccgcggccatcggcaaggcctgggaggagggggtgtgcggcatccggagcgccacccgcctggagaacatcatgtggaagcagatctccaacgagctcaaccacatcctgctggagaacgacatgaagttcacggtggtcgtgggggacgtggccggcatcctcgcgcaggggaagaagatgatccggccccagcccatggagtacaagtacagctggaagtcctggggcaaggccaagatcatcggcgccgacgtccagaacaccaccttcatcatcgacgggcccaacaccccggagtgccccgacgaccagcgcgcctggaacatctgggaggtggaggactacggcttcgggatcttcacgaccaacatctggctgaagctgcgggacagctacacccaggtgtgcgaccaccgcctcatgtccgcggccatcaaggacagcaaggccgtccacgccgacatgggctactggatcgagtccgagaagaacgagacctggaagctggcccgggcgagcttcatcgaggtgaagacgtgcatctggcccaagtcccacaccctgtggagcaacggcgtgctcgagtccgagatgatcatccccaagatctacgggggcccgatcagccagcacaactaccgccccgggtacttcacccaggccgccggcccctggcacctggggaagctggagctcgacttcgacctgtgcgagggcaccacggtcgtggtggacgagcactgcggcaaccgggggccgtccctgcgcaccaccaccgtcacgggcaagatcatccacgagtggtgctgccggagctgcaccctgccgcccctccgcttcaagggggaggacggctgctggtacgggatggagatccggcccgtgaaggagaaggaggagaacctggtgaagtccatggtcagcgccggcagcggcgaggtggactccttcagcctcgggctgctgtgcatctccatcatgatcgaggaggtgatgcgcagccggtggtcccgccggatgctcatgaccggcaccctggccgtcttcttcctgctcatcatggggcagctgacgtggaacgacctgatccgcctctgcatcatggtgggcgcgaacgccagcgaccgcatggggatgggcaccacctacctggccctgatggccaccttcaagatgcggccgatgttcgccgtgggcctcctgttccgccggctgacgtcccgcgaggtcctcctgctgaccatcgggctcagcctggtggcgtccgtcgagctgcccaacagcctcgaggagctgggcgacgggctggccatgggcatcatgatcctcaagctgctgaccgacttccagtcccaccagctctgggccaccctgctgagcctcacgttcatcaagaccaccttctccctgcactacgcctggaagaccatggcgatggtgctgagcatcgtgtccctcttccccctgtgcctgagcacgacctcccagaagaccacctggctccccgtcctgctgggcagcctcgggtgcaagccgctgacgatgttcctgatcgccgagaacaagatctggggccggcgctcctggcccctcaacgaggggatcatggccgtgggcatcgtgagcatcctgctgagctccctcctgaagaacgacgtccccctggccgggcccctcatcgccggcggcatgctgatcgcgtgctacgtgatcagcgggtccagcgccgacctgtccctcgagaaggccgccgaggtgagctgggaggaggaggccgagcactccggcgcgagccacaacatcctggtcgaggtgcaggacgacgggaccatgaagatcaaggacgaggagcgggacgacaccctgaccatcctcctgaaggccaccctgctcgccgtgtccggcgtctacccgctgagcatccccgccacgctgttcgtgtggtacttctggcagaagaagaagcagcgctccggggtgctctgggacacccccagcccgcccgaggtcgagcgggccgtgctggacgacggcatctaccgcatcatgcagcggggcctgctggggcgctcccaggtgggcgtcggggtgttccaggagaacgtgttccacaccatgtggcacgtcacccggggcgcggtgctcatgtaccaggggaagcgcctggagcccagctgggcctccgtgaagaaggacctgatcagctacggcggcgggtggcggctccagggctcctggaacacgggggaggaggtccaggtgatcgccgtggagcccggcaagaaccccaagaacgtccagaccgcccccgggaccttcaagacccccgagggcgaggtgggcgccatcgcgctggacttcaagcccgggacgagcggctcccccatcgtgaaccgcgaggggaagatcgtcggcctgtacggcaacggggtggtgaccaccagcggcacctacgtcagcgccatcgcccaggccaaggcgtcccaggaggggccgctccccgagatcgaggacgaggtgttccggaagcgcaacctgacgatcatggacctgcaccccggcagcgggaagacccggcgctacctcccggccatcgtgcgggaggccatcaagcgcaagctgcgcaccctgatcctcgcccccacccgggtcgtggcctccgagatggcggaggccctgaagggcatgcccatccgctaccagacgaccgccgtcaagagcgagcacaccggcaaggagatcgtcgacctgatgtgccacgccaccttcacgatgcggctcctgtcccccgtgcgcgtgccgaactacaacatgatcatcatggacgaggcccacttcaccgaccccagctccatcgcggcccgggggtacatcagcacccgcgtcggcatgggggaggccgccgccatcttcatgaccgcgacgccgcccggctccgtggaggccttcccgcagagcaacgccgtgatccaggacgaggagcgggacatccccgagcgctcctggaacagcgggtacgagtggatcaccgacttccccggcaagaccgtctggttcgtgccctccatcaagagcggcaacgacatcgccaactgcctgcggaagaacgggaagcgcgtgatccagctctcccggaagaccttcgacacggagtaccagaagaccaagaacaacgactgggactacgtcgtgaccaccgacatcagcgagatgggcgcgaacttccgcgccgaccgggtgatcgacccgcgccggtgcctgaagcccgtcatcctgaaggacgggcccgagcgcgtgatcctcgccggccccatgccggtcacggtggcctccgccgcgcagcggcgcgggcggatcggccgcaaccacaacaaggagggcgaccagtacatctacatggggcagcccctgaacaacgacgaggaccacgcccactggaccgaggccaagatgctgctcgacaacatcaacacccccgagggcatcatccccgccctgttcgagccggagcgcgagaagtccgccgcgatcgacggggagtaccggctgcgcggcgaggcccggaagaccttcgtggagctcatgcgccgcggggacctgcccgtctggctgtcctacaaggtggccagcgagggcttccagtacagcgaccgccggtggtgcttcgacggcgagcgcaacaaccaggtgctcgaggagaacatggacgtcgagatctggacgaaggagggggagcggaagaagctgcgcccccggtggctggacgcccgcacctactccgaccccctcgccctgcgggagttcaaggagttcgcggccggccgccggagcgtgtccggggacctgatcctcgagatcggcaagctgccgcagcacctgacccagcgcgcccagaacgccctcgacaacctggtgatgctgcacaacagcgagcagggcgggcgggcgtaccgccacgccatggaggagctccccgacaccatcgagacgctgatgctgctcgccctgatcgccgtcctgaccggcggggtgaccctcttcttcctgtccggccgggggctgggcaagaccagcatcggcctcctgtgcgtgatggcctccagcgtcctgctctggatggcgtccgtggagccccactggatcgccgccagcatcatcctggagttcttcctgatggtgctcctgatccccgagccggaccgccagcggacgccccaggacaaccagctggcctacgtcgtgatcgggctcctgttcatgatcctgacggtggccgcgaacgagatgggcctcctggagaccaccaagaaggacctggggatcggccacgtcgccgtggagaaccaccaccacgccgccatgctcgacgtggacctgcaccccgcctccgcgtggaccctgtacgccgtcgccacgaccatcatcaccccgatgatgcgccacaccatcgagaacacgaccgccaacatcagcctcaccgccatcgcgaaccaggccgccatcctgatggggctggacaagggctggcccatctccaagatggacatcggcgtgcccctcctggccctggggtgctacagccaggtgaaccccctcaccctgacggcggccgtcctgatgctcgtggcccactacgccatcatcggcccggggctgcaggccaaggcgacccgcgaggcccagaagcggaccgccgccggcatcatgaagaaccccaccgtggacgggatcgtcgccatcgacctggaccccgtggtgtacgacgcgaagttcgagaagcagctcggccagatcatgctgctgatcctctgcacgtcccagatcctgctgatgcgcaccacctgggccctctgcgagagcatcaccctggccacgggccccctgaccaccctctgggaggggtccccgggcaagttctggaacaccacgatcgccgtcagcatggccaacatcttccgggggtcctacctggcgggcgccggcctggccttcagcctcatgaagtccctcgggggcgggcgccgggggaccggggcccagggcgagaccctgggcgagaagtggaagcgccagctcaaccagctgtccaagagcgagttcaacacctacaagcggtccgggatcatggaggtggaccgcagcgaggcgaaggagggcctgaagcgcggggagacgaccaagcacgccgtgtcccgcggcaccgccaagctccggtggttcgtcgagcgcaacctggtgaagcccgaggggaaggtgatcgacctgggctgcggccgcggcgggtggagctactactgcgccgggctgaagaaggtcaccgaggtgaaggggtacacgaagggcggccccggccacgaggagcccatcccgatggccacctacgggtggaacctcgtgaagctgcactccggcaaggacgtcttcttcatcccgcccgagaagtgcgacaccctgctctgcgacatcggggagagctcccccaacccgaccatcgaggagggccgcacgctgcgggtgctgaagatggtggagccctggctccgcgggaaccagttctgcatcaagatcctgaacccctacatgcccagcgtcgtggagaccctggagcagatgcagcggaagcacggcggcatgctcgtgcgcaacccgctgtcccggaacagcacccacgagatgtactgggtctcctgcgggaccggcaacatcgtgagcgcggtgaacatgacctcccgcatgctgctcaaccgcttcacgatggcccaccggaagcccacctacgagcgcgacgtcgacctgggggccggcacccggcacgtggccgtggagcccgaggtcgccaacctggacatcatcggccagcgcatcgagaacatcaagcacgagcacaagagcacctggcactacgacgaggacaacccctacaagacgtgggcgtaccacgggtcctacgaggtgaagccgagcggctccgccagcagcatggtcaacggggtggtgaagctcctgaccaagccctgggacgtcatccccatggtgacccagatcgccatgaccgacacgacccccttcggccagcagcgggtgttcaaggagaaggtcgacacccgcaccccgaaggccaagcgggggacggcccagatcatggaggtgaccgcgaagtggctgtggggcttcctctcccgcaacaagaagccccggatctgcacccgcgaggagttcacccggaaggtgcgcagcaacgccgccatcggcgccgtcttcgtggacgagaaccagtggaactccgcgaaggaggccgtggaggacgagcggttctgggacctggtccaccgcgagcgggagctgcacaagcaggggaagtgcgccacgtgcgtgtacaacatgatgggcaagcgcgagaagaagctcggggagttcggcaaggccaaggggagccgggccatctggtacatgtggctgggcgcgcgcttcctggagttcgaggccctcggcttcatgaacgaggaccactggttctcccgggagaacagcctgtccggggtggagggcgaggggctgcacaagctcggctacatcctgcgcgacatcagcaagatccccgggggcaacatgtacgccgacgacaccgccggctgggacacccggatcaccgaggacgacctgcagaacgaggcccgcatcacggacatcatggagccggagcacgcgctcctggccaagtccatcttcaagctgacctaccagaacaaggtcgtgcgcgtgcagcggcccgccaagaacgggaccgtcatggacgtgatcagccgccgggaccagcgcggctccggccaggtgggcacctacggcctcaacacgttcaccaacatggaggcccagctgatccggcagatggagagcgaggggatcttctcccccagcgagctggagacccccaacctcgccgagcgcgtcctggactggctggagaagtacggcgtggagcggctcaagcgcatggcgatctccggggacgactgcgtggtcaagccgatcgacgaccggttcgccaccgccctgacggccctgaacgacatgggcaaggtgcgcaaggacatcccccagtgggagcccagcaaggggtggaacgactggcagcaggtccccttctgctcccaccacttccaccagctcatcatgaaggacggccgggagatcgtcgtgccgtgccgcaaccaggacgagctggtgggccgggcccgcgtcagccagggggcgggctggagcctgcgggagaccgcctgcctcgggaagtcctacgcccagatgtggcagctgatgtacttccaccgccgggacctgcgcctcgccgcgaacgccatctgcagcgccgtgcccgtggactggatccccacctcccggaccacgtggagcatccacgcccaccaccagtggatgaccaccgaggacatgctgtccgtctggaaccgcgtgtggatcgaggagaacccctggatggaggacaagacccacatcagctcctggggcgacgtgccgtacctggggaagcgcgaggaccagtggtgcggcagcctcatcggcctgacggcccgggcgacctgggccaccaacatccaggtcgccatcaaccaggtgcgccggctgatcgggaacgagaactacctcgactacatgacctccatgaagcgcttcaagaacgagagcgaccccgagggcgccctgtggtga

SEQ ID NO: 8378 - RNA, 9879 nt, synthetic construct
  misc_feature 1..9879: note = derived and/or modified CDS sequence (opt1) from DENV-1__FJ432749__SS-prME
  source 1..9879: mol_type = other RNA
agcgtgaccatgctgctcatgctgatgcccaccgccctggccttccacctcaccacccgcggcggggagccccacatgatcgtgaccaagcaggagcggggcaagagcctgctgttcaagaccagcgcgggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtcacctacgggacctgctcccagacgggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcctgacccaggacgagaagggggtcacgcagaacggccggctgatcaccgccaacccgatcgtgaccgacaaggagaagcccgtgaacatcgaggccgagccgcccttcggggagagctacatcgtcatcggcgcgggcgagaaggccctcaagctgtcctggttcaagaaggggagctccatcggcaagatgttcgaggccaccgcccgcggggcccggcgcatggcgatcctgggcgacacggcctgggacttcgggagcatcggcggcgtgttcacctccgtggggaagctcgtccaccagatcttcggcaccgcctacggggtgctgttcagcggcgtgtcctggaccatgaagatcgggatcggcgtcctgctcacgtggctgggcctgaacagccgctccaccagcctctccatgacctgcatcgccgtggggctggtgaccctgtacctcggcgtcatggtgcaggccgacagcgggtgcgtgatcaactggaagggccgggagctgaagtgcgggtccggcatcttcgtcacgaacgaggtgcacacctggaccgagcagtacaagttccaggcggacagcccgaagcgcctgagcgccgccatcggcaaggcctgggaggagggggtgtgcggcatccggtccgccacccgcctcgagaacatcatgtggaagcagatcagcaacgagctgaaccacatcctgctcgagaacgacatgaagttcaccgtcgtggtgggggacgtcgtgggcatcctggcgcaggggaagaagatgatccggccccagcccatggagcacaagtactcctggaagtcctggggcaaggccaagatcatcggcgccgacgtgcagaacacgaccttcatcatcgacgggcccaacaccccggagtgccccgacgaccagcgcgcctggaacatctgggaggtcgaggactacggcttcgggatcttcaccacgaacatctggctgaagctccgggactcctacacccaggtgtgcgaccaccgcctgatgagcgcggccatcaaggactccaaggccgtgcacgccgacatgggctactggatcgagagcgagaagaacgagacctggaagctggcccgggcgtccttcatcgaggtcaagacctgcatctggcccaagagccacacgctctggtccaacggcgtgctggagagcgagatgatcatccccaagatctacgggggcccgatctcccagcacaactaccgccccgggtacttcacccagaccgccggcccctggcacctggggaagctcgagctggacttcgacctgtgcgagggcaccacggtggtcgtggacgagcactgcggcaaccgggggccgagcctccgcaccaccaccgtgacgggcaagatcatccacgagtggtgctgccggtcctgcaccctgccgcccctgcgcttcaagggggaggacggctgctggtacgggatggagatccggcccgtcaaggagaaggaggagaacctcgtcaagagcatggtgtccgccggcagcggcgaggtcgacagcttctccctggggctgctctgcatcagcatcatgatcgaggaggtgatgcgctcccggtggagccgcaagatgctgatgaccggcaccctggccgtgttcctcctgctgatcatggggcagctcacgtggaacgacctgatccggctgtgcatcatggtcggcgccaacgcgtccgaccgcatggggatgggcaccacctacctcgccctgatggccaccttcaagatgcgcccgatgttcgccgtgggcctcctgttccggcgcctgacgagccgggaggtgctgctcctgaccatcgggctgtccctcgtcgccagcgtggagctgcccaactccctggaggagctcggcgacgggctggcgatgggcatcatgatcctgaagctcctgaccgacttccagagccaccagctgtgggccaccctcctgtccctgacgttcatcaagaccaccctcagcctgcactacgcctggaagaccatggccatggtcctgtccatcgtgagcctcttccccctgtgcctgtccacgaccagccagaagaccacctggctccccgtgctgctgggctccctcgggtgcaagccgctgacgatgttcctgatcgcggagaacaagatctggggccgcaagagctggcccctcaacgaggggatcatggccgtcggcgtggtgtccatcctgctgagcagcctcctgaagaacgacgtccccctggccgggcccctcatcgccggcggcatgctgatcgcctgctacgtgatctccgggagctccgcggacctgagcctcgagaaggccgccgaggtgtcctgggaggaggaggccgagcacagcggcgcctcccacaacatcctggtcgaggtgcaggacgacgggaccatgaagatcaaggacgaggagcgggacgacaccctgaccatcctcctgaaggcgaccctgctcgccgtgagcggcgtctacccgctgtccatccccgccacgctgttcgtgtggtacttctggcagaagaagaagcagcgcagcggggtgctgtgggacacccccagcccgcccgaggtcgagaaggccgtgctcgacgacggcatctaccggatcatgcagcgcggcctgctggggcggagccaggtgggcgtcggggtgttccaggagaacgtgttccacaccatgtggcacgtcacccgcggcgccgtgctcatgtaccaggggaagcggctggagccctcctgggcgagcgtgaagaaggacctgatctcctacggcggcgggtggcgcctccagggcagctggaacacgggggaggaggtccaggtgatcgccgtggagcccggcaagaaccccaagaacgtccagaccgcccccgggaccttcaagacccccgagggcgaggtgggcgccatcgccctggacttcaagcccgggacgtccggcagccccatcgtgaaccgggaggggaagatcgtcggcctgtacggcaacggggtggtgaccacctccggcacctacgtcagcgcgatcgcccaggccaaggccagccaggaggggccgctccccgagatcgaggacgaggtgttccgcaagcggaacctgacgatcatggacctgcaccccggctccgggaagacccgccggtacctcccggcgatcgtgcgcgaggccatcaagcggaagctgcgcaccctgatcctcgcccccacccgggtcgtggccagcgagatggccgaggcgctgaagggcatgcccatccgctaccagacgaccgccgtgaagtccgagcacaccggcaaggagatcgtcgacctgatgtgccacgccaccttcacgatgcgcctcctgagccccgtgcgggtgccgaactacaacatgatcatcatggacgaggcccacttcaccgacccctccagcatcgccgcgcgcgggtacatctccacccgggtcggcatgggggaggccgccgccatcttcatgaccgccacgccgcccggcagcgtggaggcgttcccgcagtccaacgccgtgatccaggacgaggagcgcgacatccccgagcggagctggaactccgggtacgagtggatcaccgacttccccggcaagaccgtctggttcgtgcccagcatcaagtccggcaacgacatcgccaactgcctgcgcaagaacgggaagcgggtgatccagctcagccgcaagaccttcgacacggagtaccagaagaccaagaacaacgactgggactacgtcgtgaccaccgacatctccgagatgggcgccaacttccgggcggaccgcgtgatcgacccgcggcgctgcctgaagcccgtcatcctgaaggacgggcccgagcgggtgatcctcgccggccccatgccggtcacggtggccagcgccgcccagcgccgggggcgcatcggccggaaccacaacaaggagggcgaccagtacatctacatggggcagcccctgaacaacgacgaggaccacgcgcactggaccgaggccaagatgctgctcgacaacatcaacacccccgagggcatcatccccgccctgttcgagccggagcgcgagaagtccgccgccatcgacggggagtaccggctgcgcggcgaggcgcgcaagaccttcgtggagctcatgcggcgcggggacctgcccgtctggctgagctacaaggtggcctccgagggcttccagtacagcgaccggcgctggtgcttcgacggcgagcggaacaaccaggtgctcgaggagaacatggacgtcgagatctggacgaaggagggggagcgcaagaagctgcggccccgctggctggacgcccggacctacagcgaccccctcgccctgcgcgagttcaaggagttcgccgcgggccggcgctccgtgagcggggacctgatcctcgagatcggcaagctgccgcagcacctgacccagcgggcccagaacgccctcgacaacctggtgatgctgcacaactccgagcagggcgggcgcgcctaccggcacgcgatggaggagctccccgacaccatcgagacgctgatgctgctcgccctgatcgccgtcctgaccggcggggtgaccctcttcttcctgagcggccgcgggctgggcaagacctccatcggcgtgctctgcgtcatggccagctccgtgctgctgtggatggccagcgtggagccccactggatcgcggcctccatcatcctcgagttcttcctgatggtcctgctcatccccgagccggaccggcagcgcacgccccaggacaaccagctggcctacgtggtgatcgggctcctgttcatgatcctgacggtcgccgccaacgagatgggcctgctcgagaccaccaagaaggacctggggatcggccacgtggcggtggagaaccaccaccacgccaccatgctggacgtcgacctccaccccgccagcgcctggacgctgtacgccgtggcgaccaccatcatcaccccgatgatgcggcacacgatcgagaacaccaccgccaacatctccctgaccgccatcgccaaccaggccgcgatcctcatggggctggacaagggctggcccatcagcaagatggacatcggcgtgcccctgctcgccctggggtgctactcccaggtcaaccccctgacgctcaccgccgccgtgctgatgctggtggcgcactacgccatcatcggcccggggctccaggccaaggccacccgcgaggcccagaagcggaccgcggccggcatcatgaagaaccccacggtcgacgggatcgtggccatcgacctggaccccgtggtctacgacgccaagttcgagaagcagctgggccagatcatgctcctgatcctgtgcaccagccagatcctcctgatgcgcaccacctgggccctgtgcgagtccatcacgctcgcgaccggccccctgaccaccctgtgggaggggagcccgggcaagttctggaacacgaccatcgccgtgtccatggccaacatcttccgcgggagctacctcgccggcgccggcctggcgttctccctgatgaagtccctcgggggcgggcggcgcggcaccggggcccagggcgagaccctgggcgagaagtggaagcggcagctgaaccagctcagcaagtccgagttcaacatctacaagcgcagcgggatcatggaggtggaccggtccgaggccaaggagggcctgaagcgcggggagacgacccggcacgccgtcagccgcggcaccgcgaagctgcggtggttcgtggagcgcaacctggtgaagcccgaggggaaggtcatcgacctcggctgcggccgcggcgggtggtcctactactgcgccgggctgaagaaggtgaccgaggtgaaggggtacacgaagggcgggcccggccacgaggagcccatcccgatggccacctacgggtggaacctggtcaagctccacagcggcaaggacgtgttcttcacgccgcccgagaagtgcgacaccctgctgtgcgacatcggggagtccagccccaacccgacgatcgaggagggccgcaccctccgggtgctgaagatggtcgagccctggctgcgcgggaaccagttctgcatcaagatcctcaacccctacatgccctccgtggtggagaccctggagcagatgcagcggaagcacggcggcatgctggtccgcaacccgctcagccggaactccacccacgagatgtactgggtgagctgcgggaccggcaacatcgtgtccgccgtcaacatgacgagccgcatgctgctgaaccggttcaccatggcccaccgcaagcccacctacgagcgcgacgtggacctcggggcgggcacccggcacgtggccgtcgagcccgaggtggccaacctggacatcatcggccagcgcatcgagaacatcaagcacgagcacaagtccacgtggcactacgacgaggacaacccctacaagacctgggcctaccacgggagctacgaggtcaagccgtccggcagcgcctccagcatggtgaacggggtggtcaagctgctcaccaagccctgggacgtgatccccatggtgacccagatcgcgatgacggacaccacccccttcggccagcagcgggtcttcaaggagaaggtggacacccgcacgccgaaggccaagcgggggaccgcccagatcatggaggtgaccgcccgctggctgtggggcttcctgagccggaacaagaagccccgcatctgcacccgggaggagttcacgcgcaaggtccggtccaacgccgcgatcggcgccgtgttcgtggacgagaaccagtggaacagcgccaaggaggccgtcgaggacgagcgcttctgggacctcgtgcagaaggagcgggagctgcacaagcaggggaagtgcgcgacctgcgtgtacaacatgatgggcaagcgcgagaagaagctgggggagttcggcaaggccaaggggtcccgggccatctggtacatgtggctcggcgcccgcttcctggagttcgaggccctgggcttcatgaacgaggaccactggttcagccgggagaactccctcagcggggtcgagggcgaggggctgcacaagctgggctacatcctccgcgacatctccaagatccccgggggcaacatgtacgcggacgacaccgccggctgggacacccggatcacggaggacgacctgcagaacgaggccaagatcaccgacatcatggagccggagcacgccctgctcgccaccagcatcttcaagctgacctaccagaacaaggtggtgcgcgtccagcggcccgcgaagaacgggacggtgatggacgtgatctcccgccgcgaccagcggggcagcgggcaggtcggcacctacggcctgaacaccttcaccaacatggaggcccagctcatccgccagatggagtccgaggggatcttcctgcccagcgagctggagacgcccaacctcgccgagcgggtgctggactggctggagaagtacggcgtggagcgcctcaagcggatggccatctccggggacgactgcgtcgtgaagccgatcgacgaccgcttcgccaccgcgctgaccgccctgaacgacatgggcaaggtgcggaaggacatcccccagtgggagcccagcaaggggtggaacgactggcagcaggtccccttctgctcccaccacttccaccagctcatcatgaaggacggccgcgagatcgtggtgccgtgccggaaccaggacgagctggtcggccgcgcccgggtgagccagggggccggctggtccctgcgcgagaccgcctgcctcggcaagagctacgcgcagatgtggcagctgatgtacttccaccggcgcgacctgcggctcgccgccaacgccatctgcagcgcggtgcccgtcgactgggtgcccacgtcccgcaccacctggagcatccacgcccaccaccagtggatgaccacggaggacatgctgtccgtgtggaaccgggtctggatcgaggagaacccctggatggaggacaagacccacgtgagctcctggggcgacgtgccgtacctggggaagcgcgaggaccagtggtgcggcagcctcatcggcctgaccgcccgggccacctgggcctccaacatccaggtcgcgatcaaccaggtgcgccgcctgatcgggaacgagaactacctcgactacatgaccagcatgaagcggttcaagaacgagggcgaccccgagggggccttctggtga

SEQ ID NO: 8379 - RNA, 9879 nt, synthetic construct
  misc_feature 1..9879: note = derived and/or modified CDS sequence (opt1) from DENV-1__FJ410212__SS-prME
  source 1..9879: mol_type = other RNA
agcgtgaccatgctgctgatgctgatgcccaccgccctggccttccacctcaccacccggggcggggagccccacatgatcgtcagcaagcaggagcggggcaagagcctgctgttcaagaccagcgccggggtgaacatgtgcaccctcatcgccatggacctgggcgagctgtgcgaggacaccatgacctacaagtgcccccggatcaccgaggccgagcccgacgacgtggactgctggtgcaacgccaccgacacgtgggtcacctacgggacctgcagccagaccggcgagcaccggcgggagaagcggtccgtggccctcgcgccccacgtgggcctggggctggagacgcggaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcctgacgtgcgccaagttcaagtgcgtgaccaagctggagggcaagatcgtccagtacgagaacctcaagtacagcgtgatcgtgaccgtccacaccggcgaccagcaccaggtggggaacgagtccacggagcacggcaccaccgcgaccatcacgccccaggcccccacgaccgagatccagctgaccgactacggggccctgaccctcgactgcagcccccgcacgggcctggacttcaacgagatggtcctgctcaccatgaaggagaagtcctggctggtgcacaagcagtggttcctggacctccccctgccctggaccagcggggccagcacctcccaggagacgtggaaccggcaggacctgctcgtgaccttcaagaccgcccacgcgaagaagcaggaggtcgtggtgctgggcagccaggagggcgccatgcacaccgccctgacgggggccaccgagatccagacctccggcaccacgaccatcttcgccgggcacctcaagtgccgcctgaagatggacaagctgaccctcaagggcatgagctacgtcatgtgcaccgggtccttcaagctggagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctcaagctgagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctcgtgcaccagatcttcggcaccgcctacggggtgctgttctccggcgtcagctggaccatgaagatcgggatcggcgccctgctcacgtggctgggcctgaactcccgcagcacctccctcagcatgacctgcatcgccgtggggctggtgaccctgtacctcggcgtcatggtgcaggcggactccgggtgcgtgatcaactggaagggccgggagctgaagtgcgggagcggcatcttcgtcacgaacgaggtgcacacctggaccgagcagtacaagttccaggccgacagcccgaagcgcctgtccgccgccatcggcaaggcctgggaggagggggtgtgcggcatccggagcgcgacccgcctcgagaacatcatgtggaagcagatctccaacgagctgaaccacatcctgctcgagaacgacatgaagttcaccgtcgtggtgggggacgtcgccggcatcctggtgcaggggaagaagatgatccggccccagcccatggagtacaagtacagctggaagtcctggggcaaggccaagatcatcggcgccgacgtgcagaacagcacgttcatcatcgacgggcccaacaccccggagtgccccgacgaccagcgcgcgtggaacatctgggaggtcgaggactacggcttcgggatcttcaccaccaacatctggctgaagctccgggactcctacacccaggtgtgcgaccaccgcctgatgagcgccgccatcaaggactccaaggccgtgcacgccgacatgggctactggatcgagagcgagaagaacgagacctggaagctggcgcgggcctccttcatcgaggtcaagacctgcatctggcccaagagccacaccctctggtccaacggcgtgctggagagcgagatgatcatccccaagatccacgggggcccgatctcccagcacaactaccgccccgggtacttcacgcagaccgccggcccctggcacctggggaagctcgagctggacttcgacctgtgcgagggcaccaccgtggtcgtggacgagcactgcggcaaccgggggccgagcctccgcacgaccaccgtgaccggcaagatcatccacgagtggtgctgccggtcctgcacgctgccgcccctgcgcttccgcggggaggacggctgctggtacgggatggagatccgccccgtcaaggagaaggaggagaacctcgtgaagtccatggtgagcgccggctccggcgaggtcgacagcttctccctggggctgctctgcatcagcatcatgatcgaggaggtgatgcggtcccgctggagccggaagatgctgatgaccggcaccctggccgtgttcttcctcctgatcatggggcagctgacctggaacgacctcatccgcctgtgcatcatggtcggcgcgaacgcctccgaccgcatggggatgggcacgacctacctggccctcatggccaccttcaagatgcggccgatgttcgccgtgggcctgctgttccgccggctcaccagccgcgaggtgctgctgctcacgatcgggctgtccctggtcgcgagcgtggagctccccaactccctggaggagctgggcgacgggctcgccatgggcatcatgatcctgaagctgctcaccgacttccagagctaccagctgtgggccaccctgctctccctgaccttcatcaagacgaccttcagcctgcactacgcctggaagaccatggcgatggtcctctccatcgtgagcctgttccccctgtgcctctccaccacgagccagaagaccacctggctgcccgtgctgctcggctccctggggtgcaagccgctgaccatgttcctcatcgccgagaacaagatctggggccgcaagagctggcccctgaacgaggggatcatggccgtcggcatcgtgagcatcctgctctccagcctgctgaagaacgacgtgcccctcgccgggcccctgatcgccggcggcatgctgatcgcgtgctacgtcatctccgggagctccgccgacctcagcctggagaaggccgccgaggtgtcctgggaggaggaggccgagcacagcggcgcgtcccacaacatcctggtggaggtccaggacgacgggacgatgaagatcaaggacgaggagcgcgacgacaccctcaccatcctgctgaaggccaccctcctggccgtgagcggcgtgtacccgctgtccatccccgccaccctcttcgtctggcacttctggcagaagaagaagcagcggagcggggtgctgtgggacacgcccagcccgcccgaggtggagcgcgccgtcctggacgacggcatctaccggatcatgcagcgcggcctgctcgggcggagccaggtgggcgtgggggtcttccaggagaacgtgttccacaccatgtggcacgtgacccgcggcgcggtcctgatgtaccaggggaagcggctggagccctcctgggccagcgtgaagaaggacctcatctcctacggcggcgggtggcgcttccagggcagctggaacaccggggaggaggtgcaggtcatcgccgtggagcccggcaagaaccccaagaacgtgcagacggcccccgggaccttcaagacccccgagggcgaggtcggcgccatcgcgctggacttcaagcccgggacctccggcagccccatcgtgaaccgggaggggaagatcgtgggcctgtacggcaacggggtcgtgacgaccagcggcacctacgtgtccgccatcgcccaggccaaggcgagccaggaggggccgctccccgagatcgaggacgaggtcttccgcaagcggaacctgaccatcatggacctgcaccccggctccgggaagacgcgccggtacctcccggccatcgtgcgcgaggccatcaagcggaagctgcgcaccctgatcctcgcccccacccgcgtggtcgccagcgagatggcggaggccctgaagggcatgcccatccggtaccagaccacggccgtgaagtccgagcacaccggcaaggagatcgtggacctgatgtgccacgccaccttcaccatgcgcctcctgagccccgtccgggtgccgaactacaacatgatcatcatggacgaggcccacttcacggacccctccagcatcgcggcccgcgggtacatctccacccgggtgggcatgggggaggccgccgccatcttcatgaccgcgacgccgcccggcagcatggaggccttcccgcagtccaacgccgtcatccaggacgaggagcgcgacatccccgagcggagctggaactccgggtacgagtggatcacggacttccccggcaagaccgtgtggttcgtgcccagcatcaaggccggcaacgacatcgcgaactgcctgcgcaagaacgggaagcgggtcatccagctctcccgcaagaccttcgacaccgagtaccagaagacgaagaacaacgactgggactacgtggtgaccaccgacatcagcgagatgggcgccaacttccgggccgaccgcgtcatcgacccgcggcgctgcctgaagcccgtgatcctgaaggacgggcccgagcgggtgatcctcgccggccccatgccggtcaccgtggcctccgcggcccagcgccgggggcgcatcggccggaaccacaacaaggagggcgaccagtacatctacatggggcagcccctgaacaacgacgaggaccacgcccactggacggaggccaagatgctgctcgacaacatcaacacccccgagggcatcatccccgccctgttcgagccggagcgcgagaagtccgcggccatcgacggggagtaccgcctgcggggcgaggcccgcaagaccttcgtcgagctcatgcggcgcggggacctgcccgtgtggctgtcctacaaggtggccagcgagggcttccagtacagcgaccggcgctggtgcttcgacggcgagcggaacaaccaggtcctcgaggagaacatggacgtggagatctggaccaaggagggggagcgcaagaagctgcggccccgctggctggacgcccggacgtactccgaccccctcgcgctgcgcgagttcaaggagttcgccgccggccggcgcagcgtgtccggggacctgatcctcgagatcggcaagctgccgcagcacctgacccagcgggcccagaacgcgctcgacaacctggtcatgctgcacaacagcgagcagggcgggcgcgcctaccggcacgccatggaggagctccccgacaccatcgagaccctgatgctgctcgccctgatcgccgtgctgacgggcggggtgaccctcttcttcctgtccggcaaggggctgggcaagaccagcatcggcctcctgtgcgtcatggcgtccagcgtgctgctctggatggcctccgtggagccccactggatcgccgccagcatcatcctggagttcttcctgatggtcctcctgatccccgagccggaccgccagcggacgccccaggacaaccagctggcctacgtggtgatcgggctcctgttcatgatcctgaccgtcgcggccaacgagatgggcctcctggagacgaccaagaaggacctggggatcggccacgtggccgtggagaaccaccaccacgccgccatgctcgacgtcgacctgcaccccgcgtccgcctggaccctgtacgccgtggccaccacgatcgtgaccccgatgatgcgccacaccatcgagaacaccacggccaacatcagcctcaccgcgatcgccaaccaggccgccatcctgatggggctggacaagggctggcccatctccaagatggacatcggcgtccccctcctggcgctggggtgctacagccaggtgaaccccctcaccctgaccgccgccgtgctgatgctcgtcgcccactacgccatcatcggcccggggctgcaggcgaaggccacgcgggaggcccagaagcgcaccgccgccggcatcatgaagaaccccaccatcgacgggatcgtggcgatcgacctggaccccgtggtctacgacgccaagttcgagaagcagctcggccagatcatgctgctgatcctctgcacctcccagatcctgctgatgcgcacgacctgggccctctgcgagagcatcaccctggccaccggccccctgacgaccctctgggaggggtccccgggcaagttctggaacaccaccatcgccgtgagcatggcgaacatcttccgggggtcctacctggccggcgccggcctggccttcagcctcatgaagtccctcgggggcgggcgccgggggacgggggcgcagggcgagaccctgggcgagaagtggaagcgccagctcaaccagctgtccaagagcgagttcaacacctacaagcggtccgggatcatggaggtggaccgcagcgaggccaaggagggcctgaagcgcggggagaccacgaagcacgccgtctcccgcggcaccgccaagctccggtggttcgtggagcgcaacctggtgaagcccgaggggaaggtcatcgacctgggctgcggccgcgggggctggagctactactgcgccgggctgaagaaggtgaccgaggtgaagggctacaccaagggcggccccggccacgaggagcccatcccgatggcgacgtacgggtggaacctcgtcaagctgcactccggcaaggacgtgttcttcatcccgcccgagaagtgcgacaccctgctctgcgacatcggggagagctcccccaacccgaccatcgaggagggccgcaccctgcgggtgctgaagatggtcgagccctggctccgcgggaaccagttctgcatcaagatcctgaacccctacatgcccagcgtggtggagacgctggagcagatgcagcggaagcacggcggcatgctcgtccgcaacccgctgtcccggaacagcacccacgagatgtactgggtgtcctgcgggaccggcaacatcgtgagcgccgtcaacatgacctcccgcatgctgctcaaccggttcaccatggcccaccgcaagcccacgtacgagcgcgacgtggacctgggggccggcacccggcacgtggccgtcgagcccgaggtggcgaacctggacatcatcggccagcgcatcgagaacatcaagcacgagcacaagagcacctggcactacgacgaggacaacccctacaagacctgggcctaccacgggtcctacgaggtgaagccgagcggctccgccagcagcatggtcaacggggtggtcaagctcctgacgaagccctgggacgtgatccccatggtgacccagatcgccatgaccgacaccacgcccttcggccagcagcgggtcttcaaggagaaggtggacacccgcaccccgaaggccaagcgggggaccgcgcagatcatggaggtgacggcccgctggctgtggggcttcctctcccggaacaagaagccccgcatctgcacccgggaggagttcacccgcaaggtccggagcaacgccgccatcggcgcggtgttcgtggacgagaaccagtggaactccgccaaggaggccgtcgaggacgaccgcttctgggacctggtgcaccgggagcgcgagctgcacaagcaggggaagtgcgcgacctgcgtgtacaacatgatgggcaagcgggagaagaagctcggggagttcggcaaggccaaggggagccgcgcgatctggtacatgtggctgggcgcccggttcctggagttcgaggccctcggcttcatgaacgaggaccactggttctcccgcgagaacagcctgtccggggtcgagggcgaggggctgcacaagctcggctacatcctgcgggacatcagcaagatccccgggggcaacatgtacgccgacgacacggccggctgggacacccgcatcaccgaggacgacctgcagaacgaggcgaagatcaccgacatcatggagccggagcacgccctcctggccaagtccatcttcaagctgacgtaccagaacaaggtggtgcgggtccagcgccccgccaagaacgggaccgtgatggacgtgatcagccgccgggaccagcgcggctccgggcaggtcggcacctacggcctcaacaccttcacgaacatggaggcccagctgatccggcagatggagagcgaggggatcttcctgcccaacgagctcgagacccccaacctggcgggccgcgtgctggactggctcgagaagtacggggtggagcggctgaagcgcatggccatctccggcgacgactgcgtcgtgaagccgatcgacgaccggttcgccaccgccctgaccgccctcaacgacatggggaaggtgcgcaaggacatcccccagtgggagcccagcaagggctggaacgactggcagcaggtccccttctgctcccaccacttccaccagctgatcatgaaggacggccgggagatcgtggtgccgtgccgcaaccaggacgagctggtcgggcgggcgcgcgtgagccagggcgccgggtggtccctccgggagacggcctgcctgggcaagagctacgcccagatgtggcagctgatgtacttccaccgccgggacctccgcctggcggccaacgccatctgcagcgccgtgcccgtcgactgggtgcccacctcccggaccacctggagcatccacgcccaccaccagtggatgacgaccgaggacatgctgtccgtgtggaaccgcgtctggatcgaggagaacccctggatggaggacaagacccggatcagctcctgggaggacgtgccgtacctcgggaagcgcgaggaccagtggtgcggcagcctgatcggcctgaccgcgcgcgccacgtgggccaccaacatccaggtggccatcaaccaggtccggcgcctcatcgggaacgagaactactccgactacatgaccagcatgaagcggttcaagaacgagtccgagcccgagggcgccctgtggtga

SEQ ID NO: 8380 - RNA, 9879 nt, synthetic construct
  misc_feature 1..9879: note = derived and/or modified CDS sequence (opt1) from DENV-1__FJ461307__SS-prME
  source 1..9879: mol_type = other RNA
agcgtgaccatgctgctgatgctgatgcccaccgccctggccttccacctcaccacccggggcggggagccccacatgatcgtcagcaagcaggagcggggcaagagcctgctgttcaagaccagcgccggggtgaacatgtgcaccctcatcgccatggacctgggcgagctgtgcgaggacaccatgacctacaagtgcccccggatcaccgaggccgagcccgacgacgtggactgctggtgcaacgccaccgacacgtgggtcacctacgggacctgcagccagaccggcgagcaccggcgggagaagcggtccgtggccctcgcgccccacgtgggcctggggctggagacgcggaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcctgacgtgcgccaagttcaagtgcgtgaccaagctggagggcaagatcgtccagtacgagaacctcaagtacagcgtgatcgtgaccgtccacaccggcgaccagcaccaggtggggaacgagtccacggagcacggcaccaccgcgaccatcacgccccaggcccccacgaccgagatccagctgaccgactacggggccctgaccctcgactgcagcccccgcacgggcctggacttcaacgagatggtcctgctcaccatgaaggagaagtcctggctggtgcacaagcagtggttcctggacctccccctgccctggaccagcggggccagcacctcccaggagacgtggaaccggcaggacctgctcgtgaccttcaagaccgcccacgcgaagaagcaggaggtcgtggtgctgggcagccaggagggcgccatgcacaccgccctgacgggggccaccgagatccagacctccggcaccacgaccatcttcgccgggcacctcaagtgccgcctgaagatggacaagctgaccctcaagggcatgagctacgtcatgtgcaccgggtccttcaagctggagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctcaagctgagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctcgtgcaccagatcttcggcaccgcctacggggtgctgttctccggcgtcagctggaccatgaagatcgggatcggcgtgctgctcacgtggctgggcctgaactcccgcagcacctccctcagcatgacctgcatcgccgtggggctggtcaccctgtacctcggcgtgatggtgcaggccgactccgggtgcgtcatcaactggaagggccgggagctgaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctcgagaacatcatgtggaagcagatctccaacgagctgaaccacatcctgctcgagaacgacatgaagttcaccgtggtggtcggggacgtggcgggcatcctggtgcaggggaagaagatgatccggccccagcccatggagtacaagtacagctggaagtcctggggcaaggccaagatcatcggcgccgacgtccagaacagcacgttcatcatcgacgggcccaacaccccggagtgccccgacgaccagcgcgcctggaacatctgggaggtggaggactacggcttcgggatcttcaccaccaacatctggctgaagctccgggactcctacacccaggtgtgcgaccaccgcctgatgagcgcggccatcaaggactccaaggccgtccacgccgacatgggctactggatcgagagcgagaagaacgagacctggaagctggcccgggcgtccttcatcgaggtgaagacctgcatctggcccaagagccacaccctctggtccaacggcgtgctggagagcgagatgatcatccccaagatccacgggggcccgatctcccagcacaactaccgccccgggtacttcacgcagaccgccggcccctggcacctggggaagctcgagctggacttcgacctgtgcgagggcaccaccgtcgtggtggacgagcactgcggcaaccgggggccgagcctccgcacgaccaccgtcaccggcaagatcatccacgagtggtgctgccggtcctgcacgctgccgcccctgcgcttccgcggggaggacggctgctggtacgggatggagatccgccccgtgaaggagaaggaggagaacctcgtgaagtccatggtcagcgccggctccggcgaggtggacagcttctccctggggctgctctgcatcagcatcatgatcgaggaggtgatgcggtcccgctggagccggaagatgctgatgaccggcaccctggccgtcttcttcctcctgatcatggggcagctgacctggaacgacctcatccgcctgtgcatcatggtgggcgccaacgcgtccgaccgcatggggatgggcacgacctacctggccctcatggccaccttcaagatgcggccgatgttcgccgtgggcctgctgttccgccggctcaccagccgcgaggtcctgctgctcacgatcgggctgtccctggtggccagcgtcgagctccccaactccctggaggagctgggcgacgggctcgcgatgggcatcatgatcctgaagctgctcaccgacttccagagctaccagctgtgggccaccctgctctccctgaccttcatcaagacgaccttcagcctgcactacgcctggaagaccatggccatggtgctctccatcgtgagcctgttccccctgtgcctctccaccacgagccagaagaccacctggctgcccgtcctgctcggctccctggggtgcaagccgctgaccatgttcctcatcgcggagaacaagatctggggccgcaagagctggcccctgaacgaggggatcatggccgtgggcatcgtgagcatcctgctctccagcctgctgaagaacgacgtccccctcgccgggcccctgatcgccggcggcatgctgatcgcctgctacgtgatctccgggagctccgcggacctcagcctggagaaggccgccgaggtgtcctgggaggaggaggccgagcacagcggcgcctcccacaacatcctggtcgaggtgcaggacgacgggacgatgaagatcaaggacgaggagcgcgacgacaccctcaccatcctgctgaaggcgaccctcctggccgtgagcggcgtctacccgctgtccatccccgccaccctcttcgtgtggcacttctggcagaagaagaagcagcggagcggggtgctgtgggacacgcccagcccgcccgaggtcgagcgcgccgtgctggacgacggcatctaccggatcatgcagcgcggcctgctcgggcggagccaggtgggcgtcggggtgttccaggagaacgtgttccacaccatgtggcacgtcacccgcggcgccgtgctgatgtaccaggggaagcggctggagccctcctgggcgagcgtgaagaaggacctcatctcctacggcggcgggtggcgcttccagggcagctggaacaccggggaggaggtccaggtgatcgccgtggagcccggcaagaaccccaagaacgtccagacggcccccgggaccttcaagacccccgagggcgaggtgggcgccatcgccctggacttcaagcccgggacctccggcagccccatcgtgaaccgggaggggaagatcgtcggcctgtacggcaacggggtggtgacgaccagcggcacctacgtctccgcgatcgcccaggccaaggccagccaggaggggccgctccccgagatcgaggacgaggtgttccgcaagcggaacctgaccatcatggacctgcaccccggctccgggaagacgcgccggtacctcccggcgatcgtgcgcgaggccatcaagcggaagctgcgcaccctgatcctcgcccccacccgcgtcgtggccagcgagatggccgaggcgctgaagggcatgcccatccggtaccagaccacggccgtgaagtccgagcacaccggcaaggagatcgtcgacctgatgtgccacgccaccttcaccatgcgcctcctgagccccgtgcgggtgccgaactacaacatgatcatcatggacgaggcccacttcacggacccctccagcatcgccgcgcgcgggtacatctccacccgggtcggcatgggggaggccgccgccatcttcatgaccgccacgccgcccggcagcatggaggcgttcccgcagtccaacgccgtgatccaggacgaggagcgcgacatccccgagcggagctggaactccgggtacgagtggatcacggacttccccggcaagaccgtgtggttcgtccccagcatcaaggccggcaacgacatcgccaactgcctgcgcaagaacgggaagcgggtgatccagctctcccgcaagaccttcgacaccgagtaccagaagacgaagaacaacgactgggactacgtggtcaccaccgacatcagcgagatgggcgcgaacttccgggccgaccgcgtgatcgacccgcggcgctgcctgaagcccgtgatcctgaaggacgggcccgagcgggtcatcctcgccggccccatgccggtgaccgtcgcctccgccgcgcagcgccgggggcgcatcggccggaaccacaacaaggagggcgaccagtacatctacatggggcagcccctgaacaacgacgaggaccacgcccactggacggaggccaagatgctgctcgacaacatcaacacccccgagggcatcatccccgccctgttcgagccggagcgcgagaagtccgccgcgatcgacggggagtaccgcctgcggggcgaggcccgcaagaccttcgtggagctcatgcggcgcggggacctgcccgtgtggctgtcctacaaggtcgccagcgagggcttccagtacagcgaccggcgctggtgcttcgacggcgagcggaacaaccaggtgctcgaggagaacatggacgtggagatctggaccaaggagggggagcgcaagaagctgcggccccgctggctggacgcccggacgtactccgaccccctcgccctgcgcgagttcaaggagttcgcggccggccggcgcagcgtctccggggacctgatcctcgagatcggcaagctgccgcagcacctgacccagcgggcccagaacgccctcgacaacctggtgatgctgcacaacagcgagcagggcgggcgcgcgtaccggcacgccatggaggagctccccgacaccatcgagaccctgatgctgctcgccctgatcgccgtgctgacgggcggggtcaccctcttcttcctgtccggcaaggggctgggcaagaccagcatcggcctcctgtgcgtgatggcctccagcgtgctgctctggatggcgtccgtcgagccccactggatcgccgccagcatcatcctggagttcttcctgatggtgctcctgatccccgagccggaccgccagcggacgccccaggacaaccagctggcctacgtggtcatcgggctcctgttcatgatcctgaccgtggccgcgaacgagatgggcctcctggagacgaccaagaaggacctggggatcggccacgtggccgtcgagaaccaccaccacgccgccatgctcgacgtggacctgcaccccgcctccgcgtggaccctgtacgccgtggccaccacgatcatcaccccgatgatgcgccacaccatcgagaacaccacggccaacatcagcctcaccgccatcgcgaaccaggccgccatcctgatggggctggacaagggctggcccatctccaagatggacatcggcgtccccctcctggccctggggtgctacagccaggtgaaccccctcaccctgaccgcggccgtgctgatgctcgtcgcccactacgccatcatcggcccggggctgcaggccaaggcgacgcgggaggcccagaagcgcaccgccgccggcatcatgaagaaccccaccatcgacgggatcgtggccatcgacctggaccccgtggtctacgacgcgaagttcgagaagcagctcggccagatcatgctgctgatcctctgcacctcccagatcctgctgatgcgcacgacctgggccctctgcgagagcatcaccctggccaccggccccctgacgaccctctgggaggggtccccgggcaagttctggaacaccaccatcgccgtgagcatggccaacatcttccgggggtcctacctggcgggcgccggcctggccttcagcctcatgaagtccctcgggggcgggcgccgggggacgggggcccagggcgagaccctgggcgagaagtggaagcgccagctcaaccagctgtccaagagcgagttcaacacctacaagcggtccgggatcatggaggtggaccgcagcgaggcgaaggagggcctgaagcgcggggagaccacgaagcacgccgtctcccgcggcaccgccaagctccggtggttcgtggagcgcaacctggtgaagcccgaggggaaggtcatcgacctgggctgcggccgcgggggctggagctactactgcgccgggctgaagaaggtgaccgaggtgaagggctacaccaagggcggccccggccacgaggagcccatcccgatggccacgtacgggtggaacctcgtcaagctgcactccggcaaggacgtgttcttcatcccgcccgagaagtgcgacaccctgctctgcgacatcggggagagctcccccaacccgaccatcgaggagggccgcaccctgcgggtgctgaagatggtcgagccctggctccgcgggaaccagttctgcatcaagatcctgaacccctacatgcccagcgtggtggagacgctggagcagatgcagcggaagcacggcggcatgctcgtccgcaacccgctgtcccggaacagcacccacgagatgtactgggtgtcctgcgggaccggcaacatcgtgagcgcggtcaacatgacctcccgcatgctgctcaaccggttcaccatggcccaccgcaagcccacgtacgagcgcgacgtggacctgggggccggcacccggcacgtggccgtcgagcccgaggtggccaacctggacatcatcggccagcgcatcgagaacatcaagcacgagcacaagagcacctggcactacgacgaggacaacccctacaagacctgggcgtaccacgggtcctacgaggtgaagccgagcggctccgccagcagcatggtcaacggggtggtcaagctcctgacgaagccctgggacgtgatccccatggtgacccagatcgccatgaccgacaccacgcccttcggccagcagcgggtcttcaaggagaaggtggacacccgcaccccgaaggccaagcgggggaccgcccagatcatggaggtgacggcgcgctggctgtggggcttcctctcccggaacaagaagccccgcatctgcacccgggaggagttcacccgcaaggtccggagcaacgccgccatcggcgccgtgttcgtggacgagaaccagtggaactccgcgaaggaggccgtcgaggacgaccgcttctgggacctggtgcaccgggagcgcgagctgcacaagcaggggaagtgcgcgacctgcgtgtacaacatgatgggcaagcgggagaagaagctcggggagttcggcaaggccaaggggagccgcgccatctggtacatgtggctgggcgcgcggttcctggagttcgaggccctcggcttcatgaacgaggaccactggttctcccgcgagaacagcctgtccggggtcgagggcgaggggctgcacaagctcggctacatcctgcgggacatcagcaagatccccgggggcaacatgtacgccgacgacacggccggctgggacacccgcatcaccgaggacgacctgcagaacgaggccaagatcaccgacatcatggagccggagcacgcgctcctggccaagtccatcttcaagctgacgtaccagaacaaggtggtgcgggtccagcgccccgccaagaacgggaccgtgatggacgtgatcagccgccgggaccagcgcggctccgggcaggtcggcacctacggcctcaacaccttcacgaacatggaggcccagctgatccggcagatggagagcgaggggatcttcctgcccaacgagctcgagacccccaacctggccggccgcgtgctggactggctcgagaagtacggggtggagcggctgaagcgcatggcgatctccggcgacgactgcgtcgtgaagccgatcgacgaccggttcgccaccgccctgaccgccctcaacgacatggggaaggtgcgcaaggacatcccccagtgggagcccagcaagggctggaacgactggcagcaggtccccttctgctcccaccacttccaccagctgatcatgaaggacggccgggagatcgtggtgccgtgccgcaaccaggacgagctggtcgggcgggcccgcgtgagccagggcgcggggtggtccctccgggagacggcctgcctgggcaagagctacgcccagatgtggcagctgatgtacttccaccgccgggacctccgcctggccgcgaacgccatctgcagcgccgtgcccgtcgactgggtgcccacctcccggaccacctggagcatccacgcccaccaccagtggatgacgaccgaggacatgctgtccgtgtggaaccgcgtctggatcgaggagaacccctggatggaggacaagacccggatcagctcctgggaggacgtgccgtacctcgggaagcgcgaggaccagtggtgcggcagcctgatcggcctgaccgcccgcgcgacgtgggccaccaacatccaggtggccatcaaccaggtccggcgcctcatcgggaacgagaactactccgactacatgatcagcatgaagcggttcaagaacgagtccgagcccgagggcgccctgtggtga

SEQ ID NO: 8381 - RNA, 9879 nt, synthetic construct
  misc_feature 1..9879: note = derived and/or modified CDS sequence (opt1) from DENV-1__FJ410213__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgccggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtgacctacgggacctgcagccagacgggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccgtgggcggcgtgttcaccagcgtcgggaagctggtgcaccagatcttcggcaccgcctacggggtcctgttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggccgactccgggtgcgtcatcaactggaagggccgggagctcaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctggagaacatcatgtggaagcagatctccaacgagctcaaccacatcctgctggagaacgacatgaagttcaccgtggtggtcggggacgtggtgggcatcctcgcgcaggggaagaagatgatccggccccagcccatggagcacaagtacagctggaagtcctggggcaaggccaagatcatcggcgccgacgtccagaacacgaccttcatcatcgacgggcccaacaccccggagtgccccgacgaccagcgcgcctggaacatctgggaggtggaggactacggcttcgggatcttcaccacgaacatctggctgaagctgcgggacagctacacccaggtgtgcgaccaccgcctcatgtccgcggccatcaaggacagcaaggccgtccacgccgacatgggctactggatcgagtccgagaagaacgagacctggaagctggcccgggcgagcttcatcgaggtgaagacctgcatctggcccaagtcccacacgctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcaccacggtcgtggtggacgagcactgcggcaaccgggggccgtccctgcgcaccaccaccgtcacgggcaagatcatccacgagtggtgctgccggagctgcaccctgccgcccctccgcttcaagggggaggacggctgctggtacgggatggagatccggcccgtgaaggagaaggaggagaacctggtgaagtccatggtcagcgccggcagcggcgaggtggactccttcagcctcgggctgctgtgcatctccatcatgatcgaggaggtgatgcgcagccggtggtcccgcaagatgctcatgaccggcaccctggccgtcttcctgctcctgatcatggggcagctgacgtggaacgacctcatccggctgtgcatcatggtgggcgccaacgcgagcgaccgcatggggatgggcaccacctacctggccctcatggccaccttcaagatgcgcccgatgttcgccgtggggctgctgttccggcgcctcacgtcccgggaggtcctgctgctcaccatcgggctgagcctggtggcctccgtcgagctccccaacagcctggaggagctgggcgacgggctcgcgatgggcatcatgatcctgaagctgctcaccgacttccagtcccaccagctgtgggccaccctgctcagcctgacgttcatcaagaccaccctgtccctccactacgcctggaagaccatggccatggtgctgagcatcgtgtccctgttccccctctgcctgagcacgacctcccagaagaccacctggctgcccgtcctcctgggcagcctggggtgcaagccgctcacgatgttcctgatcaccgagaacaagatctggggccgcaagtcctggcccctgaacgaggggatcatggcggtgggcgtggtcagcatcctcctgagctccctgctcaaggacgacgtgcccctggccgggcccctgatcgccggcggcatgctcatcgcctgctacgtgatcagcgggtccagcgccgacctgtccctggagaaggcggccgaggtcagctgggaggaggaggccgagcactccggcgccagccacaacatcctcgtggaggtgcaggacgacgggaccatgaagatcaaggacgaggagcgggacgacaccctgaccatcctgctcaaggccacgctgctggcggtctccggcgtgtacccgctcagcatccccgccaccctgttcgtgtggtacttctggcagaagaagaagcagcgctccggggtcctgtgggacacccccagcccgcccgaggtggagcgggccgtgctggacgacggcatctaccgcatcatgcagcggggcctcctggggcgctcccaggtcggcgtgggggtgttccaggagaacgtcttccacaccatgtggcacgtgacgcggggcgccgtgctgatgtaccaggggaagcgcctcgagcccagctgggcctccgtcaagaaggacctgatcagctacggcggcgggtggcggctgcagggctcctggaacaccggggaggaggtccaggtgatcgcggtcgagcccggcaagaaccccaagaacgtgcagaccgcccccgggaccttcaagacgcccgagggcgaggtgggcgccatcgccctcgacttcaagcccgggaccagcggctcccccatcgtcaaccgcgaggggaagatcgtgggcctgtacggcaacggggtggtcaccaccagcggcacgtacgtgagcgccatcgcgcaggccaaggcctcccaggaggggccgctgcccgagatcgaggacgaggtgttccggaagcgcaacctcaccatcatggacctgcaccccggcagcgggaagacccggcgctacctgccggccatcgtccgggaggcgatcaagcgcaagctccggaccctgatcctggcccccacgcgcgtggtggcctccgagatggccgaggccctcaagggcatgcccatccgctaccagaccaccgcggtcaagagcgagcacaccggcaaggagatcgtggacctgatgtgccacgccacgttcaccatgcggctgctctcccccgtgcgcgtcccgaactacaacatgatcatcatggacgaggcccacttcaccgaccccagctccatcgccgcccgggggtacatcagcacccgcgtgggcatgggggaggcggccgccatcttcatgacggccacgccgcccggctccgtggaggccttcccgcagagcaacgcggtcatccaggacgaggagcgggacatccccgagcgctcctggaacagcgggtacgagtggatcaccgacttccccggcaagaccgtgtggttcgtgccctccatcaagagcggcaacgacatcgccaactgcctgcggaagaacgggaagcgcgtcatccagctgtcccggaagacgttcgacaccgagtaccagaagaccaagaacaacgactgggactacgtggtgaccacggacatcagcgagatgggcgccaacttccgcgccgaccgggtcatcgacccgcgccggtgcctcaagcccgtgatcctgaaggacgggcccgagcgcgtcatcctggcgggccccatgccggtgaccgtggcctccgccgcccagcggcgcgggcggatcggccgcaaccacaacaaggagggcgaccagtacatctacatggggcagcccctcaacaacgacgaggaccacgcccactggaccgaggcgaagatgctgctggacaacatcaacacccccgagggcatcatccccgccctcttcgagccggagcgggagaagtccgccgccatcgacggggagtaccgcctgcgcggcgaggcccggaagacgttcgtcgagctgatgcgccgcggggacctccccgtgtggctgtcctacaaggtggcgagcgagggcttccagtacagcgaccgccggtggtgcttcgacggcgagcgcaacaaccaggtcctggaggagaacatggacgtggagatctggaccaaggagggggagcggaagaagctccgcccccggtggctggacgcccgcacctactccgaccccctggccctccgggagttcaaggagttcgccgccggccgccggagcgtgtccggggacctgatcctggagatcggcaagctcccgcagcacctgacccagcgcgcgcagaacgccctggacaacctcgtcatgctgcacaacagcgagcagggcgggcgggcctaccgccacgccatggaggagctgcccgacacgatcgagaccctcatgctgctggcgctcatcgccgtgctgaccggcggggtgaccctgttcttcctctccggccgggggctgggcaagaccagcatcggcctgctctgcgtcatggcctccagcgtgctgctgtggatggcctccgtggagccccactggatcgccgcgagcatcatcctcgagttcttcctgatggtcctgctcatccccgagccggaccgccagcggacgccccaggacaaccagctggcctacgtggtgatcgggctcctcttcatgatcctgaccgtcgccgccaacgagatgggcctgctcgagaccaccaagaaggacctggggatcggccacgtggccgtggagaaccaccaccacgcgacgatgctggacgtcgacctccaccccgcctccgcctggaccctgtacgccgtggccaccaccatcatcacgccgatgatgcgccacaccatcgagaacaccaccgcgaacatcagcctgacggccatcgccaaccaggccgccatcctcatggggctggacaagggctggcccatctccaagatggacatcggcgtgcccctgctcgcgctggggtgctacagccaggtcaaccccctgaccctcaccgccgccgtgctgatgctggtggcccactacgcgatcatcggcccggggctccaggccaaggccacccgggaggcccagaagcgcacggccgcgggcatcatgaagaaccccaccgtcgacgggatcgtggccatcgacctggaccccgtggtctacgacgccaagttcgagaagcagctgggccagatcatgctcctgatcctgtgcacctcccagatcctcctgatgcgcaccacgtgggccctgtgcgagagcatcaccctcgccaccggccccctgaccacgctgtgggaggggtccccgggcaagttctggaacaccaccatcgcggtgagcatggccaacatcttccgggggtcctacctcgccggcgccggcctggccttcagcctgatgaagtccctcgggggcgggcgccggggcaccggggcgcagggcgagacgctgggcgagaagtggaagcgccagctgaaccagctctccaagagcgagttcaacatctacaagcggtccgggatcatggaggtggaccgcagcgaggccaaggagggcctgaagcgcggggagaccacccgccacgccgtctcccggggcaccgccaagctgcgctggttcgtggagcggaacctggtgaagcccgaggggaaggtcatcgacctcggctgcggccgcgggggctggagctactactgcgcggggctgaagaaggtgacggaggtgaagggctacaccaagggcgggcccggccacgaggagcccatcccgatggccacctacgggtggaacctggtcaagctccactccggcaaggacgtgttcttcacgccgcccgagaagtgcgacacgctgctgtgcgacatcggggagagctcccccaacccgaccatcgaggagggccggaccctccgcgtgctgaagatggtcgagccctggctgcgggggaaccagttctgcatcaagatcctcaacccctacatgcccagcgtggtggagaccctggagcagatgcagcgcaagcacggcggcatgctggtccggaacccgctctcccgcaacagcacccacgagatgtactgggtgtcctgcgggacgggcaacatcgtgagcgccgtcaacatgacctcccggatgctgctgaaccgcttcaccatggcccaccgcaagcccacctacgagcgggacgtggacctcggggccggcacgcgccacgtggcggtcgagcccgaggtggccaacctggacatcatcggccagcggatcgagaacatcaagcacgagcacaagagcacctggcactacgacgaggacaacccctacaagacctgggcctaccacgggtcctacgaggtcaagccgagcggctccgccagcagcatggtgaacggggtggtcaagctgctcaccaagccctgggacgtgatccccatggtgacgcagatcgccatgaccgacaccacccccttcggccagcagcgcgtcttcaaggagaaggtggacacgcggaccccgaaggcgaagcgcgggaccgcccagatcatggaggtgaccgcccggtggctgtggggcttcctgtcccgcaacaagaagccccggatctgcacgcgcgaggagttcacccggaaggtccgcagcaacgccgccatcggcgcggtgttcgtggacgagaaccagtggaactccgccaaggaggccgtcgaggacgagcggttctgggacctcgtgcagaaggagcgcgagctgcacaagcaggggaagtgcgcgacctgcgtgtacaacatgatgggcaagcgggagaagaagctgggggagttcggcaaggcgaaggggagccgcgccatctggtacatgtggctcggcgcccggttcctggagttcgaggccctgggcttcatgaacgaggaccactggttctcccgcgagaacagcctctccggggtcgagggcgaggggctgcacaagctgggctacatcctccgggacatcagcaagatccccgggggcaacatgtacgccgacgacaccgcgggctgggacacgcgcatcaccgaggacgacctgcagaacgaggccaagatcaccgacatcatggagccggagcacgccctgctcgccacctccatcttcaagctgacgtaccagaacaaggtggtgcgggtccagcgccccgccaagaacgggaccgtgatggacgtgatcagccgccgggaccagcgcggctccgggcaggtcggcacctacggcctgaacaccttcacgaacatggaggcgcagctcatccggcagatggagagcgaggggatcttcctgccctccgagctggagacccccaacctcgccgagcgcgtgctggactggctggagaagtacggcgtggagcggctcaagcgcatggccatcagcggggacgactgcgtcgtgaagccgatcgacgaccggttcgccaccgccctgaccgcgctgaacgacatgggcaaggtgcgcaaggacatcccccagtgggagccctccaaggggtggaacgactggcagcaggtccccttctgcagccaccacttccaccagctcatcatgaaggacggccgggagatcgtggtgccgtgccgcaaccaggacgagctggtcggccgggcccgcgtgtcccagggggccggctggagcctgcgggagacggcctgcctcggcaagagctacgcccagatgtggcagctgatgtacttccaccgccgggacctgcgcctcgcggccaacgccatctgctccgccgtgcccgtcgactgggtgcccaccagccggaccacctggtccatccacgcgcaccaccagtggatgacgaccgaggacatgctgagcgtgtggaaccgcgtctggatcgaggagaacccctggatggaggacaagacccacgtgtccagctggggcgacgtgccgtacctggggaagcgggaggaccagtggtgcggctccctcatcggcctgaccgcccgcgccacctgggccagcaacatccaggtcgccatcaaccaggtgcgccggctgatcgggaacgagaactacctcgactacatgacgtccatgaagcgcttcaagaacgagggcgaccccgagggggcgctgtggtga

SEQ ID NO: 8382 - RNA, 9879 nt, synthetic construct
  misc_feature 1..9879: note = derived and/or modified CDS sequence (opt1) from DENV-1__FJ461308__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgcgggggtgaacatgtgcaccctcatcgccatggacctgggcgagttctgcgaggacaccatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcgccgagacctggatgagctccgagggcgcctggaagcagatccagcgggtggagacctgggccctgcgccaccccgggttcaccgtgatcgccctgttcctggcccacgccatcggcacgagcatcacccagaaggggatcatcttcatcctgctcatgctggtgaccccctccatggccatgcggtgcgtcggcatcggcagccgcgacttcgtggaggggctgtccggcgccacctgggtggacgtcgtgctcgagcacgggagctgcgtgacgaccatggcgaaggacaagcccaccctggacatcgagctgctcaagaccgaggtcacgaaccccgccgtgctgcggaagctgtgcatcgaggccaagatctccaacaccaccaccgacagccgctgcccgacgcagggcgaggccaccctcgtggaggagcaggacgccaacttcgtctgccggcgcaccttcgtggaccggggctgggggaacggctgcgggctgttcggcaaggggtccctgatcacgtgcgcgaagttcaagtgcgtgacgaagctcgagggcaagaccgtccagtacgagaacctgaagtacagcgtgatcgtgaccgtccacaccggcgaccagcaccaggtggggaacgagtccacggagcacggcaccaccgccaccatcacgccccaggcccccagcacggagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggaccagcggggcctccaccagccaggagacctggaaccggaaggacctcctggtgacgttcaagaccgcgcacgccaagaagcaggaggtcgtggtgctgggctcccaggagggcgccatgcacaccgccctcaccggggccacggagatccagaccagcggcaccaccacgatcttcgcggggcacctgaagtgccgcctgaagatggacaagctcaccctgaagggcatgtcctacgtcatgtgcaccgggagcttcaagctggagaaggaggtggccgagacccagcacggcacggtgctcgtccagatcaagtacgagggcaccgacgccccctgcaagatccccttctccacccaggacgagaagggggtgacccagaacggccggctgatcacggccaacccgatcgtgaccgacaaggagaagcccgtcaacatcgaggcggagccgcccttcggggagagctgcatcgtgatcggcgccggcgagaaggccctgaagctgtcctggttcaagaaggggagctccatcggcaagatgttcgaggccaccgcccgcggggcgcggcgcatggccatcctcggcgacaccgcctgggacttcgggagcatcggcggcgtgttcacgtccgtcgggaagctggtgcaccagatcttcggcaccgcctacggggtgctgttcagcggcgtctcctggaccatgaagatcgggatcggcgtgctcctgacctggctgggcctcaacagccgctccacgagcctgtccatgacctgcatcgccgtggggctggtcaccctctacctgggcgtgatggtgcaggcggacagcgggtgcgtcatcaactggaagggccgggagctgaagtgcgggagcggcatcttcgtgaccaacgaggtgcacacgtggaccgagcagtacaagttccaggccgactccccgaagcgcctcagcgccgccatcggcaaggcctgggaggagggggtctgcggcatccggtccgcgacccgcctggagaacatcatgtggaagcagatcagcaacgagctgaaccacatcctcctggagaacgacatgaagttcaccgtggtggtcggggacgtggccggcatcctggcccaggggaagaagatgatccggccccagcccatggagcacaagtactcctggaagtcctggggcaaggccaagatcatcggcgcggacgtgcagaacaccacgttcatcatcgacgggcccaacaccccggagtgccccgacgaccagcgcgcctggaacatctgggaggtcgaggactacggcttcgggatcttcaccaccaacatctggctcaagctgcgggactcctacacccaggtgtgcgaccaccgcctgatgagcgccgccatcaaggactccaaggccgtgcacgcggacatgggctactggatcgagagcgagaagaacgagacctggaagctcgcccgggcctccttcatcgaggtcaagacctgcatctggcccaagagccacaccctgtggtccaacggcgtgctggagagcgagatgatcatccccaagatctacgggggcccgatctcccagcacaactaccgccccgggtacttcacgcagaccgccggcccctggcacctcgggaagctggagctggacttcgacctctgcgagggcaccaccgtggtcgtggacgagcactgcggcaaccgggggccgagcctgcgcacgaccaccgtgaccggcaagatcatccacgagtggtgctgccggtcctgcacgctgccgcccctgcgcttcaagggggaggacggctgctggtacgggatggagatccggcccgtcaaggagaaggaggagaacctggtcaagagcatggtgagcgccggctccggcgaggtcgacagcttctccctggggctcctgtgcatcagcatcatgatcgaggaggtgatgcgctcccggtggagccgcaagatgctgatgaccggcaccctcgcggtgttcttcctgctgatcatggggcagctcacctggaacgacctgatccggctgtgcatcatggtcggcgccaacgcctccgaccgcatggggatgggcacgacctacctcgccctgatggccaccttcaagatgcgcccgatgttcgcggtggggctcctcttccggcgcctgaccagccgggaggtgctgctcctgacgatcgggctgtccctcgtcgccagcgtggagctgcccaactccctggaggagctcggcgacgggctggccatgggcatcatgatcctgaagctcctgaccgacttccagagccaccagctgtgggccaccctcctgtccctgaccttcatcaagacgaccttcagcctccactacgcgtggaagaccatggccatggtcctgtccatcgtgagcctgttccccctctgcctgtccaccacgagccagaagaccacctggctgcccgtgctcctgggctccctggggtgcaagccgctcaccatgttcctgatcgccgagaacaagatctggggccgcaagagctggcccctgaacgaggggatcatggccgtcggcatcgtgagcatcctcctgtccagcctgctcaagaacgacgtgcccctggccgggcccctgatcgcgggcggcatgctcatcgcctgctacgtcatctccgggagctccgccgacctgagcctggagaaggccgccgaggtgtcctgggaggaggaggcggagcacagcggcgcctcccacaacatcctcgtggaggtccaggacgacgggacgatgaagatcaaggacgaggagcgggacgacaccctgaccatcctgctcaaggccaccctgctggccgtgagcggcgtgtacccgctctccatccccgccaccctgttcgtctggtacttctggcagaagaagaagcagcgcagcggggtgctgtgggacacgcccagcccgcccgaggtggagcgggcggtcctcgacgacggcatctaccgcatcatgcagcggggcctgctggggcgcagccaggtgggcgtgggggtcttccaggagaacgtgttccacaccatgtggcacgtgacccggggcgccgtcctgatgtaccaggggaagcgcctcgagccctcctgggccagcgtgaagaaggacctgatctcctacggcggcgggtggcggctgcagggcagctggaacaccggggaggaggtgcaggtcatcgccgtggagcccggcaagaaccccaagaacgtgcagacggcccccgggaccttcaagacctccgagggcgaggtcggcgcgatcgccctcgacttcaagcccgggaccagcggcagccccatcgtgaaccgcgaggggaagatcgtgggcctgtacggcaacggggtcgtgacgacctccggcacctacgtgagcgccatcgcccaggcgaaggcctcccaggaggggcccctgccggagatcgaggacgaggtcttccggaagcgcaacctcaccatcatggacctgcaccccggcagcgggaagacgcggcgctacctgcccgccatcgtgcgggaggccatcaagcgcaagctccggaccctgatcctggccccgacccgcgtggtcgcgtccgagatggccgaggccctcaagggcatgcccatccgctaccagaccacggccgtcaagagcgagcacaccggcaaggagatcgtggacctgatgtgccacgccaccttcaccatgcggctgctctcccccgtccgcgtgcccaactacaacatgatcatcatggacgaggcgcacttcacggacccgagctccatcgccgcccgggggtacatcagcacccgcgtgggcatgggggaggccgccgcgatcttcatgaccgccacgccgcccggctccgtcgaggccttcccccagagcaacgccgtgatccaggacgaggagcgggacatcccggagcgctcctggaacagcgggtacgagtggatcacggacttccccggcaagaccgtgtggttcgtcccctccatcaagagcggcaacgacatcgcgaactgcctgcggaagaacgggaagcgcgtgatccagctgtcccggaagaccttcgacaccgagtaccagaagacgaagaacaacgactgggactacgtggtcaccaccgacatcagcgagatgggcgccaacttccgcgccgaccgggtgatcgacccccgccggtgcctcaagccggtgatcctgaaggacgggcccgagcgcgtcatcctggccggccccatgcccgtgaccgtcgcctccgcggcccagcggcgcgggcggatcggccgcaaccacaacaaggagggcgaccagtacatctacatggggcagccgctcaacaacgacgaggaccacgcccactggacggaggccaagatgctgctggacaacatcaacacccccgagggcatcatccccgccctcttcgagcccgagcgggagaagtccgcggccatcgacggggagtaccgcctgcgcggcgaggcccggaagaccttcgtggagctgatgcgccgcggggacctcccggtgtggctgagctacaaggtcgcctccgagggcttccagtacagcgaccgccggtggtgcttcgacggcgagcgcaacaaccaggtgctggaggagaacatggacgtggagatctggaccaaggagggggagcggaagaagctccgcccccggtggctggacgcccgcacgtactccgaccccctggcgctccgggagttcaaggagttcgccgccggccgccggagcgtctccggggacctgatcctggagatcggcaagctcccccagcacctgacccagcgcgcccagaacgcgctggacaacctcgtgatgctgcacaacagcgagcagggcgggcgggcctaccgccacgccatggaggagctgccggacaccatcgagaccctcatgctgctggccctcatcgccgtgctgacgggcggggtcaccctgttcttcctctccggccgggggctgggcaagaccagcatcggcctgctctgcgtgatggcgtccagcgtgctgctgtggatggcctccgtcgagccccactggatcgccgccagcatcatcctcgagttcttcctgatggtgctgctcatccccgagcccgaccgccagcggaccccgcaggacaaccagctggcctacgtggtcatcgggctcctcttcatgatcctgaccgtggcggccaacgagatgggcctgctcgagacgaccaagaaggacctggggatcggccacgtggccgtcgagaaccaccaccacgccgccatgctggacgtggacctccaccccgcgtccgcctggaccctgtacgccgtggccaccacgatcatcacccccatgatgcgccacaccatcgagaacaccacggccaacatcagcctgaccgcgatcgccaaccaggccgccatcctcatggggctggacaagggctggccgatctccaagatggacatcggcgtccccctgctcgcgctggggtgctacagccaggtgaaccccctgaccctcaccgccgccgtgctgatgctggtcgcccactacgccatcatcggccccgggctccaggcgaaggccacgcgggaggcccagaagcgcaccgccgccggcatcatgaagaacccgaccgtggacgggatcgtggcgatcgacctggaccccgtcgtgtacgacgccaagttcgagaagcagctgggccagatcatgctcctgatcctgtgcacctcccagatcctcctgatgcgcacgacctgggccctgtgcgagagcatcaccctcgccaccggccccctgacgaccctgtgggaggggtcccccggcaagttctggaacaccaccatcgccgtgagcatggcgaacatcttccgggggagctacctcgccggcgccggcctggccttctccctgatgaagtccctcgggggcgggcgccggggcacgggggcgcagggcgagaccctgggcgagaagtggaagcgccagctgaaccagctctccaagagcgagttcaacacctacaagcggtccgggatcatggaggtcgaccgcagcgaggccaaggagggcctgaagcgcggggagaccacgaagcacgccgtgtcccgcggcaccgccaagctgcggtggttcgtggagcgcaacctcgtcaagccggaggggaaggtgatcgacctgggctgcggccgcggcgggtggagctactactgcgccgggctgaagaaggtgaccgaggtcaaggggtacaccaagggcgggcccggccacgaggagcccatccccatggcgacgtacgggtggaacctggtgaagctccactccggcaaggacgtgttcttcatcccgcccgagaagtgcgacaccctgctgtgcgacatcggggagagctcccccaaccccaccatcgaggagggccgcaccctccgggtcctgaagatggtggagccgtggctgcgcgggaaccagttctgcatcaagatcctcaacccctacatgcccagcgtggtcgagacgctggagcagatgcagcggaagcacggcggcatgctggtgcgcaaccccctctcccggaacagcacccacgagatgtactgggtgtcctgcgggaccggcaacatcgtcagcgccgtgaacatgacctcccgcatgctgctgaaccggttcaccatggcccaccgcaagccgacgtacgagcgcgacgtggacctcggggccggcacccggcacgtcgccgtggagcccgaggtggcgaacctggacatcatcggccagcgcatcgagaacatcaagcacgagcacaagagcacctggcactacgacgaggacaacccctacaagacctgggcctaccacgggtcctacgaggtcaagcccagcggcagcgcctccagcatggtgaacggggtcgtgaagctgctcacgaagccgtgggacgtgatccccatggtcacccagatcgccatgaccgacaccacgcccttcggccagcagcgggtgttcaaggagaaggtggacacccgcacccccaaggccaagcgggggaccgcgcagatcatggaggtcacggccaagtggctgtggggcttcctgtcccgcaacaagaagccgcggatctgcacccgcgaggagttcacccggaaggtgcgcagcaacgccgccatcggcgcggtgttcgtcgacgagaaccagtggaactccgccaaggaggccgtggaggacgagcggttctgggacctcgtgcaccgcgagcgggagctgcacaagcaggggaagtgcgcgacctgcgtctacaacatgatgggcaagcgcgagaagaagctgggggagttcggcaaggccaaggggagccgggcgatctggtacatgtggctcggcgcccgcttcctggagttcgaggccctgggcttcatgaacgaggaccactggttctcccgggagaacagcctctccggggtggagggcgaggggctgcacaagctgggctacatcctccgcgacatcagcaagatccccgggggcaacatgtacgccgacgacacggccggctgggacacccggatcaccgaggacgacctgcagaacgaggcgaagatcaccgacatcatggagcccgagcacgccctgctcgccaagtccatcttcaagctgacgtaccagaacaaggtggtccgcgtgcagcggccggccaagaacgggaccgtgatggacgtcatcagccgccgcgaccagcggggctccggccaggtgggcacctacggcctgaacaccttcacgaacatggaggcccagctcatccgccagatggagagcgaggggatcttctcccccagcgagctggagacccccaacctggcgggccgggtgctcgactggctggagaagcacggggtcgagcgcctgaagcggatggccatctccggcgacgactgcgtggtgaagcccatcgacgaccgcttcgccaccgccctcaccgccctgaacgacatggggaaggtccggaaggacatcccgcagtgggagcccagcaagggctggaacgactggcagcaggtccccttctgcagccaccacttccaccagctgatcatgaaggacggccgcgagatcgtggtcccctgccggaaccaggacgagctcgtggggcgcgcgcgggtgtcccagggcgccgggtggagcctgcgcgagacggcctgcctgggcaagtcctacgcccagatgtggcagctcatgtacttccaccggcgcgacctgcggctggcggccaacgccatctgcagcgccgtcccggtggactgggtgcccacctcccgcaccacctggagcatccacgcccaccaccagtggatgacgaccgaggacatgctctccgtctggaaccgggtgtggatcgaggagaacccctggatggaggacaagacccacatcagctcctggggcgacgtgccctacctgggcaagcgcgaggaccagtggtgcggcagcctgatcgggctcaccgcgcgggccacgtgggccaccaacatccaggtcgccatcaaccaggtgcgccgcctgatcggcaacgagaactacctggactacatgacctccatgaagcggttcaagaacgagagcgacccggagggggccctctggtga

SEQ ID NO: 8383 - RNA, 9879 nt, synthetic construct
  misc_feature 1..9879: note = derived and/or modified CDS sequence (opt1) from DENV-1__FJ461310__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtcacctacgggacctgcagccagaccggcgagcaccggcgggacaagcggtccgtggccctcgcgccccacgtgggcctggggctggagacgcgcaccgagacctggatgagctccgagggcgcctggaagcagatccagcgggtcgagacctgggccctccggcaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtgctgttctccggcgtcagctggaccatgaagatcgggatcggcgtgctgctgacgtggctcggcctgaactcccgcagcacctccctgagcatgacctgcatcgccgtggggctcatcaccctgtacctgggcgtcatggtgcaggccgactccgggtgcgtgatcaactggaagggccgggagctcaagtgcgggagcggcatcttcgtcacgaacgaggtgcacacctggaccgagcagtacaagttccaggcggacagcccgaagcgcctgtccgccgccatcggcaaggcctgggaggagggggtgtgcggcatccggagcgccacccgcctggagaacatcatgtggaagcagatctccaacgagctcaaccacatcctgctggagaacgacatgaagttcaccgtcgtggtgggggacgtcgcgggcatcctcgcccaggggaagaagatgatccggccccagcccatggagtacaagtacagctggaagtcctggggcaaggccaagatcatcggcgccgacgtgcagaacacgaccttcatcatcgacgggcccaacaccccggagtgccccgacgaccagcgcgcgtggaacatctgggaggtggaggactacggcttcgggatcttcaccacgaacatctggctgaagctgcgggacagctacacccaggtctgcgaccaccgcctcatgtccgccgccatcaaggacagcaaggccgtgcacgccgacatgggctactggatcgagtccgagaagaacgagacctggaagctggcgcgggccagcttcatcgaggtgaagacctgcatctggcccaagtcccacacgctgtggagcaacggcgtcctcgagtccgagatgatcatccccaagatctacgggggcccgatcagccagcacaactaccgccccgggtacttcacccaggccgccggcccctggcacctggggaagctggagctcgacttcgacctgtgcgagggcaccaccgtggtggtcgacgagcactgcggcaaccgggggccgtccctgcgcacgaccaccgtgaccggcaagatcatccacgagtggtgctgccggagctgcacgctgccgcccctccgcttccgcggggaggacggctgctggtacgggatggagatccgccccgtgaaggagaaggaggagaacctggtcaagtccatggtgagcgccggcagcggcgaggtggactccttcagcctcgggctgctgtgcatctccatcatgatcgaggaggtcatgcggagccgctggtcccggcgcatgctcatgaccggcaccctggcggtgttcttcctgctcatcatggggcagctgacctggaacgacctgatccgcctctgcatcatggtgggcgccaacgccagcgaccggatggggatgggcacgacctacctggccctgatggccaccttcaagatgcgcccgatgttcgcggtcggcctcctgttccggcgcctgacctcccgggaggtgctcctgctgacgatcgggctcagcctggtggcctccgtcgagctgcccaacagcctcgaggagctgggcgacgggctggccatgggcatcatgatcctcaagctgctgaccgacttccagtcccaccagctctgggccaccctgctgagcctcaccttcatcaagacgaccttctccctgcactacgcgtggaagaccatggccatggtgctgagcatcgtctccctcttccccctgtgcctgagcaccacgtcccagaagaccacctggctccccgtgctgctgggcagcctcgggtgcaagccgctgaccatgttcctgatcgccgagaacaagatctggggccgccggtcctggcccctcaacgaggggatcatggccgtgggcatcgtcagcatcctgctgagctccctcctgaagaacgacgtgcccctggccgggcccctcatcgcgggcggcatgctgatcgcctgctacgtgatcagcgggtccagcgccgacctgtccctcgagaaggccgccgaggtcagctgggaggaggaggcggagcactccggcgccagccacaacatcctggtggaggtgcaggacgacgggacgatgaagatcaaggacgaggagcgcgacgacaccctgaccatcctcctgaaggccaccctgctcgccgtctccggcgtgtacccgctgagcatccccgccaccctgttcgtgtggtacttctggcagcggaagaagcagcgctccggggtcctctgggacacgcccagcccgcccgaggtggagcgggcggtgctggacgacggcatctaccgcatcatgcagcggggcctgctggggcgctcccaggtcggcgtgggggtgttccaggagaacgtcttccacaccatgtggcacgtgacccggggcgccgtgctcatgtaccaggggaagcgcctggagcccagctgggcctccgtcaagaaggacctgatcagctacggcggcgggtggcggctccagggctcctggaacaccggggaggaggtccaggtgatcgccgtcgagcccggcaagaaccccaagaacgtgcagacggcccccgggaccttcaagacccccgagggcgaggtgggcgcgatcgccctggacttcaagcccgggaccagcggctcccccatcgtcaaccgcgaggggaagatcgtgggcctgtacggcaacggggtggtcacgaccagcggcacctacgtgagcgccatcgcccaggcgaaggcctcccaggaggggccgctccccgagatcgaggacgaggtgttccggaagcgcaacctgaccatcatggacctgcaccccggcagcgggaagacgcggcgctacctcccggccatcgtccgcgaggccatcaagcggaagctgcgcaccctgatcctcgcccccacccgggtggtggcgtccgagatggccgaggccctgaagggcatgcccatccgctaccagaccacggccgtcaagagcgagcacaccggcaaggagatcgtggacctgatgtgccacgccaccttcaccatgcggctcctgtcccccgtgcgcgtcccgaactacaacatgatcatcatggacgaggcgcacttcacggaccccagctccatcgccgcccgggggtacatcagcacccgcgtgggcatgggggaggccgccgcgatcttcatgaccgccacgccgcccggctccgtggaggccttcccgcagagcaacgccgtcatccaggacgaggagcgggacatccccgagcgctcctggaacagcgggtacgagtggatcacggacttccccggcaagaccgtgtggttcgtgccctccatcaagagcggcaacgacatcgcgaactgcctgcggaagaacgggaagcgcgtcatccagctctcccggaagaccttcgacaccgagtaccagaagacgaagaacaacgactgggactacgtggtgaccaccgacatcagcgagatgggcgccaacttccgcgccgaccgggtcatcgacccgcgccggtgcctgaagcccgtgatcctgaaggacgggcccgagcgcgtgatcctcgccggccccatgccggtcaccgtggcctccgcggcccagcggcgcgggcgcatcggccggaaccacaacaaggagggcgaccagtacatctacatggggcagcccctgaacaacgacgaggaccacgcccactggacggaggccaagatgctgctcgacaacatcaacacccccgagggcatcatccccgccctgttcgagccggagcgcgagaagtccgcggccatcgacggggagtaccggctgcgcggcgaggcccggaagaccttcgtcgagctcatgcgccgcggggacctgcccgtgtggctgtcctacaaggtggccagcgagggcttccagtacagcgaccgccggtggtgcttcgacggcgagcgcaacaaccaggtcctcgaggagaacatggacgtggagatctggaccaaggagggggagcggaagaagctgcgcccccggtggctggacgcccgcacgtactccgaccccctcgcgctgcgggagttcaaggagttcgccgccggccgccggagcgtgtccggggacctgatcctcgagatcggcaagctgccgcagcacctgacccagcgcgcccagaacgcgctcgacaacctggtcatgctgcacaacagcgagcagggcgggcgggcctaccgccacgccatcgaggagctccccgacaccatcgagaccctgatgctgctcgccctgatcgccgtgctgacgggcggggtgaccctcttcttcctgtccggccgggggctgggcaagaccagcatcggcctcctgtgcgtcatggcgtccagcgtgctgctctggatggcctccgtggagccccactggatcgccgccagcatcatcctggagttcttcctgatggtcctcctgatccccgagccggaccgccagcgcacgccccaggacaaccagctggcctacgtggtgatcgggctcctgttcatgatcctgaccgtcgcggccaacgagatgggcctcctggagacgaccaagaaggacctggggatcggccacgtggccgtggagaaccaccaccacgccgccatgctcgacgtcgacctgcaccccgcgtccgcctggaccctgtacgccgtggccaccacgatcatcaccccgatgatgcggcacaccatcgagaacaccacggccaacatcagcctcaccgcgatcgccaaccaggccgccatcctgatggggctggacaagggctggcccatctccaagatggacatcggcgtgcccctcctggcgctggggtgctacagccaggtcaaccccctcaccctgaccgccgccgtgctgatgctcgtggcccactacgccatcatcggcccggggctgcaggcgaaggccacgcgcgaggcccagaagcggaccgccgccggcatcatgaagaaccccaccgtcgacgggatcgtggcgatcgacctggaccccgtggtctacgacgccaagttcgagaagcagctcggccagatcatgctgctgatcctctgcacctcccagatcctgctgatgcgcacgacctgggccctctgcgagagcatcaccctggccaccggccccctgacgaccctctgggaggggtccccgggcaagttctggaacaccaccatcgccgtgagcatggcgaacatcttccgggggtcctacctggccggcgccggcctggccttcagcctcatgaagtccctcgggggcgggcgccgggggacgggggcgcagggcgagaccctgggcgagaagtggaagcgccagctcaaccagctgtccaagagcgagttcaacacctacaagcggtccgggatcatggaggtggaccgcagcgaggccaaggagggcctgaagcgcggggagaccacgaagcacgccgtctcccgcggcaccgccaagctccggtggttcgtggagcgcaacctggtgaagcccgaggggaaggtcatcgacctgggctgcggccgcgggggctggagctactactgcgccgggctgaagaaggtgaccgaggtgaagggctacaccaagggcggccccggccacgaggagcccatcccgatggcgacgtacgggtggaacctcgtcaagctgcactccggcaaggacgtgttcttcatcccgcccgagaagtgcgacaccctgctctgcgacatcggggagagctcccccaacccgaccatcgaggagggccgcaccctgcgggtgctgaagatggtcgagccctggctccgcgggaaccagttctgcatcaagatcctgaacccctacatgcccagcgtggtggagacgctggagcagatgcagcggaagcacggcggcatgctcgtccgcaacccgctgtcccgcaacagcacccacgagatgtactgggtgtcctgcgggaccggcaacatcgtgagcgccgtcaacatgacctcccggatgctgctcaaccgcttcaccatggcccaccggaagcccacgtacgagcgcgacgtggacctgggggccggcacccggcacgtggccgtcgagcccgaggtggcgaacctggacatcatcggccagcgcatcgagaacatcaagcacgagcacaagagcacctggcactacgacgaggacaacccctacaagacctgggcctaccacgggtcctacgaggtgaagccgagcggctccgccagcagcatggtcaacggggtggtcaagctcctgacgaagccctgggacgtgatccccatggtgacccagatcgccatgaccgacaccacgcccttcggccagcagcgggtcttcaaggagaaggtggacacccgcaccccgaaggccaagcgggggaccgcgcagatcatggaggtgacggccaagtggctgtggggcttcctctcccgcaacaagaagccccggatctgcacccgcgaggagttcacccggaaggtccgcagcaacgccgccatcggcgcggtgttcgtggacgagaaccagtggaactccgccaaggaggccgtcgaggacgagcggttctgggacctggtgcaccgcgagcgggagctgcacaagcaggggaagtgcgcgacctgcgtgtacaacatgatgggcaagcgcgagaagaagctcggggagttcggcaaggccaaggggagccgggcgatctggtacatgtggctgggcgcccgcttcctggagttcgaggccctcggcttcatgaacgaggaccactggttctcccgggagaacagcctgtccggggtcgagggcgaggggctgcacaagctcggctacatcctgcgcgacatcagcaagatccccgggggcaacatgtacgccgacgacacggccggctgggacacccgcatcaccgaggacgacctgcagaacgaggcgcggatcaccgacatcatggagccggagcacgccctcctggccaagtccatcttcaagctgacgtaccagaacaaggtggtgcgcgtccagcggcccgccaagaacgggaccgtgatggacgtgatcagccgccgggaccagcgcggctccgggcaggtcggcacctacggcctcaacaccttcacgaacatggaggcccagctgatccggcagatggagagcgaggggatcttctcccccagcgagctggagacccccaacctcgcggagcgcgtgctggactggctggagaagtacggcgtggagcggctcaagcgcatggccatctccggggacgactgcgtcgtgaagccgatcgacgaccggttcgccaccgccctgaccgccctgaacgacatgggcaaggtgcgcaaggacatcccccagtgggagcccagcaaggggtggaacgactggcagcaggtccccttctgctcccaccacttccaccagctcatcatgaaggacggccgggagatcgtggtgccgtgccgcaaccaggacgagctggtcggccgggcgcgcgtgagccagggggccggctggagcctgcgggagacggcctgcctcgggaagtcctacgcccagatgtggcagctgatgtacttccaccgccgggacctgcgcctcgcggccaacgccatctgcagcgccgtgcccgtcgactggatccccacctcccgcaccacctggagcatccacgcccaccaccagtggatgacgaccgaggacatgctgtccgtgtggaaccgggtgtggatcgaggagaacccctggatggaggacaagacccacatcagctcctggggcgacgtcccgtacctggggaagcgcgaggaccagtggtgcggcagcctcatcggcctgaccgcgcgggccacgtgggccaccaacatccaggtggccatcaaccaggtgcgccggctgatcgggaacgagaactacctcgactacatgacctccatgaagcgcttcaagaacgagagcgaccccgagggcgccctgtggtga

SEQ ID NO: 8384 - RNA, 9879 nt, synthetic construct
  misc_feature 1..9879: note = derived and/or modified CDS sequence (opt1) from DENV-1__FJ906728__SS-prME
  source 1..9879: mol_type = other RNA
agcgtgaccatgctgctcatgctgatgcccaccgccctggccttccacctcacgacccgcggcggggagccgcacatgatcgtctccaagcaggagcggggcaagagcctgctgttcaagacctccgcgggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtcacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccacccggggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcaccccccaggcccccacgaccgagatccagctcaccgactacggggccctgatcctggactgcagcccccgcaccggcctcgacttcaacgagatggtcctgctgacgatgaaggagaagtcctggctcgtgcacaagcagtggttcctggacctgccgctcccctggaccagcggggccagcacctcccaggagacctggaaccggcaggacctgctggtgacgttcaagaccgcccacgcgaagaagcaggaggtcgtggtgctcggcagccaggagggcgccatgcacaccgccctgaccggggccacggagatccagacctccggcaccaccacgatcttcgccgggcacctgaagtgccgcctcaagatggacaagctgaccctgaagggcatgagctacgtcatgtgcaccgggcccttcaagctcgagaaggaggtggcggagacccagcacggcacggtgctggtccagatcaagtacgagggcaccgacgccccctgcaagatcccgttctccacccaggacgagaagggggtgacccagaacggccggctgatcacggccaaccccatcgtgaccgacaaggagaagcccgtcaacatcgaggccgagcccccgttcggggagagctacatcgtgatcggcgcgggcgagaaggccctgaagctctcctggttcaagaaggggagctccatcggcaagatgttcgaggccaccgcccgcggggcccggcgcatggcgatcctgggcgacaccgcctgggacttcgggagcatcggcggcgtgttcacgtccgtcgggaagctggtgcaccagatcttcggcaccgcctacggggtgctcttcagcggcgtctcctggaccatgaagatcgggatcggcgtgctgctgacctggctcggcctgaacagccgctccacgagcctgtccatgacctgcatcgccgtggggctcgtcaccctgtacctgggcgtgatggtgcaggccgacagcgggtgcgtcatcaactggaagggccgggagctcaagtgcgggtccggcatcttcgtgaccaacgaggtgcacacgtggaccgagcagtacaagttccaggcggacagccccaagcgcctgagcgccgccatcggcaaggcctgggaggagggggtctgcggcatccggtccgccacccgcctggagaacatcatgtggaagcagatcagcaacgagctcaaccacatcctgctggagaacgacatgaagctcaccgtggtggtcggggacgtggcgggcatcctggggcagggcaagaagatgatccggccccagcccatggagtacaagtactcctggaagagctggggcaaggccaagatcatcggggccgacgcccagaacaccacgttcatcatcgacggcccgaacacccccgagtgccccgacgaccagcgcgcgtggaacatctgggaggtggaggactacgggttcggcatcttcaccaccaacatctggctgaagctccgggactcctacacgcaggtctgcgaccaccgcctgatgagcgccgccatcaaggactccaaggccgtgcacgccgacatgggctactggatcgagagcgagaagaacgagacctggaagctggcgcgggcctccttcatcgaggtgaagacctgcatctggcccaagagccacaccctctggtccaacggggtcctggagagcgagatgatcatcccgaagatctacggcgggcccatctcccagcacaactaccgccccggctacttcacgcagaccgccgggccgtggcacctgggcaagctcgagctggacttcgacctgtgcgagggcaccaccgtggtggtcgacgagcactgcgggaaccggggccccagcctccgcacgaccaccgtgaccgggaagatcatccacgagtggtgctgccggtcctgcacgctgccccccctgcgcttccggggcgaggacgggtgctggtacggcatggagatccgcccggtgaaggagaaggaggagaacctcgtcaagagcatggtgtccgccggcagcggggaggtggacagcttctccctgggcctgctctgcatcagcatcatgatcgaggaggtcatgcggtcccgctggagccggaagatgctgatgaccgggaccctggccgtgttcttcctcctgatcatgggccagctgacctggaacgacctcatccgcctgtgcatcatggtgggggcgaacgcctccgaccgcatgggcatgggcacgacctacctggccctcatggccaccttcaagatgcggcccatgttcgccgtcgggctgctgctccgccggctgaccagccgcgaggtgctgctcctgacgatcggcctgtccctcgtggcgagcgtcgagctgcccaactccctggaggagctcggggacggcctggccatgggcatcatgatcctgaagctcctgaccgacttccagagccaccagctgtgggccaccctcctgtccctgaccttcatcaagacgaccttcagcctccactacgcctggaagaccatggcgatggtgctgtccatcgtcagcctgttccccctctgcctgtccaccacgagccagaagaccacctggctgccggtgctcctggggtccctgggctgcaagcccctcaccatgttcctgatcgccgagaacaagatctgggggcggaagagctggcccctgaacgagggcatcatggccgtggggatcgtctccatcctcctgagcagcctgctcaagaacgacgtgcccctggccggcccgctgatcgccggcgggatgctcatcgcgtgctacgtgatctccggcagctccgccgacctgagcctggagaaggccgccgaggtctcctgggaggaggaggccgagcacagcggggcgtcccacaacatcctcgtggaggtgcaggacgacggcacgatgaagatcaaggacgaggagcgcgacgacaccctgaccatcctgctcaaggccaccctgctggccgtcagcggggtgtaccccctctccatccccgccaccctgttcgtgtggtacttctggcagaagaagaagcagcggagcggcgtcctgtgggacacgccctccccgcccgaggtggagcgcgccgtgctggacgacggcatctaccggatcatgcagcgcgggctcctgggccggagccaggtcggggtgggcgtgttccaggagaacgtcttccacaccatgtggcacgtgacccgcggggcggtgctgatgtaccagggcaagcggctcgagccctcctgggccagcgtcaagaaggacctgatctcctacggcgggggctggcgcctgcgggggagctggaacaccggcgaggaggtgcaggtgatcgccgtcgagcccgggaagaacccgaagaacgtgcagacggcccccggcaccttcaagacccccgagggcgaggtgggggccatcgcgctcgacttcaagcccggcacctccgggagcccgatcgtcaaccgcgagggcaagatcgtgggcctgtacgggaacggcgtggtcacgacctccgggacctacgtgagcgccatcgcccaggccaaggcgagccaggagggccccctgcccgagatcgaggacgaggtgttccggaagcgcaacctcaccatcatggacctgcacccggggtccggcaagacgcggcgctacctgcccgccatcgtccgggaggccatcaagcgcaagctccgcaccctgatcctggcccccacccgggtggtggccagcgagatggcggaggccctcaagggcatgcccatccgctaccagaccacggccgtcaagtccgagcacaccgggaaggagatcgtggacctgatgtgccacgccaccttcaccatgcggctgctcagcccggtgcgcgtccccaactacaacatgatcatcatggacgaggcccacttcacggacccctccagcatcgcggcccggggctacatctccacccgcgtggggatgggcgaggccgccgccatcttcatgaccgcgacccccccggggagcgtggaggccttcccccagtccaacgccgtcatccaggacgaggagcgggacatccccgagcgcagctggaacacgggctacgagtggatcaccgacttccccggcaagaccgtgtggttcgtgccgtccatcaagagcgggaacgacatcgccaactgcctgcggaagaacggcaagcgcgtcatccagctgtcccggaagaccttcgacacggagtaccagaagaccaagaacaacgactgggactacgtggtgaccaccgacatcagcgagatgggggcgaacttccgcgccgaccgggtcatcgacccccgccggtgcctcaagcccgtgatcctgaaggacggccccgagcgcgtgatcctggccgggccgatgcccgtcacggtggcctccgccgcgcagcggcgcggccggatcggccgcaaccacaacaaggagggggaccagtacatctacatgggccagcccctcaacaacgacgaggaccacgcccactggaccgaggccaagatgctgctggacaacatcaacacccccgaggggatcatcccggccctcttcgagcccgagcgcgagaagagcgccgcggtcgacggcgagtaccggctgcgcggggaggcccggaagaccttcgtggagctgatgcgccggggcgacctccccgtgtggctgtcctacaaggtcgccagcgagggcttccagtactccgaccgccggtggtgcttcgacggggagcgcaacaaccaggtgctggaggagaacatggacgtggagatctggacgaaggagggcgagcggaagaagctccgcccccggtggctggacgcccgcacctacagcgacccgctggccctccgggagttcaaggagttcgcggccgggcgccggagcgtctccggcgacctgatcctggagatcggcaagctcccccagcacctgacccagcgcgcccagaacgccctggacaacctcgtgatgctgcacaacagcgagcaggggggccgggcgtaccgccacgccatggaggagctgcccgacaccatcgagacgctcatgctgctggccctcatcgccgtgctgaccgggggcgtcaccctgttcttcctctccgggcggggcctgggcaagaccagcatcgggctgctctgcgtgatggcctccagcgtgctgctgtggatggcgtccgtcgagccccactggatcgccgccagcatcatcctcgagttcttcctgatggtgctgctcatcccggagcccgaccgccagcggaccccccaggacaaccagctggcctacgtggtcatcggcctgctcttcatgatcctggccgtggcggccaacgagatggggctgctcgagacgaccaagaaggacctgggcatcgggcacgtggccgtcgagaaccaccaccacgccgccatgctggacgtggacctccacccggcgtccgcctggaccctgtacgccgtggccaccacgatcatcacccccatgatgcgccacaccatcgagaacaccacggccaacatcagcctgaccgcgatcgccaaccaggccgccatcctcatgggcctggacaagggctggcccatctccaagatggacatcggggtccccctgctcgcgctgggctgctacagccaggtgaacccgctgaccctcaccgccgccgtgctgatgctggtcgcccactacgccatcatcgggcccggcctccaggcgaaggccacgcgcgaggcccagaagcggaccgccgccgggatcatgaagaaccccaccgtggacggcatcgtggcgatcgacctggaccccgtcgtgtacgacgccaagttcgagaagcagctgggccagatcatgctcctgatcctgtgcacctcccagatcctcctgatgcgcacgacctgggccctgtgcgagagcatcaccctcgccaccgggccgctgacgaccctgtgggagggctcccccgggaagttctggaacaccaccatcgccgtgagcatggcgaacatcttccggggctcctacctcgccggcgccgggctggccttcagcctgatgaagtccctcggcgggggccgccgggggacgggcgcgcagggcgagaccctgggggagaagtggaagcgccagctgaaccagctcagcaagagcgagttcaacacctacaagcggtccggcatcatggaggtcgaccgcagcgaggccaaggaggggctgaagcggggcgagaccacgaagcacgccgtgtcccgcgggaccgccaagctgcggtggttcgtggagcgcaacctggtcaagcccgagggcaaggtgatcgacctcggctgcgggcggggcgggtggagctactactgcgccggcctgaagaaggtgaccgaggtcaaggggtacaccaagggcggccccgggcacgaggagccgatccccatggcgacgtacggctggaacctggtgaagctccactccgggaaggacgtgttcttcatcccccccgagaagtgcgacaccctgctgtgcgacatcggcgagagctccccgaaccccaccatcgaggaggggcgcaccctccgggtcctgaagatggtggagccctggctgcgcggcaaccagttctgcatcaagatcctcaacccctacatgccgagcgtggtcgagacgctggagcagatgcagcggaagcacggcgggatgctggtgcgcaaccccctctcccggaacagcacccacgagatgtactgggtgtcctgcggcaccgggaacatcgtcagcgccgtgaacatgacctcccgcatgctgctgaaccgcttcaccatggcccaccggaagcccacgtacgagcgcgacgtggacctcggcaccggcacccggcacgtcgccgtggagcccgaggtggccaacctggacatcatcgggcagcgcatcgagaacatcaagcacgagcacaagagcacctggcactacgacgaggacaacccgtacaagacgtgggcgtaccacggctcctacgaggtcaagcccagcgggtccgccagctccatggtgaacggcgtcgtgaagctgctcaccaagccctgggacgtgatccccatggtcacccagatcgccatgaccgacacgaccccgttcgggcagcagcgggtgttcaaggagaaggtggacacccgcacccccaaggccaagcggggcacggcccagatcatggaggtcaccgcgcgctggctgtggggcttcctgagccggaacaagaagccccgcatctgcacccgggaggagttcacccgcaaggtgcggagcaacgccgccatcggggccgtgttcgtcgacgagaaccagtggaactccgcgaaggaggccgtggaggacgagcgcttctgggacctcgtgcaccgggagcgcgagctgcacaagcagggcaagtgcgccacgtgcgtctacaacatgatggggaagcgggagaagaagctgggcgagttcgggaaggccaagggcagccgcgccatctggtacatgtggctcggcgcgcggttcctggagttcgaggccctggggttcatgaacgaggaccactggttctcccgcgagaacagcctctccggcgtggagggggagggcctgcacaagctggggtacatcctccgggacatcagcaagatcccgggcggcaacatgtacgccgacgacaccgccgggtgggacacccgcatcaccgaggacgacctgcagaacgaggccaagatcacggacatcatggagcccgagcacgcgctgctcgccaaggccatcttcaagctgacctaccagaacaaggtggtccgcgtgcagcggcccgccaagaacggcaccgtgatggacgtcatctcccgccgggaccagcgcgggagcggccaggtgggcacctacgggctgaacacgttcaccaacatggaggcccagctcatccggcagatggagtccgagggcatcttcagcccctccgagctggagaccccgaacctggcggagcgcgccctcgactggctggagaagtacggggtggagcggctgaagcgcatggccatcagcggcgacgactgcgtcgtgaagcccatcgacgaccggttcgccaccgccctcacggcgctgaacgacatggggaaggtgcgcaaggacatcccccagtgggagccctccaagggctggaacgactggcagcaggtcccgttctgcagccaccacttccaccagctgatcatgaaggacggccgggagatcgtggtgccctgccgcaaccaggacgagctcgtcgggcgggcccgcgtgtcccagggcgccgggtggagcctgcgggagaccgcctgcctgggcaagtcctacgcgcagatgtggcagctcatgtacttccaccgccgggacctgcgcctggccgccaacgccatctgcagcgccgtgcccgtcgactgggtgcccaccagccggaccacgtggtccatccacgcgcaccaccagtggatgaccaccgaggacatgctcagcgtgtggaaccgcgtctggatcgaggagaacccgtggatggaggacaagacccacatctccagctgggaggacgtgccctacctggggaagcgcgaggaccagtggtgcggctccctgatcggcctcacggcccgggccacctgggccaccaacatccaggtggccatcaaccaggtccgccggctgatcgggaacgagaactacctggactacatgaccagcatgaagcgcttcaagaacgagtccgaccccgagggcgcgctctggtga

SEQ ID NO: 8385 - RNA, 9879 nt, synthetic construct
  misc_feature 1..9879: note = derived and/or modified CDS sequence (opt1) from DENV-1__FJ461313__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctcgcgccccacgtgggcctggggctggagacgcgcaccgagacctggatgagctccgagggcgcctggaagcagatccagcgggtggagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtcctcttctccggcgtcagctggaccatgaagatcgggatcggcgtgctgctgacgtggctcggcctgaactcccgcagcacctccctgagcatgacctgcatcgccgtggggctcgtcaccctgtacctgggcgccatggtgcaggcggactccgggtgcgtgatcaactggaagggccgggagctcaagtgcgggagcggcatcttcgtcacgaacgaggtgcacacctggaccgagcagtacaagttccaggccgacagcccgaagcgcctgtccgccgccatcggcaaggcctgggaggagggggtgtgcggcatccggagcgcgacccgcctggagaacatcatgtggaagcagatctccaacgagctcaaccacatcctgctggagaacgacatgaagctcaccgtcgtggtgggggacgtcgccggcatcctggggcagggcaagaagatgatccggccccagcccatggagtacaagtacagctggaagtcctggggcaaggccaagatcatcggggccgacgcgcagaacacgaccttcatcatcgacggccccaacaccccggagtgccccgacgaccagcgcgcctggaacatctgggaggtggaggactacgggttcggcatcttcaccacgaacatctggctgaagctccgggacagctacacccaggtgtgcgaccaccgcctgatgtccgccgccatcaaggacagcaaggccgtccacgcggacatgggctactggatcgagtccgagaagaacgagacctggaagctggcccgggccagcttcatcgaggtgaagacctgcatctggcccaagtcccacacgctctggagcaacggggtgctggagtccgagatgatcatccccaagatctacggcgggccgatcagccagcacaactaccgccccggctacttcacccagaccgccgggccctggcacctgggcaagctcgagctggacttcgacctgtgcgagggcaccacggtcgtggtggacgagcactgcgggaaccggggcccgtccctccgcaccaccaccgtcacggggaagatcatccacgagtggtgctgccggagctgcaccctgccgcccctgcgcttccggggcgaggacgggtgctggtacggcatggagatccgccccgtgaaggagaaggaggagaacctcgtgaagtccatggtcagcgccggcagcggggaggtggactccttcagcctgggcctgctctgcatctccatcatgatcgaggaggtgatgcggagccgctggtcccggaagatgctgatgaccgggaccctggcggtcttcttcctcctgatcatgggccagctgacgtggaacgacctcatccgcctgtgcatcatggtgggggccaacgccagcgaccgcatgggcatgggcaccacctacctggccctcatggccaccttcaagatgcggccgatgttcgcggtggggctgctgttccgccggctcacgtcccgcgaggtcctgctgctcaccatcggcctgagcctggtggcctccgtggagctccccaacagcctggaggagctgggggacggcctcgccatgggcatcatgatcctgaagctgctcaccgacttccagtcccaccagctgtgggccaccctgctcagcctgacgttcatcaagaccaccttctccctgcactacgcgtggaagaccatggccatggtcctcagcatcgtgtccctgttccccctgtgcctcagcacgacctcccagaagaccacctggctgcccgtcctgctcgggagcctgggctgcaagccgctgacgatgttcctcatcgccgagaacaagatctgggggcggaagtcctggcccctgaacgagggcatcatggccgtggggatcgtgagcatcctgctcagctccctgctgaagaacgacgtccccctcgccggccccctgatcgcgggcgggatgctgatcgcctgctacgtgatcagcggctccagcgccgacctctccctggagaaggccgccgaggtgagctgggaggaggaggcggagcactccggggccagccacaacatcctggtcgaggtgcaggacgacggcaccatgaagatcaaggacgaggagcgcgacgacaccctcaccatcctgctgaaggccaccctcctggccgtgtccggggtctacccgctgagcatccccgccaccctcttcgtgtggtacttctggcagaagaagaagcagcggtccggcgtgctgtgggacacccccagcccgcccgaggtcgagcgcgcggtgctggacgacggcatctaccggatcatgcagcgcgggctgctcggccggtcccaggtgggggtcggcgtgttccaggagaacgtgttccacaccatgtggcacgtcacccgcggggccgtgctgatgtaccagggcaagcggctggagcccagctgggcctccgtgaagaaggacctcatcagctacggcgggggctggcgcctgcgggggtcctggaacacgggcgaggaggtccaggtgatcgccgtggagcccgggaagaaccccaagaacgtccagaccgcccccggcaccttcaagacccccgagggcgaggtgggggcgatcgccctggacttcaagcccggcacgagcgggtcccccatcgtgaaccgcgagggcaagatcgtcggcctctacgggaacggcgtggtgaccaccagcgggacctacgtcagcgccatcgcccaggcgaaggcctcccaggagggcccgctgcccgagatcgaggacgaggtgttccggaagcgcaacctgacgatcatggacctccaccccgggagcggcaagacccggcgctacctgccggccatcgtgcgggaggccatcaagcgcaagctgcgcaccctcatcctggcccccacccgggtcgtggcgtccgagatggccgaggccctgaagggcatgcccatccgctaccagacgaccgccgtcaagagcgagcacaccgggaaggagatcgtcgacctcatgtgccacgccaccttcacgatgcggctgctgtcccccgtgcgcgtgccgaactacaacatgatcatcatggacgaggcgcacttcaccgaccccagctccatcgccgcccggggctacatcagcacccgcgtcgggatgggcgaggccgccgcgatcttcatgaccgccacgccgcccgggtccgtggaggccttcccgcagagcaacgccgtgatccaggacgaggagcgggacatccccgagcgctcctggaacagcggctacgagtggatcaccgacttccccggcaagaccgtctggttcgtgccctccatcaagagcgggaacgacatcgcgaactgcctccggaagaacggcaagcgcgtgatccagctgtcccggaagaccttcgacacggagtaccagaagaccaagaacaacgactgggactacgtcgtgaccaccgacatcagcgagatgggggccaacttccgcgccgaccgggtgatcgacccgcgccggtgcctgaagcccgtcatcctcaaggacggccccgagcgcgtgatcctggccgggcccatgccggtgacggtcgcctccgcggcccagcggcgcggccggatcggccgcaaccacaacaaggagggggaccagtacatctacatgggccagcccctgaacaacgacgaggaccacgcccactggaccgaggccaagatgctcctggacaacatcaacacccccgaggggatcatccccgccctgttcgagccggagcgcgagaagtccgcggccgtggacggcgagtaccggctccgcggggaggcccggaagaccttcgtcgagctgatgcgccggggcgacctgcccgtgtggctctcctacaaggtggccagcgagggcttccagtacagcgaccgccggtggtgcttcgacggggagcgcaacaaccaggtcctggaggagaacatggacgtggagatctggacgaaggagggcgagcggaagaagctgcgcccccggtggctcgacgcccgcacctactccgaccccctggcgctgcgggagttcaaggagttcgccgccgggcgccggagcgtgtccggcgacctcatcctggagatcggcaagctgccgcagcacctcacccagcgcgcccagaacgcgctggacaacctggtcatgctccacaacagcgagcagggcgggcgggcctaccgccacgccatggaggagctgcccgacaccatcgagacgctgatgctcctggccctgatcgccgtgctcaccgggggcgtgaccctgttcttcctgtccgggcggggcctcggcaagaccagcatcgggctgctgtgcgtcatggcgtccagcgtgctcctgtggatggcctccgtggagccccactggatcgccgccagcatcatcctggagttcttcctcatggtcctgctgatccccgagccggaccgccagcggacgccccaggacaaccagctcgcctacgtggtgatcggcctgctgttcatgatcctcacggtcgcggccaacgagatggggctgctggagaccaccaagaaggacctcggcatcgggcacgtggccgtggagaaccaccaccacgccgccatgctggacgtcgacctgcaccccgcgtccgcctggaccctctacgccgtggccacgaccatcatcaccccgatgatgcgccacaccatcgagaacacgaccgccaacatcagcctgaccgcgatcgccaaccaggccgccatcctgatgggcctcgacaagggctggcccatctccaagatggacatcggggtgcccctgctggcgctcggctgctacagccaggtcaaccccctgaccctgacggccgccgtgctcatgctggtggcccactacgccatcatcgggccgggcctgcaggcgaaggccacccgcgaggcccagaagcggaccgccgccgggatcatgaagaaccccaccgtcgacggcatcgtggcgatcgacctcgaccccgtggtctacgacgccaagttcgagaagcagctgggccagatcatgctgctcatcctgtgcacgtcccagatcctgctcatgcgcaccacctgggccctgtgcgagagcatcaccctggccacggggcccctcaccaccctgtgggagggctccccggggaagttctggaacaccacgatcgccgtgagcatggcgaacatcttccggggctcctacctggccggcgccgggctcgccttcagcctgatgaagtccctgggcgggggccgccggtccaccggggcgcagggcgagaccctcggcgagaagtggaagcgccagctgaaccagctgagcaagtccgagttcaacacctacaagcggagcgggatcatggaggtggaccgctccgaggccaaggagggcctcaagcgcggggagacgaccaagcacgccgtcagccgcggcaccgccaagctgcggtggttcgtggagcgcaacctggtgaagcccgaggggaaggtcatcgacctgggctgcggccgcggcgggtggtcctactactgcgccgggctcaagaaggtgaccgaggtgaaggggtacacgaagggcggccccggccacgaggagcccatcccgatggcgacctacgggtggaacctggtcaagctgcacagcggcaaggacgtgttcttcatcccgcccgagaagtgcgacaccctcctgtgcgacatcggggagtccagccccaacccgaccatcgaggagggccgcacgctgcgggtgctcaagatggtcgagccctggctgcgcgggaaccagttctgcatcaagatcctgaacccctacatgccctccgtggtggagaccctcgagcagatgcagcggaagcacggcggcatgctggtccgcaacccgctgagccggaactccacccacgagatgtactgggtgagctgcgggaccggcaacatcgtgtccgccgtcaacatgaccagccgcatgctcctgaaccgcttcacgatggcccaccggaagcccacctacgagcgcgacgtggacctggggaccggcacccggcacgtggccgtcgagcccgaggtggccaacctcgacatcatcggccagcgcatcgagaacatcaagcacgagcacaagtccacgtggcactacgacgaggacaacccctacaagacctgggcgtaccacgggagctacgaggtgaagccgtccggcagcgccagctccatggtcaacggggtggtcaagctgctgaccaagccctgggacgtgatccccatggtgacccagatcgccatgacggacaccacccccttcggccagcagcgggtcttcaaggagaaggtggacacccgcacgccgaaggccaagcgggggaccgcccagatcatggaggtgaccgcgcgctggctctggggcttcctgagccggaacaagaagccccgcatctgcacccgggaggagttcacgcgcaaggtccggtccaacgccgccatcggcgccgtgttcgtggacgagaaccagtggaacagcgcgaaggaggccgtcgaggacgagcgcttctgggacctggtgcaccgggagcgcgagctccacaagcaggggaagtgcgcgacctgcgtgtacaacatgatgggcaagcgggagaagaagctgggggagttcggcaaggccaaggggtcccgcgccatctggtacatgtggctgggcgcgcggttcctcgagttcgaggccctgggcttcatgaacgaggaccactggttcagccgcgagaactccctgagcggggtcgagggcgaggggctccacaagctgggctacatcctgcgggacatctccaagatccccgggggcaacatgtacgccgacgacaccgccggctgggacacccgcatcacggaggacgacctccagaacgaggccaagatcaccgacatcatggagccggagcacgcgctgctggccaaggccatcttcaagctcacctaccagaacaaggtggtgcgcgtccagcggcccgccaagaacgggaccgtgatggacgtgatcagccgccgggaccagcgcggctccgggcaggtcggcacgtacggcctgaacaccttcaccaacatggaggcccagctgatccggcagatggagagcgaggggatcttctcccccagcgagctcgagacccccaacctggcggagcgcgccctgaactggctcgagaagtacggcgtggagcggctgaagcgcatggccatctccggggacgactgcgtggtcaagccgatcgacgaccggttcgccacggccctgaccgcgctcaacgacatgggcaaggtgcgcaaggacatcccccagtgggagcccagcaaggggtggaacgactggcagcaggtccccttctgctcccaccacttccaccagctgatcatgaaggacggccgggagatcgtcgtgccgtgccgcaaccaggacgagctggtgggccgggcccgcgtcagccagggggccggctggagcctccgggagaccgcctgcctggggaagtcctacgcgcagatgtggcagctgatgtacttccaccgccgggacctccgcctggccgccaacgccatctgcagcgccgtgcccgtggactgggtccccacctcccggacgacctggagcatccacgcgcaccaccagtggatgaccaccgaggacatgctgtccgtgtggaaccgcgtgtggatcgaggagaacccctggatggaggacaagacgcacatcagctcctgggaggacgtcccgtacctcggcaagcgcgaggaccagtggtgcgggagcctgatcggcctgaccgcccgggccacctgggccaccaacatccaggtggccatcaaccaggtgcgccggctcatcggcaacgagaactacctggactacatgacctccatgaagcgcttcaagaacgagagcgaccccgagggggcgctgtggtga

SEQ ID NO: 8386 - RNA, 9879 nt, synthetic construct
  misc_feature 1..9879: note = derived and/or modified CDS sequence (opt1) from DENV-1__FJ547063__SS-prME
  source 1..9879: mol_type = other RNA
agcgtgaccatgctgctgatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgggacaagcggtccgtggccctcgcgccccacgtgggcctggggctggagacccgcaccgagacctggatgagctccgagggcgcgtggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggagctggccgagacccagcacggcaccgtgctggtgcagatcaagtacgagggcaccgacgcgccctgcaagatccccttcagcacgcaggacgagaagggggtcacccagaacggccggctgatcaccgccaacccgatcgtgaccgacaaggagaagcccgtgaacatcgaggccgagccgcccttcggggagtcctacatcgtcatcggcgccggcgagaaggcgctcaagctgagctggttcaagaaggggtccagcatcggcaagatgttcgaggccacggcccgcggggcccggcgcatggccatcctgggcgacaccgcgtgggacttcgggtccatcggcggcgtgttcaccagcgtggggaagctcgtccaccagatcttcggcaccgcctacggggtgctgttctccggcgtgagctggacgatgaagatcgggatcggcgtcctgctcacctggctgggcctgaactcccgcagcacctccctcagcatgacctgcatcgccgtggggctggtgacgctgtacctcggcgtcatggtgcaggccgactccgggtgcgtgatcaactggaagggccgggagctgaagtgcgggagcggcatcttcgtcaccaacgaggtgcacacctggaccgagcagtacaagttccaggccgacagcccgaagcgcctgtccgcggccatcggcaaggcctgggaggagggggtgtgcggcatccggagcgccacccgcctcgagaacatcatgtggaagcagatctccaacgagctgaaccacatcctgctcgagaacgacatgaagttcacggtcgtggtgggggacgtcgccggcatcctggcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctgaagctccgggacagctacacccaggtctgcgaccaccgcctgatgtccgcggccatcaaggacagcaaggccgtgcacgccgacatgggctactggatcgagtccgagaagaacgagacctggaagctggcccgggcgagcttcatcgaggtgaagacgtgcatctggcccaagtcccacaccctctggagcaacggcgtcctggagtccgagatgatcatccccaagatctacgggggcccgatcagccagcacaactaccgccccgggtacttcacccagaccgccggcccctggcacctggggaagctcgagctggacttcgacctgtgcgagggcacgaccgtggtggtcgacgagcactgcggcaaccgggggccgtccctccgcaccaccacggtgaccggcaagatcatccacgagtggtgctgccggagctgcaccctgccgcccctgcgcttccgcggggaggacggctgctggtacgggatggagatccgccccgtgaaggagaaggaggagaacctcgtcaagtccatggtgagcgccggcagcggcgaggtggactccttcagcctggggctgctctgcatctccatcatgatcgaggaggtcatgcggagccgctggtcccggaagatgctgatgaccggcacgctggccgtgttcttcctcctgatcatggggcagctgacctggaacgacctcatccgcctgtgcatcatggtgggcgccaacgcgagcgaccgcatggggatgggcaccacctacctggccctcatggccacgttcaagatgcggccgatgttcgccgtcggcctgctgttccgccggctcacctcccgcgaggtgctgctgctcaccatcgggctgagcctggtggcctccgtcgagctccccaacagcctggaggagctgggcgacgggctcgcgatgggcatcatgatcctgaagctgctcaccgacttccagtcccaccagctgtgggccacgctgctcagcctgaccttcatcaagaccaccttctccctgcactacgcctggaagacgatggccatgatcctcagcatcgtgtccctgttccccctgtgcctcagcaccacctcccagaagaccacgtggctgcccgtcctgctcggcagcctggggtgcaagccgctgaccatgttcctcatcgcggagaacaagatctggggccggcgctcctggcccctgaacgaggggatcatggccgtgggcatcgtgagcatcctgctcagctccctgctgaagaacgacgtccccctcgccgggcccctgatcgccggcggcatgctgatcgcctgctacgtgatcagcgggtccagcgcggacctctccctggagaaggccgccgaggtgagctgggaggaggaggccgagcactccggcgccagccacaacatcctggtcgaggtgcaggacgacgggaccatgaagatcaaggacgaggagcgggacgacaccctcaccatcctgctgaaggcgacgctcctggccgtgtccggcgtctacccgctgagcatccccgccaccctcttcgtgtggtacttctggcagaagaagaagcagcgctccggggtgctgtgggacacccccagcccgcccgaggtcgagcgggccgtgctggacgacggcatctaccgcatcatgcagcggggcctgctcgggcgctcccaggtgggcgtcggggtgttccaggagaacgtgttccacaccatgtggcacgtcacgcggggcgccgtgctgatgtaccaggggaagcgcctggagcccagctgggcgtccgtgaagaaggacctcatcagctacggcggcgggtggcggctgcagggctcctggaacaccggggaggaggtccaggtgatcgccgtggagcccggcaagaaccccaagaacgtccagaccgcccccgggaccttcaagacgcccgagggcgaggtgggcgccatcgccctggacttcaagcccgggaccagcggctcccccatcgtgaaccgcgaggggaagatcgtcggcctctacggcaacggggtggtgaccaccagcggcacgtacgtcagcgcgatcgcccaggccaaggcctcccaggaggggccgctgcccgagatcgaggacgaggtgttccggaagcgcaacctgaccatcatggacctccaccccggcagcgggaagacccggcgctacctgccggcgatcgtgcgggaggccatcaagcgcaagctgcgcaccctcatcctggcccccacgcgggtcgtggcctccgagatggccgaggcgctgaagggcatgcccatccgctaccagaccaccgccgtcaagagcgagcacaccggcaaggagatcgtcgacctcatgtgccacgccacgttcaccatgcggctgctgtcccccgtgcgcgtgccgaactacaacatgatcatcatggacgaggcccacttcaccgaccccagctccatcgccgcgcgggggtacatcagcacccgcgtcggcatgggggaggccgccgccatcttcatgacggccacgccgcccggctccgtggaggcgttcccgcagagcaacgccgtgatccaggacgaggagcgggacatccccgagcgctcctggaacagcgggtacgagtggatcaccgacttccccggcaagaccgtctggttcgtgccctccatcaagagcggcaacgacatcgccaactgcctccggaagaacgggaagcgcgtgatccagctgtcccggaagacgttcgacaccgagtaccagaagaccaagaacaacgactgggactacgtcgtgaccacggacatcagcgagatgggcgccaacttccgcgcggaccgggtgatcgacccgcgccggtgcctgaagcccgtcatcctcaaggacgggcccgagcgcgtgatcctggccggccccatgccggtgaccgtcgcctccgccgcccagcggcgcgggcggatcggccgcaaccacaacaaggagggcgaccagtacatctacatggggcagcccctgaacaacgacgaggaccacgcgcactggaccgaggccaagatgctcctggacaacatcaacacccccgagggcatcatccccgccctgttcgagccggagcgcgagaagtccgccgccatcgacggggagtaccggctccgcggcgaggcgcggaagacgttcgtggagctgatgcgccgcggggacctgcccgtctggctctcctacaaggtggccagcgagggcttccagtacagcgaccgccggtggtgcttcgacggcgagcgcaacaaccaggtgctggaggagaacatggacgtcgagatctggaccaaggagggggagcggaagaagctgcgcccccggtggctcgacgcccgcacctactccgaccccctggccctgcgggagttcaaggagttcgccgcgggccgccggagcgtgtccggggacctcatcctggagatcggcaagctgccgcagcacctcacccagcgcgcccagaacgccctggacaacctggtgatgctccacaacagcgagcagggcgggcgggcctaccgccacgcgatggaggagctgcccgacacgatcgagaccctgatgctcctggccctgatcgccgtcctcaccggcggggtgaccctgttcttcctgtccggccgggggctcggcaagaccagcatcggcctgctgtgcgtgatggcctccagcgtcctcctgtggatggcctccgtggagccccactggatcgcggccagcatcatcctggagttcttcctcatggtgctgctgatccccgagccggaccgccagcggacgccccaggacaaccagctcgcctacgtcgtgatcgggctgctgttcatgatcctcaccgtggccgccaacgagatgggcctgctggagaccaccaagaaggacctcgggatcggccacgtcgcggtggagaaccaccaccacgccgccatgctggacgtggacctgcaccccgcctccgcctggacgctctacgcggtcgccaccaccatcatcaccccgatgatgcgccacacgatcgagaacaccaccgccaacatcagcctgaccgccatcgccaaccaggcggccatcctgatggggctcgacaagggctggcccatctccaagatggacatcggcgtgcccctgctggccctcgggtgctacagccaggtgaaccccctgacgctgaccgccgcggtcctcatgctggtggcccactacgccatcatcggcccggggctgcaggccaaggccacccgcgaggcgcagaagcggaccgccgccggcatcatgaagaaccccacggtggacgggatcgtcgccatcgacctcgaccccgtggtgtacgacgccaagttcgagaagcagctgggccagatcatgctgctcatcctgtgcacctcccagatcctgctcatgcgcaccacctgggcgctgtgcgagagcatcacgctggccaccggccccctcaccaccctgtgggaggggtccccgggcaagttctggaacacgaccatcgccgtcagcatggccaacatcttccgggggtcctacctggccggcgcgggcctcgccttcagcctgatgaagtccctcgggggcgggcgccgggggaccggggcccagggcgagaccctcggcgagaagtggaagcgccagctgaaccagctgtccaagagcgagttcaacacgtacaagcggtccgggatcatggaggtggaccgcagcgaggccaaggagggcctcaagcgcggggagaccaccaagcacgcggtgtcccgcggcaccgccaagctgcggtggttcgtcgagcgcaacctggtgaagcccgaggggaaggtgatcgacctgggctgcggccgcggcgggtggagctactactgcgccgggctcaagaaggtcacggaggtgaaggggtacaccaagggcggccccggccacgaggagcccatcccgatggccacctacgggtggaacctggtgaagctgcactccggcaaggacgtcttcttcatcccgcccgagaagtgcgacaccctcctgtgcgacatcggggagagctcccccaacccgacgatcgaggagggccgcaccctgcgggtgctcaagatggtggagccctggctgcgcgggaaccagttctgcatcaagatcctgaacccctacatgcccagcgtcgtggagaccctcgagcagatgcagcggaagcacggcggcatgctggtgcgcaacccgctgcagcggaactccacccacgagatgtactgggtcagctgcgggaccggcaacatcgtgtccgccgtgaacatgacgagccgcatgctcctgaaccgcttcaccatggcgcaccggaagcccacctacgagcgcgacgtcgacctgggggccggcacccggcacgtggccgtggagcccgaggtcgccaacctcgacatcatcggccagcgcatcgagaacatcaagcacgagcacaagtccacgtggcactacgacgaggacaacccctacaagacctgggcctaccacgggagctacgaggtgaagccgtccggcagcgcgtccagcatggtgaacggggtcgtgaagctgctgaccaagccctgggacgtcatccccatggtgacccagatcgccatgacggacaccacccccttcggccagcagcgggtgttcaaggagaaggtcgacacccgcacgccgaaggccaagcgggggaccgcccagatcatggaggtgaccgccaagtggctctggggcttcctgagccgcaacaagaagccccggatctgcacccgcgaggagttcacgcggaaggtgcgctccaacgcggccatcggcgccgtcttcgtggacgagaaccagtggaacagcgccaaggaggcggtggaggacgagcggttctgggacctggtccaccgcgagcgggagctccacaagcaggggaagtgcgcgacctgcgtgtacaacatgatgggcaagcgcgagaagaagctgggggagttcggcaaggccaaggggtcccgggccatctggtacatgtggctgggcgcccgcttcctcgagttcgaggcgctgggcttcatgaacgaggaccactggttcagccgggagaactccctgagcggggtggagggcgaggggctccacaagctgggctacatcctgcgcgacatctccaagatccccgggggcaacatgtacgccgacgacaccgccggctgggacacccggatcacggaggacgacctccagaacgaggcccgcatcaccgacatcatggagccggagcacgccctgctggccaagagcatcttcaagctcacctaccagaacaaggtcgtgcgcgtgcagcggcccgccaagaacgggaccgtcatggacgtgatctcccgccgggaccagcgcggcagcggccaggtggggacgtacggcctgaacaccttcaccaacatggaggcccagctgatccggcagatggagtccgaggggatcttcagcccctccgagctcgagacccccaacctggccgagcgcgtcctggactggctcgagaagtacggcgtggagcggctgaagcgcatggccatcagcggggacgactgcgtggtcaagccgatcgacgaccggttcgcgacggccctgaccgccctcaacgacatgggcaaggtgcgcaaggacatcccccagtgggagccctccaaggggtggaacgactggcagcaggtccccttctgcagccaccacttccaccagctgatcatgaaggacggccgggagatcgtcgtgccgtgccgcaaccaggacgagctggtgggccgggcccgcgtctcccagggggccggctggagcctccgggagaccgcgtgcctgggcaagagctacgcccagatgtggcagctgatgtacttccaccgccgggacctccgcctggccgccaacgcgatctgctccgccgtgcccgtggactggatccccaccagccggacgacctggtccatccacgcccaccaccagtggatgaccaccgaggacatgctgagcgtctggaaccgcgtgtggatcgaggagaacccctggatggaggacaagacgcacatctccagctggggcgacgtgccgtacctcgggaagcgcgaggaccagtggtgcggctccctgatcggcctgaccgcccgggccacctgggcgaccaacatccaggtcgccatcaaccaggtgcgccggctcatcgggaacgagaactacctggactacatgaccagcatgaagcgcttcaagaacgagtccgaccccgagggcgccctgtggtga

SEQ ID NO: 8387 - RNA, 9879 nt, synthetic construct
  misc_feature 1..9879: note = derived and/or modified CDS sequence (opt1) from DENV-1__FJ410218__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgccggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtgacctacgggacctgcagccagacgggcgagcaccggcgcgacaagcggagcgtggccctcgcgccccacgtgggcctggggctggagacccgcaccgagacctggatgtccagcgagggcgcctggaagcagatccagcgggtggagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtggggaagctggtccaccagatcttcggcaccgcctacggggtcctgttctccggcgtgagctggaccatgaagatcgggatcggcgtcctgctgacgtggctcggcctgaactcccgcagcacctccctgagcatgacctgcatcgccgtggggctcgtgaccctgtacctgggcgtcatggtgcaggccgactccgggtgcgtgatcaactggaagggccgggagctcaagtgcgggagcggcatcttcgtcacgaacgaggtgcacacctggaccgagcagtacaagttccaggcggacagcccgaagcgcctgtccgccgccatcggcaaggcctgggaggagggggtgtgcggcatccggagcgccacccgcctggagaacatcatgtggaagcagatctccaacgagctcaaccacatcctgctggagaacgacatgaagttcaccgtcgtggtgggggacgtcgtgggcatcctcgcgcaggggaagaagatgatccggccccagcccatggagcacaagtacagctggaagtcctggggcaaggccaagatcatcggcgccgacgtgcagaacacgaccttcatcatcgacgggcccaacaccccggagtgccccgacgaccagcgcgcctggaacatctgggaggtcgaggactacggcttcgggatcttcaccacgaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacctgcatctggcccaagtcccacacgctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcaccacggtggtcgtggacgagcactgcggcaaccgggggccgtccctgcgcaccaccaccgtgacgggcaagatcatccacgagtggtgctgccggagctgcaccctgccgcccctccgcttcaagggggaggacggctgctggtacgggatggagatccggcccgtcaaggagaaggaggagaacctggtgaagtccatggtgagcgccggcagcggcgaggtcgactccttcagcctcgggctgctgtgcatctccatcatgatcgaggaggtgatgcgcagccggtggtcccgcaagatgctcatgaccggcaccctggccgtgttcctgctcctgatcatggggcagctgacgtggaacgacctcatccggctgtgcatcatggtcggcgccaacgcgagcgaccgcatggggatgggcaccacctacctggccctcatggccaccttcaagatgcgcccgatgttcgccgtgggcctgctgttccggcgcctcacgtcccgggaggtgctgctgctcaccatcgggctgagcctggtcgcctccgtggagctccccaacagcctggaggagctgggcgacgggctcgcgatgggcatcatgatcctgaagctgctcaccgacttccagtcccaccagctgtgggccaccctgctcagcctgacgttcatcaagaccaccctgtccctccactacgcctggaagaccatggccatggtcctgagcatcgtgtccctgttccccctctgcctgagcacgacctcccagaagaccacctggctgcccgtgctcctgggcagcctggggtgcaagccgctcacgatgttcctgatcgtcgagaacaagatctggggccgcaagtcctggcccctgaacgaggggatcatggcggtgggcgtggtcagcatcctcctgagctccctgctcaagaacgacgtgcccctggccgggcccctgatcgccggcggcatgctcatcgcctgctacgtgatcagcgggtccagcgccgacctgtccctggagaaggcggccgaggtcagctgggaggaggaggccgagcactccggcgccagccacaacatcctcgtggaggtgcaggacgacgggaccatgaagatcaaggacgaggagcgggacgacaccctgaccatcctgctcaaggccaccctgctggcggtctccggcgtgtacccgctcagcatccccgccacgctgttcgtgtggtacttctggcagaagaagaagcagcgctccggggtcctgtgggacacccccagcccgcccgaggtggagcgggccgtgctggacgacggcatctaccgcatcatgcagcggggcctcctggggcgctcccaggtcggcgtgggggtgttccaggagaacgtcttccacaccatgtggcacgtgacccggggcgccgtgctgatgtaccaggggaagcgcctcgagcccagctgggcctccgtcaagaaggacctgatcagctacggcggcgggtggcggctgcagggctcctggaacacgggggaggaggtccaggtgatcgcggtcgagcccggcaagaaccccaagaacgtgcagaccgcccccgggaccttcaagacccccgagggcgaggtgggcgccatcgccctcgacttcaagcccgggacgagcggctcccccatcgtcaaccgcgaggggaagatcgtgggcctgtacggcaacggggtggtcaccaccagcggcacctacgtgagcgccatcgcgcaggccaaggcctcccaggaggggccgctgcccgagatcgaggacgaggtgttccggaagcgcaacctcacgatcatggacctgcaccccggcagcgggaagacccggcgctacctgccggccatcgtccgggaggcgatcaagcgcaagctccggaccctgatcctggcccccacccgcgtggtggcctccgagatggccgaggccctcaagggcatgcccatccgctaccagacgaccgcggtcaagagcgagcacaccggcaaggagatcgtggacctgatgtgccacgccaccttcacgatgcggctgctctcccccgtgcgcgtcccgaactacaacatgatcatcatggacgaggcccacttcaccgaccccagctccatcgccgcccgggggtacatcagcacccgcgtgggcatgggggaggcggccgccatcttcatgaccgccacgccgcccggctccgtggaggccttcccgcagagcaacgcggtcatccaggacgaggagcgggacatccccgagcgctcctggaacagcgggtacgagtggatcaccgacttccccggcaagaccgtgtggttcgtgccctccatcaagagcggcaacgacatcgccaactgcctgcggaagaacgggaagcgcgtcatccagctgtcccggaagaccttcgacacggagtaccagaagaccaagaacaacgactgggactacgtggtgaccaccgacatcagcgagatgggcgccaacttccgcgccgaccgggtcatcgacccgcgccggtgcctcaagcccgtgatcctgaaggacgggcccgagcgcgtcatcctggcgggccccatgccggtgacggtggcctccgccgcccagcggcgcgggcggatcggccgcaaccacaacaaggagggcgaccagtacatctacatggggcagcccctcaacaacgacgaggaccacgcccactggaccgaggcgaagatgctgctggacaacatcaacacccccgagggcatcatccccgccctcttcgagccggagcgggagaagtccgccgccatcgacggggagtaccgcctgcgcggcgaggcccggaagaccttcgtcgagctgatgcgccgcggggacctccccgtgtggctgtcctacaaggtggcgagcgagggcttccagtacagcgaccgccggtggtgcttcgacggcgagcgcaacaaccaggtcctggaggagaacatggacgtggagatctggacgaaggagggggagcggaagaagctccgcccccggtggctggacgcccgcacctactccgaccccctggccctccgggagttcaaggagttcgccgccggccgccggagcgtgtccggggacctgatcctggagatcggcaagctcccgcagcacctgacccagcgcgcgcagaacgccctggacaacctcgtcatgctgcacaacagcgagcagggcgggcgggcctaccgccacgccatggaggagctgcccgacaccatcgagacgctcatgctgctggcgctcatcgccgtgctgaccggcggggtgaccctgttcttcctctccggccgggggctgggcaagaccagcatcggcctgctctgcgtcatggcctccagcgtgctgctgtggatggcctccgtggagccccactggatcgccgcgagcatcatcctcgagttcttcctgatggtcctgctcatccccgagccggaccgccagcggacgccccaggacaaccagctggcctacgtggtgatcgggctcctcttcatgatcctgacggtcgccgccaacgagatgggcctgctcgagaccaccaagaaggacctggggatcggccacgtggccgtggagaaccaccaccacgcgaccatgctggacgtcgacctccaccccgcctccgcctggacgctgtacgccgtggccaccaccatcatcaccccgatgatgcgccacacgatcgagaacaccaccgcgaacatcagcctgaccgccatcgccaaccaggccgccatcctcatggggctggacaagggctggcccatctccaagatggacatcggcgtgcccctgctcgcgctggggtgctacagccaggtcaaccccctgacgctcaccgccgccgtgctgatgctggtggcccactacgcgatcatcggcccggggctccaggccaaggccacccgggaggcccagaagcgcaccgccgcgggcatcatgaagaaccccacggtcgacgggatcgtggccatcgacctggaccccgtggtctacgacgccaagttcgagaagcagctgggccagatcatgctcctgatcctgtgcacctcccagatcctcctgatgcgcaccacctgggccctgtgcgagagcatcacgctcgccaccggccccctgaccaccctgtgggaggggtccccgggcaagttctggaacacgaccatcgcggtgagcatggccaacatcttccgggggtcctacctcgccggcgccggcctggccttcagcctgatgaagtccctcgggggcgggcgccggggcaccggggcgcagggcgagaccctgggcgagaagtggaagcgccagctgaaccagctctccaagagcgagttcaacatctacaagcggtccgggatcatggaggtggaccgcagcgaggccaaggagggcctgaagcgcggggagacgacccgccacgccgtctcccggggcaccgccaagctgcgctggttcgtggagcggaacctggtgaagcccgaggggaaggtcatcgacctcggctgcggccgcgggggctggagctactactgcgcggggctgaagaaggtgaccgaggtgaagggctacacgaagggcgggcccggccacgaggagcccatcccgatggccacctacgggtggaacctggtcaagctccactccggcaaggacgtgttcttcacgccgcccgagaagtgcgacaccctgctgtgcgacatcggggagagctcccccaacccgacgatcgaggagggccggaccctccgcgtgctgaagatggtcgagccctggctgcgggggaaccagttctgcatcaagatcctcaacccctacatgcccagcgtggtggagaccctggagcagatgcagcgcaagcacggcggcatgctggtccggaacccgctctcccgcaacagcacccacgagatgtactgggtgtcctgcgggaccggcaacatcgtgagcgccgtcaacatgacgtcccggatgctgctgaaccgcttcaccatggcccaccgcaagcccacctacgagcgggacgtggacctcggggccggcacccgccacgtggcggtcgagcccgaggtggccaacctggacatcatcggccagcggatcgagaacatcaagcacgagcacaagagcacgtggcactacgacgaggacaacccctacaagacctgggcctaccacgggtcctacgaggtcaagccgagcggctccgccagcagcatggtgaacggggtggtcaagctgctcaccaagccctgggacgtgatccccatggtgacccagatcgccatgacggacaccacccccttcggccagcagcgcgtcttcaaggagaaggtggacacccggacgccgaaggcgaagcgcgggaccgcccagatcatggaggtgaccgcccggtggctgtggggcttcctgtcccgcaacaagaagccccggatctgcacccgcgaggagttcacgcggaaggtccgcagcaacgccgccatcggcgcggtgttcgtggacgagaaccagtggaactccgccaaggaggccgtcgaggacgagcggttctgggacctcgtgcagaaggagcgcgagctgcacaagcaggggaagtgcgcgacctgcgtgtacaacatgatgggcaagcgggagaagaagctgggggagttcggcaaggcgaaggggagccgcgccatctggtacatgtggctcggcgcccggttcctggagttcgaggccctgggcttcatgaacgaggaccactggttctcccgcgagaacagcctctccggggtcgagggcgaggggctgcacaagctgggctacatcctccgggacatcagcaagatccccgggggcaacatgtacgccgacgacaccgcgggctgggacacccgcatcacggaggacgacctgcagaacgaggccaagatcaccgacatcatggagccggagcacgccctgctcgccacctccatcttcaagctgacctaccagaacaaggtggtgcgggtccagcgccccgccaagaacgggacggtgatggacgtgatcagccgccgggaccagcgcggctccgggcaggtcggcacctacggcctgaacaccttcaccaacatggaggcgcagctcatccggcagatggagagcgaggggatcttctcccccagcgagctggagatccccaacctggccgagcgcgtgctcgactggctggagaagtacggcgtggagcggctgaagcgcatggccatctccggggacgactgcgtcgtgaagccgatcgacgaccggttcgccacggccctcaccgcgctgaacgacatgggcaaggtgcgcaaggacgtcccccagtgggagcccagcaaggggtggaacgactggcagcaggtccccttctgctcccaccacttccaccagctgatcatgaaggacggccgggagatcgtggtcccgtgccgcaaccaggacgagctcgtgggccgggcccgcgtgagccagggggccggctggagcctgcgggagaccgcctgcctggggaagtcctacgcccagatgtggcagctcatgtacttccaccgccgggacctgcgcctggcggccaacgccatctgcagcgccgtccccgtggactgggtgcccacctcccggacgacctggagcatccacgcgcaccaccagtggatgaccaccgaggacatgctctccgtctggaaccgcgtgtggatcgaggagaacccctggatggaggacaagacgcacgtgagctcctggggcgacgtcccgtacctggggaagcgggaggaccagtggtgcggcagcctgatcggcctcaccgcccgcgccacctgggcctccaacatccaggtggccatcaaccaggtgcgccggctgatcgggaacgagaactacctggactacatgaccagcatgaagcgcttcaagaacgagggcgaccccgagggggcgctctggtga

SEQ ID NO: 8388 - RNA, 9879 nt, synthetic construct
  misc_feature 1..9879: note = derived and/or modified CDS sequence (opt1) from DENV-1__FJ461316__SS-prME
  source 1..9879: mol_type = other RNA
agcgtgaccatgctgctcatgctgatgcccaccgccctggccttccacctcaccacccggggcggggagccccacatggtggtgagcaagcaggagcggggcaagagcctgctgttcaagaccagcgcgggggtgaacatgtgcaccctcatcgccatggacctgggcgagctgtgcgaggacaccatgacctacaagtgcccccggatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtggagacctgggccctccgccaccccgggttcacggtgatcgccctgttcctggcgcacgccatcggcaccagcatcacccagaaggggatcatcttcatcctcctgatgctggtcaccccctccatggccatgcggtgcgtgggcatcggcagccgcgacttcgtggaggggctctccggcgccacgtgggtcgacgtggtgctggagcacgggagctgcgtcaccaccatggccaaggacaagcccaccctggacatcgagctcctgaagacggaggtgaccaaccccgcgatcctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtcctgttctccggcgtcagctggaccatgaagatcgggctgggcgtgctgctcacgtggctgggcctgaactcccgcagcacctccctcagcatgacctgcatcgccgtggggctggtcaccctgtacctcggcgtgatggtgcaggccgactccgggtgcgtcatcaactggaagggccgggagctgaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctcgagaacgtgatgtggaagcagatctccaacgagctgaaccacatcctgctcgagaacgacatgaagttcaccgtggtcgtgggggacgtggcgggcatcctggcccaggggaagaagatgatccggccccagcccatggagtacaagtacagctggaagtcctggggcaaggccaagatcatgggcgccgacgtccagaacacgaccttcatcatcgacgggcccaacaccccggagtgccccgacgaccagcgcgcgtggaacatctgggaggtggaggactacggcttcgggatcttcaccacgaacatctggctgaagctccgggacagctacacccaggtgtgcgaccaccgcctgatgtccgccgccatcaaggacagcaaggccgtccacgccgacatgggctactggatcgagtccgagaagaacgagacctggaagctggcgcgggccagcttcatcgaggtgaagacctgcatctggcccaagtcccacacgctctggagcaacggcgtgctggagtccgagatgatcatccccaagatctacgggggcccgatcagccagcacaactaccgccccgggtacttcacccagaccgccggcccctggcacctggggaagctcgagctggacttcgacctgtgcgagggcaccacggtcgtggtggacgagcactgcggcaaccgggggccgtccctccgcaccaccaccgtcacgggcaagatcatccacgagtggtgctgccggagctgcaccctgccgcccctgcgcttccgcggggaggacggctgctggtacgggatggagatccgccccgtgaaggagaaggaggagaacctcgtgaagtccatggtcagcgccggcagcggcgaggtggactccttcagcctggggctgctctgcatctccatcatgatcgaggaggtgatgcggagccgctggtcccggaagatgctgatgaccggcaccctggccgtcttcctcctgctgatcatggggcagctcacgtggaacgacctgatccgcctgtgcatcatggtgggcgcgaacgccagcgaccgcatggggatgggcaccacctacctcgccctgatggccaccttcaagatgcggccgatgttcgccgtggggctcctgttccgccggctgacgtcccgcgaggtcctgctcctgaccatcgggctgagcctcgtggcgtccgtcgagctgcccaacagcctggaggagctcggcgacgggctggccatgggcatcatgatcctgaagctcctgaccgacttccagtcccaccagctgtgggccaccctcctgagcctgacgttcatcaagaccaccttctccctccactacgcctggaagaccatggcgatggtgctgagcatcgtgtccctgttccccctctgcctgagcacgacctcccagaagaccacctggctgcccgtcctcctgggcagcctggggtgcaagccgctcacgatgttcctgatcgccgagaacaagatctggggccggcgctcctggcccctgaacgaggggatcatggccgtgggcatcgtgagcatcctcctgagctccctgctcaagaacgacgtccccctggccgggcccctgatcgccggcggcatgctcatcgcgtgctacgtgatcagcgggtccagcgccgacctgtccctggagaaggccgccgaggtgagctgggaggaggaggccgagcactccggcgcgagccacaacatcctcgtcgaggtgcaggacgacgggaccatgaagatcaaggacgaggagcgggacgacaccctgaccatcctgctcaaggccaccctgctggccgtgtccggcgtctacccgctcagcatccccgccacgctgttcgtgtggtacttctggcagaagaagaagcagcgctccggggtgctgtgggacacccccagcccgcccgaggtcgagcgggccgtgctggacgacggcatctaccgcatcatgcagcggggcctcctggggcgctcccaggtgggcgtcggggtgttccaggagaacgtgttccacaccatgtggcacgtcacccggggcgcggtgctgatgtaccaggggaagcgcctcgagcccagctgggcctccgtgaagaaggacctgatcagctacggcggcgggtggcggctgcagggctcctggaacacgggggaggaggtccaggtgatcgccgtggagcccggcaagaaccccaagaacgtccagaccgcccccgggaccttcaagacccccgagggcgaggtgggcgccatcgcgctcgacttcaagcccgggacgagcggctcccccatcgtgaaccgcgaggggaagatcgtcggcctgtacggcaacggggtggtgaccaccagcggcacctacgtcagcgccatcgcccaggccaaggcgtcccaggaggggccgctgcccgagatcgaggacgaggtgttccggaagcgcaacctcacgatcatggacctgcaccccggcagcgggaagacccggcgctacctgccggccatcgtgcgggaggccatcaagcgcaagctccgcaccctgatcctggcccccacccgggtcgtggcctccgagatggcggaggccctcaagggcatgcccatccgctaccagacgaccgccgtcaagagcgagcacaccggcaaggagatcgtcgacctgatgtgccacgccaccttcacgatgcggctgctctcccccgtgcgcgtgccgaactacaacatgatcatcatggacgaggcccacttcaccgaccccagctccatcgcggcccgggggtacatcagcacccgcgtcggcatgggggaggccgccgccatcttcatgaccgcgacgccgcccggctccgtggaggccttcccgcagagcaacgccgtgatccaggacgaggagcgggacatccccgagcgctcctggaacagcgggtacgagtggatcaccgacttccccggcaagaccgtctggttcgtgccctccatcaagagcggcaacgacatcgccaactgcctgcggaagaacgggaagcgcgtgatccagctgtcccggaagaccttcgacacggagtaccagaagaccaagaacaacgactgggactacgtcgtgaccaccgacatcagcgagatgggcgcgaacttccgcgccgaccgggtgatcgacccgcgccggtgcctcaagcccgtcatcctgaaggacgggcccgagcgcgtgatcctggccggccccatgccggtcacggtggcctccgccgcgcagcggcgcgggcggatcggccgcaaccacaacaaggagggcgaccagtacatctacatggggcagcccctcaacaacgacgaggaccacgcccactggaccgaggccaagatgctgctggacaacatcaacacccccgagggcatcatccccgccctcttcgagccggagcgcgagaagtccgccgcgatcgacggggagtaccggctgcgcggcgaggcccggaagaccttcgtggagctgatgcgccgcggggacctccccgtctggctgtcctacaaggtggccagcgagggcttccagtacagcgaccgccggtggtgcttcgacggcgagcgcaacaaccaggtgctggaggagaacatggacgtcgagatctggacgaaggagggggagcggaagaagctccgcccccggtggctggacgcccgcacctactccgaccccctggccctccgggagttcaaggagttcgcggccggccgccggagcgtgtccggggacctgatcctggagatcggcaagctcccgcagcacctgacccagcgcgcccagaacgccctggacaacctcgtgatgctgcacaacagcgagcagggcgggcgggcgtaccgccacgccatggaggagctgcccgacaccatcgagacgctcatgctgctggccctcatcgccgtcctgaccggcggggtgaccctgttcttcctctccggccgggggctgggcaagaccagcatcggcctgctctgcgtgatggcctccagcgtcctgctgtggatggcgtccgtggagccccactggatcgccgccagcatcatcctcgagttcttcctgatggtgctgctcatccccgagccggaccgccagcggacgccccaggacaaccagctggcctacgtcgtgatcgggctcctcttcatgatcctgacggtggccgcgaacgagatgggcctgctcgagaccaccaagaaggacctggggatcggccacgccgccgtcgggaaccaccaccacgccgccatgctggacgtggacctccaccccgcgtccgcctggaccctgtacgccgtggccacgaccatcatcaccccgatgatgcgccacaccatcgagaacacgaccgccaacatcagcctgaccgcgatcgccaaccaggccgccatcctcatgggcctggacaagggctggcccatctccaagatggacatcggggtccccctgctcgcgctgggctgctacagccaggtgaaccccctgaccctcacggccgccgtgctgatgctggtcgcccactacgccatcatcgggccgggcctccaggcgaaggccacccgcgaggcccagaagcggaccgccgccgggatcatgaagaaccccaccgtggacggcatcgtggcgatcgacctggaccccgtcgtgtacgacgccaagttcgagaagcagctgggccagatcatgctcctgatcctgtgcacgtcccagatcctcctgatgcgcaccacctgggccctgtgcgagagcatcaccctcgccacggggcccctgaccaccctgtgggagggctccccggggaagttctggaacaccacgatcgccgtgagcatggcgaacatcttccggggctcctacctcgccggcgccgggctggccttcagcctgatgaagtccctcggcgggggccgccgggggaccggcgcgcagggcgagaccctgggggagaagtggaagcgccagctgaaccagctctccaagagcgagttcaacacctacaagcggtccggcatcatggaggtcgaccgcagcgaggccaaggaggggctgaagcggggcgagacgaccaagcacgccgtgtcccgcgggaccgccaagctgcggtggttcgtggagcgcaacctggtcaagcccgagggcaaggtgatcgacctcggctgcgggcggggcgggtggagctactactgcgccggcctgaagaaggtgaccgaggtcaaggggtacacgaagggcggccccgggcacgaggagcccatcccgatggcgacctacggctggaacctggtgaagctccactccgggaaggacgtgttcttcatcccgcccgagaagtgcgacaccctgctgtgcgacatcggcgagagctcccccaacccgaccatcgaggaggggcgcacgctccgggtcctgaagatggtggagccctggctgcgcggcaaccagttctgcatcaagatcctcaacccctacatgcccagcgtggtcgagaccctggagcagatgcagcggaagcacggcgggatgctggtgcgcaacccgctctcccggaacagcacccacgagatgtactgggtgtcctgcggcaccgggaacatcgtcagcgccgtgaacatgacctcccgcatgctgctgaaccgcttcacgatggcccaccggaagcccacctacgagcgcgacgtggacctcggcgccggcacccggcacgtcgccgtggagcccgaggtggcgaacctggacatcatcgggcagcgcatcgagaacatcaagcacgagcacaagagcacctggcactacgacgaggacaacccctacaagacgtgggcctaccacggctcctacgaggtcaagccgagcgggtccgccagcagcatggtgaacggcgtcgtgaagctgctcaccaagccctgggacgtgatccccatggtcacccagatcgccatgaccgacacgacccccttcgggcagcagcgggtgttcaaggagaaggtggacacccgcaccccgaaggccaagcggggcacggcgcagatcatggaggtcaccgccaagtggctgtggggcttcctgtcccgcaacaagaagccccggatctgcacccgcgaggagttcacccggaaggtgcgcagcaacgccgccatcggggcggtgttcgtcgacgagaaccagtggaactccgccaaggaggccgtggaggacgagcggttctgggacctcgtgcaccgcgagcgggagctgcacaagcagggcaagtgcgccacgtgcgtctacaacatgatggggaagcgcgagaagaagctgggcgagttcgggaaggccaagggcagccgggcgatctggtacatgtggctcggcgcccgcttcctggagttcgaggccctggggttcatgaacgaggaccactggttctcccgggagaacagcctctccggcgtggagggggagggcctgcacaagctggggtacatcctccgcgacatcagcaagatccccggcggcaacatgtacgccgacgacaccgccgggtgggacacccggatcaccgaggacgacctgcagaacgaggcgcgcatcacggacatcatggagccggagcacgccctgctcgccaagtccatcttcaagctgacctaccagaacaaggtggtccgcgtgcagcggcccgccaagaacggcaccgtgatggacgtcatcagccgccgggaccagcgcgggtccggccaggtgggcacctacgggctgaacacgttcaccaacatggaggcccagctcatccggcagatggagagcgagggcatcttctcccccagcgagctggagacccccaacctggcggagcgcgtgctcgactggctggagaagtacggggtcgagcggctgaagcgcatggccatctccggcgacgactgcgtggtgaagccgatcgacgaccggttcgccaccgccctcacggccctgaacgacatggggaaggtccgcaaggacatcccccagtgggagcccagcaagggctggaacgactggcagcaggtccccttctgctcccaccacttccaccagctgatcatgaaggacggccgggagatcgtggtcccgtgccgcaaccaggacgagctcgtggggcgggcgcgcgtgagccagggcgccgggtggagcctgcgggagaccgcctgcctgggcaagtcctacgcccagatgtggcagctcatgtacttccaccgccgggacctgcgcctggcggccaacgccatctgcagcgccgtccccgtggactggatccccacctcccggaccacgtggagcatccacgcccaccaccagtggatgaccaccgaggacatgctctccgtgtggaaccgcgtctggatcgaggagaacccctggatggaggacaagacccacatcagctcctggggcgacgtgccgtacctgggcaagcgcgaggaccagtggtgcggcagcctgatcgggctcacggcgcgggccacctgggccaccaacatccaggtggccatcaaccaggtccgccggctgatcggcaacgagaactacctggactacatgacctccatgaagcgcttcaagaacgagagcgaccccgagggggccctctggtga

SEQ ID NO: 8389 - RNA, 9879 nt, synthetic construct
  misc_feature 1..9879: note = derived and/or modified CDS sequence (opt1) from DENV-1__FJ410220__SS-prME
  source 1..9879: mol_type = other RNA
agcgtgaccatgctgctgatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtgacctacgggacctgcagccagaccggcgagcaccggcgcgagaagcggtccgtggccctcgcgccccacgtgggcctggggctggagacgcggaccgagacctggatgagctccgagggcgcctggaagcagatccagcgggtcgagacctgggccctccgccaccccgggttcacggtgatcgccctgttcctggcgcacgccatcggcaccagcatcacccagaaggggatcgtgttcatcctcctgatgctggtcaccccctccatggccatgcggtgcgtgggcatcggcagccgcgacttcgtggaggggctctccggcgccacgtgggtcgacgtggtgctggagcacgggagctgcgtcaccaccatggccaaggacaagcccaccctggacatcgagctcctgaagacggaggtgaccaaccccgcggtgctgcggaagctctgcatcgaggccaagatctccaacaccaccacggacagccgctgcccgacccagggcgaggccaccctggtcgaggagcaggacgccaacttcgtgtgccggcgcaccttcgtggaccggggctgggggaacggctgcgggctgttcggcaaggggtccctcctgacgtgcgccaagttcaagtgcgtcaccaagctggagggcaagatcgtgcagtacgagaacctcaagtacagcgtgatcgtcaccgtgcacaccggcgaccagcaccaggtcgggaacgagtccacggagcacggcaccaccgcgaccatcacgccccaggcccccacgaccgagatccagctgaccgactacggggccctgaccctcgactgcagcccccgcacgggcctggacttcaacgagatggtgctgctcaccatgaaggagaagtcctggctggtgcacaagcagtggttcctggacctccccctgccctggaccagcggggccagcacctcccaggagacgtggaaccggcaggacctgctcgtcaccttcaagaccgcccacgcgaagaagcaggaggtggtggtcctgggcagccaggagggcgccatgcacaccgccctgacgggggccaccgagatccagacctccggcaccacgaccatcttcgccgggcacctcaagtgccgcctgaagatggacaagctgaccctcaagggcatgagctacgtgatgtgcaccgggtccttcaagctggagaaggaggtggcggagacgcagcacggcaccgtcctggtgcagatcaagtacgagggcaccgacgccccctgcaagatccccttcagcacccaggacgagaagggggtgacgcagaacggccggctgatcaccgccaacccgatcgtcaccgacaaggagaagcccgtgaacatcgaggccgagccgcccttcggggagtcctacatcgtgatcggcgcgggcgagaaggccctcaagctgagctggttcaagaaggggtccagcatcggcaagatgttcgaggccaccgcccgcggggcccggcgcatggcgatcctgggcgacacggcctgggacttcgggtccatcggcggcgtcttcaccagcgtggggaagctcgtgcaccagatcttcggcaccgcctacggggtcctgttctccggcgtgagctggaccatgaagatcgggatcggcgtgctgctcacgtggctgggcctgaactcccgcagcacctccctcagcatgacctgcatcgccgtcgggctggtgaccctgtacctcggcgtgatggtccaggccgactccgggtgcgtgatcaactggaagggccgggagctgaagtgcgggagcggcatcttcgtgacgaacgaggtccacacctggaccgagcagtacaagttccaggcggacagcccgaagcgcctgtccgccgccatcggcaaggcctgggaggagggggtgtgcggcatccggagcgccacccgcctcgagaacatcatgtggaagcagatctccaacgagctgaaccacatcctgctcgagaacgacatgaagttcaccgtggtcgtgggggacgtggcgggcatcctggtccaggggaagaagatgatccggccccagcccatggagtacaagtacagctggaagtcctggggcaaggccaagatcatcggcgccgacgtgcagaacagcacgttcatcatcgacgggcccaacaccccggagtgccccgacgaccagcgcgcctggaacatctgggaggtggaggactacggcttcgggatcttcaccaccaacatctggctgaagctccgggactcctacacgcaggtctgcgaccaccgcctgatgagcgcggccatcaaggactccaaggccgtgcacgccgacatgggctactggatcgagagcgagaagaacgagacctggaagctggcccgggcgtccttcatcgaggtgaagacctgcatctggcccaagagccacaccctctggtccaacggcgtcctggagagcgagatgatcatccccaagatccacgggggcccgatctcccagcacaactaccgccccgggtacttcacgcagaccgccggcccctggcacctggggaagctcgagctggacttcgacctgtgcgagggcaccaccgtggtggtcgacgagcactgcggcaaccgggggccgagcctccgcacgaccaccgtgaccggcaagatcatccacgagtggtgctgccggtcctgcacgctgccgcccctgcgcttccgcggggaggacggctgctggtacgggatggagatccgccccgtgaaggagaaggaggagaacctcgtcaagagcatggtgagcgccggctccggcgaggtggacagcttctccctggggctgctctgcatcagcatcatgatcgaggaggtcatgcggtcccgctggagccggaagatgctgatgaccggcaccctggccgtgttcttcctcctgatcatggggcagctgacctggaacgacctcatccgcctgtgcatcatggtgggcgccaacgcgtccgaccgcatggggatgggcacgacctacctggccctcatggccaccttcaagatgcggccgatgttcgccgtcggcctgctgttccgccggctcaccagccgcgaggtgctgctgctcacgatcgggctgtccctggtcgccagcgtggagctccccaactccctggaggagctgggcgacgggctcgcgatgggcatcatgatcctgaagctgctcaccgacttccagagctaccagctgtgggccaccctgctctccctgaccttcatcaagacgaccttcagcctgcactacgcctggaagaccatggccatggtgctctccatcgtcagcctgttccccctgtgcctctccaccacgagccagaagaccacctggctgcccgtgctgctcggctccctggggtgcaagccgctgaccatgttcctcatcgcggagaacaagatctggggccggaagtcctggcccctgaacgaggggatcatggccgtgggcatcgtcagcatcctgctctccagcctgctgaagaacgacgtgcccctcgccgggcccctgatcgccggcggcatgctgatcgcctgctacgtgatctccgggagctccgcggacctcagcctggagaaggccgccgaggtctcctgggaggaggaggccgagcacagcggcgcctcccacaacatcctggtggaggtgcaggacgacgggacgatgaagatcaaggacgaggagcgcgacgacaccctcaccatcctgctgaaggcgaccctcctggccgtcagcggcgtgtacccgctgtccatccccgccaccctcttcgtgtggcacttctggcagaagaagaagcagcggagcggggtcctgtgggacacgcccagcccgcccgaggtggagcgcgccgtgctggacgacggcatctaccggatcatgcagcgcggcctgctcgggcggagccaggtcggcgtgggggtgttccaggagaacgtcttccacaccatgtggcacgtgacccgcggcgccgtgctgatgtaccaggggaagcggctggagccctcctgggcgagcgtcaagaaggacctcatctcctacggcggcgggtggcgcttccagggcagctggaacaccggggaggaggtccaggtgatcgccgtcgagcccggcaagaaccccaagaacgtgcagacggcccccgggaccttcaagacccccgagggcgaggtgggcgccatcgccctggacttcaagcccgggacctccggcagccccatcgtcaaccgggaggggaagatcgtgggcctgtacggcaacggggtggtcacgaccagcggcacctacgtgtccgcgatcgcccaggccaaggccagccaggaggggccgctccccgagatcgaggacgaggtgttccgcaagcggaacctgaccatcatggacctgcaccccggctccgggaagacgcgccggtacctcccggcgatcgtccgcgaggccatcaagcggaagctgcgcaccctgatcctcgcccccacccgcgtggtggccagcgagatggccgaggcgctgaagggcatgcccatccggtaccagaccacggccgtcaagtccgagcacaccggcaaggagatcgtggacctgatgtgccacgccaccttcaccatgcgcctcctgagccccgtgcgggtcccgaactacaacatgatcatcatggacgaggcccacttcacggacccctccagcatcgccgcgcgcgggtacatctccacccgggtgggcatgggggaggccgccgccatcttcatgaccgccacgccgcccggcagcatggaggcgttcccgcagtccaacgccgtgatccaggacgaggagcgcgacatccccgagcggagctggaactccgggtacgagtggatcacggacttccccggcaagaccgtctggttcgtgcccagcatcaaggccggcaacgacatcgccaactgcctgcgcaagaacgggaagcgggtgatccagctctcccgcaagaccttcgacaccgagtaccagaagacgaagaacaacgactgggactacgtcgtgaccaccgacatcagcgagatgggcgcgaacttccgggccgaccgcgtgatcgacccgcggcgctgcctgaagcccgtcatcctgaaggacgggcccgagcgggtgatcctcgccggccccatgccggtcaccgtggcctccgccgcgcagcgccgggggcgcatcggccggaaccacaacaaggagggcgaccagtacatctacatggggcagcccctgaacaacgacgaggaccacgcccactggacggaggccaagatgctgctcgacaacatcaacacccccgagggcatcatccccgccctgttcgagccggagcgcgagaagtccgccgcgatcgacggggagtaccgcctgcggggcgaggcccgcaagaccttcgtggagctcatgcggcgcggggacctgcccgtctggctgtcctacaaggtggccagcgagggcttccagtacagcgaccggcgctggtgcttcgacggcgagcggaacaaccaggtgctcgaggagaacatggacgtcgagatctggaccaaggagggggagcgcaagaagctgcggccccgctggctggacgcccggacgtactccgaccccctcgccctgcgcgagttcaaggagttcgcggccggccggcgcagcgtgtccggggacctgatcctcgagatcggcaagctgccgcagcacctgacccagcgggcccagaacgccctcgacaacctggtgatgctgcacaacagcgagcagggcgggcgcgcgtaccggcacgccatggaggagctccccgacaccatcgagaccctgatgctgctcgccctgatcgccgtcctgacgggcggggtgaccctcttcttcctgtccggcaaggggctgggcaagaccagcatcggcctcctgtgcgtgatggcctccagcgtcctgctctggatggcgtccgtggagccccactggatcgccgccagcatcatcctggagttcttcctgatggtgctcctgatccccgagccggaccgccagcggacgccccaggacaaccagctggcctacgtcgtgatcgggctcctgttcatgatcctgaccgtggccgcgaacgagatgggcctcctggagacgaccaagaaggacctggggatcggccacgtcgccgtggagaaccaccaccacgccgccatgctcgacgtggacctgcaccccgcctccgcgtggaccctgtacgccgtcgccaccacgatcatcaccccgatgatgcgccacaccatcgagaacaccacggccaacatcagcctcaccgccatcgcgaaccaggccgccatcctgatggggctggacaagggctggcccatctccaagatggacatcggcgtgcccctcctggccctggggtgctacagccaggtgaaccccctcaccctgaccgcggccgtcctgatgctcgtggcccactacgccatcatcggcccggggctgcaggccaaggcgacgcgggaggcccagaagcgcaccgccgccggcatcatgaagaaccccaccatcgacgggatcgtggccatcgacctggaccccgtcgtgtacgacgcgaagttcgagaagcagctcggccagatcatgctgctgatcctctgcacctcccagatcctgctgatgcgcacgacctgggccctctgcgagagcatcaccctggccaccggccccctgacgaccctctgggaggggtccccgggcaagttctggaacaccaccatcgccgtgagcatggccaacatcttccgggggtcctacctggcgggcgccggcctggccttcagcctcatgaagtccctcgggggcgggcgccgggggacgggggcccagggcgagaccctgggcgagaagtggaagcgccagctcaaccagctgtccaagagcgagttcaacacctacaagcggtccgggatcatggaggtcgaccgcagcgaggcgaaggagggcctgaagcgcggggagaccacgaagcacgccgtgtcccgcggcaccgccaagctccggtggttcgtggagcgcaacctggtcaagcccgaggggaaggtgatcgacctgggctgcggccgcgggggctggagctactactgcgccgggctgaagaaggtgaccgaggtcaagggctacaccaagggcggccccggccacgaggagcccatcccgatggccacgtacgggtggaacctcgtgaagctgcactccggcaaggacgtgttcttcatcccgcccgagaagtgcgacaccctgctctgcgacatcggggagagctcccccaacccgaccatcgaggagggccgcaccctgcgggtcctgaagatggtggagccctggctccgcgggaaccagttctgcatcaagatcctgaacccctacatgcccagcgtggtcgagacgctggagcagatgcagcggaagcacggcggcatgctcgtgcgcaacccgctgtcccggaacagcacccacgagatgtactgggtgtcctgcgggaccggcaacatcgtcagcgcggtgaacatgacctcccgcatgctgctcaaccggttcaccatggcccaccgcaagcccacgtacgagcgcgacgtggacctgggggccggcacccggcacgtcgccgtggagcccgaggtggccaacctggacatcatcggccagcgcatcgagaacatcaagcacgagcacaagagcacctggcactacgacgaggacaacccctacaagacctgggcgtaccacgggtcctacgaggtcaagccgagcggctccgccagcagcatggtgaacggggtcgtgaagctcctgacgaagccctgggacgtgatccccatggtcacccagatcgccatgaccgacaccacgcccttcggccagcagcgggtgttcaaggagaaggtggacacccgcaccccgaaggccaagcgggggaccgcccagatcatggaggtcacggcgcgctggctgtggggcttcctctcccggaacaagaagccccgcatctgcacccgggaggagttcacccgcaaggtgcggagcaacgccgccatcggcgccgtgttcgtcgacgagaaccagtggaactccgcgaaggaggccgtggaggacgaccgcttctgggacctggtgcaccgggagcgcgagctgcacaagcaggggaagtgcgcgacctgcgtctacaacatgatgggcaagcgggagaagaagctcggggagttcggcaaggccaaggggagccgcgccatctggtacatgtggctgggcgcgcggttcctggagttcgaggccctcggcttcatgaacgaggaccactggttctcccgcgagaacagcctgtccggggtggagggcgaggggctgcacaagctcggctacatcctgcgggacatcagcaagatccccgggggcaacatgtacgccgacgacacggccggctgggacacccgcatcaccgaggacgacctgcagaacgaggccaagatcaccgacatcatggagccggagcacgcgctcctggccaagtccatcttcaagctgacgtaccagaacaaggtggtccgggtgcagcgccccgccaagaacgggaccgtgatggacgtcatcagccgccgggaccagcgcggctccggccaggtggggacctacggcctcaacaccttcacgaacatggaggcccagctgatccggcagatggagagcgaggggatcttcctgcccaacgagctcgagacccccaacctggccggccgcgtgctggactggctcgagaagtacggggtcgagcggctgaagcgcatggcgatctccggcgacgactgcgtggtgaagccgatcgacgaccggttcgccaccgccctgaccgccctcaacgacatggggaaggtccgcaaggacatcccccagtgggagcccagcaagggctggaacgactggcagcaggtccccttctgctcccaccacttccaccagctgatcatgaaggacggccgggagatcgtggtcccgtgccgcaaccaggacgagctggtggggcgggcccgcgtgagccagggcgcggggtggtccctccgggagacggcctgcctgggcaagagctacgcccagatgtggcagctgatgtacttccaccgccgggacctccgcctggccgcgaacgccatctgcagcgccgtccccgtggactgggtgcccacctcccggaccacctggagcatccacgcccaccaccagtggatgacgaccgaggacatgctgtccgtctggaaccgcgtgtggatcgaggagaacccctggatggaggacaagacccggatcagctcctgggaggacgtgccgtacctcgggaagcgcgaggaccagtggtgcggcagcctgatcggcctgaccgcccgcgcgacgtgggccaccaacatccaggtcgccatcaaccaggtgcggcgcctcatcgggaacgagaactactccgactacatgaccagcatgaagcggttcaagaacgagtccgagcccgagggcgccctgtggtga

SEQ ID NO: 8390 - RNA, 9879 nt, synthetic construct
  misc_feature 1..9879: note = derived and/or modified CDS sequence (opt1) from DENV-1__JF937649__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgaggtggagcccgacgacgtggactgctggtgcaacaccaccgacacctgggtgacctacgggacctgcagccagacgggcgagcaccggcgcgacaagcggagcgtggccctcgcgccccacgtcggcctggggctggagacccgcgccgagacctggatgagctccgagggcgcgtggaagcagatccagaaggtggagacctgggccctccggcaccccgggttcacggtgatcgccctgttcctggcccacgcgatcggcaccagcatcacccagaaggggatcatcttcatcctcctgatgctggtcaccccctccatggccatgcgctgcgtgggcatcggcagccgggacttcgtggaggggctctccggcgccacgtgggtcgacgtggtgctggagcacgggagctgcgtcaccaccatggccaaggacaagcccaccctggacatcgagctcctgaagacggaggtgaccaaccccgccgtgctgcgcaagctctgcatcgaggcgaagatctccaacaccaccacggacagccggtgcccgacccagggcgaggccaccctggtcgaggagcaggacgccaacttcgtgtgccgccggaccttcgtggaccgcggctgggggaacggctgcgggctgttcggcaaggggtccctcatcacgtgcgccaagttcaagtgcgtcaccaagctggagggcaagatcgtgcagtacgagaacctgaagtacagcgtgatcgtcaccgtgcacaccggcgaccagcaccaggtcgggaacgagtccacggagcacggcaccaccgccaccatcacgccccaggcgcccacgagcgagatccagctcaccgactacggggccctgaccctggactgcagcccccggaccggcctcgacttcaacgagatggtgctgctgacgatgaaggagaagtcctggctcgtgcacaagcagtggttcctggacctgcccctcccctggaccagcggggcctccaccagccaggagacctggaaccgccaggacctgctggtcacgttcaagaccgcccacgccaagaagcaggaggtggtggtcctcggctcccaggagggcgcgatgcacaccgccctgaccggggccacggagatccagaccagcggcaccaccacgatcttcgccgggcacctgaagtgccggctcaagatggacaagctgaccctgaagggcatgtcctacgtgatgtgcaccgggagcttcaagctcgagaaggaggtggccgagacccagcacggcacggtcctggtgcagatcaagtacgagggcaccgacgcgccctgcaagatccccttctccacccaggacgagaagggggtgacccagaacggccgcctgatcacggccaacccgatcgtcaccgacaaggagaagcccgtgaacatcgaggccgagccgcccttcggggagagctacatcgtgatcggcgccggcgagaaggcgctgaagctctcctggttcaagaaggggagctccatcggcaagatgttcgaggccaccgcccgcggggcccgccggatggccatcctgggcgacaccgcgtgggacttcgggagcatcggcggcgtcttcacgtccgtggggaagctggtgcaccagatcttcggcaccgcctacggggtcctcttcagcggcgtgtcctggaccatgaagatcgggatcggcgtgctgctgacctggctcggcctgaacagccgctccacgagcctgtccatgacctgcatcgccgtcgggctcgtgaccctgtacctgggcgtgatggtccaggccgacagcgggtgcgtgatcaactggaagggccgcgagctcaagtgcgggagcggcatcttcgtgaccaacgaggtccacacgtggaccgagcagtacaagttccaggccgactccccgaagcggctgagcgcggccatcggcaaggcctgggaggagggggtgtgcggcatccgctccgccacccggctggagaacatcatgtggcgccagatcagcaacgagctcaaccacatcctgctggagaacgacatgaagttcaccgtggtcgtgggggacgtggtcggcatcctcgcccaggggaagaagatgatccggccccagcccatggagcacaagtactcctggaagtcctggggcaaggcgaagatcatcggcgccgacgtgcagaacaccacgttcatcatcgacgggcccaacaccccggagtgccccgacgaccagcgcgcctggaacatctgggaggtggaggactacggcttcgggatcttcaccaccaacatctggctgaagctgcgggactcctacacgcaggtctgcgaccaccgcctcatgagcgccgcgatcaaggactccaaggccgtgcacgccgacatgggctactggatcgagagcgagaagaacgagacctggaagctggcccgggcctccttcatcgaggtgaagacctgcatctggcccaagagccacaccctgtggtccaacggcgtcctcgagagcgagatgatcatccccaagatctacgggggcccgatctcccagcacaactaccgccccgggtacttcacgcagaccgcgggcccctggcacctggggaagctggagctcgacttcgacctgtgcgagggcaccaccgtggtggtcgacgagcactgcggcaaccgggggccgagcctgcgcacgaccaccgtgaccggcaagatcatccacgagtggtgctgccggtcctgcacgctgccgcccctccgcttcaagggggaggacggctgctggtacgggatggagatccggcccgtgaaggagaaggaggagaacctggtcaagagcatggtgagcgccggctccggcgaggtggacagcttctccctcgggctgctgtgcatcagcatcatgatcgaggaggtcatgcgctcccggtggagccgcaagatgctcatgaccggcaccctggccgtgttcttcctgctcatcatggggcagctgacctggaacgacctgatccggtcctgcatcatggtgggcgccaacgccagcgaccgcatggggatgggcacgacctacctcgcgctgatggccaccttcaagatgcgcccgatgttcgccgtcgggctgctgttccggcgcctgacctcccgggaggtgctgctcctgacgatcgggctgagcctcgtcgcctccgtggagctgcccaacagcctggaggagctcggcgacgggctggccatgggcatcatgatcctgaagctcctgaccgacttccagtcctaccagctgtgggcgaccctcctgagcctgaccttcatcaagacgaccttctccctccactacgcctggaagaccatggccatggtgctgagcatcgtctccctgctccccctgtgcctgagcaccacgtcccagaagaccacctggctccccgtgctgctgggcagcctcgggtgcaagccgctgaccatgttcctgatcgccgagaacaagatctggggccgcaagagctggcccctcaacgaggggatcatggcggtgggcatcgtctccatcctgctgagctccctcctgaagaacgacgtgcccctggccgggcccctcatcgccggcggcatgctgatcgcctgctacgtgatcagcgggtccagcgccgacctgtccctcgagaaggcggccgaggtcagctgggaggaggaggccgagcactccggcgccagccacaacatcctggtggaggtgcaggacgacgggacgatgaagatcaaggacgaggagcgggacgacaccctgaccatcctcctgaaggccaccctgctcgcggtctccggcgtgtacccgctgagcatccccgccaccctgttcgtgtggtacttctggcagaagaagaagcagcgctccggggtcctctgggacacgcccagcccgcccgaggtggagcgggccgtgctggacgacggcatctaccgcatcatgcagcggggcctgctggggcgctcccaggtcggcgtgggggtgttccaggagaacgtcttccacaccatgtggcacgtgacccggggcgccgtgctcatgtaccaggggaagcgcctggagcccagctgggcctccgtcaagaaggacctgatcagctacggcggcgggtggcggctccagggctcctggaacaccggggaggaggtccaggtgatcgcggtcgagcccggcaagaaccccaagaacgtgcagacggcccccgggaccttcaagacccccgagggcgaggtgggcgccatcgccctggacttcaagcccgggaccagcggcagccccatcgtcaaccgcgaggggaagatcgtgggcctgtacggcaacggggtggtcacgacctccggcacctacgtgagcgccatcgcgcaggccaaggcctcccaggaggggccgctccccgagatcgaggacgaggtgttccggaagcgcaacctgaccatcatggacctgcaccccggcagcgggaagacgcggcgctacctcccggccatcgtccgggaggcgatcaagcgcaagctgcggaccctgatcctcgcccccacccgcgtggtggcctccgagatggccgaggccctgaagggcatgcccatccgctaccagaccacggcggtcaagagcgagcacaccggccgggagatcgtggacctgatgtgccacgccaccttcaccatgcgcctcctgtcccccgtgcgggtcccgaactacaacatgatcatcatggacgaggcccacttcacggaccccagctccatcgccgcccgcgggtacatcagcacccgggtgggcatgggggaggcggccgccatcttcatgaccgccacgccgcccggctccgtggaggccttcccgcagagcaacgcggtcatccaggacgaggagcgcgacatccccgagcggtcctggaacagcgggtacgagtggatcacggacttccccggcaagaccgtgtggttcgtgccctccatcaagagcggcaacgacatcgccaactgcctgcgcaagaacgggaagcgggtcatccagctctcccgcaagaccttcgacaccgagtaccagaagacgaagaacaacgactgggactacgtggtgaccaccgacatcagcgagatgggcgccaacttccgggccgaccgcgtcatcgacccgcggcgctgcctgaagcccgtgatcctgaaggacgggcccgagcgggtcatcctcgcgggccccatgccggtgaccgtggcctccgccgcccagcgccgggggcgcatcggccggaaccacaacaaggagggcgaccagtacatctacatggggcagcccctgaacaacgacgaggaccacgcccactggacggaggcgaagatgctgctcgacaacatcaacacccccgagggcatcatccccgccctgttcgagccggagcgcgagaagtccgccgccatcgacggggagtaccgcctgcggggcgaggcccgcaagaccttcgtcgagctcatgcggcgcggggacctgcccgtgtggctgagctacaaggtggcgtccgagggcttccagtacagcgaccggcgctggtgcttcgacggcgagcggaacaaccaggtcctcgaggagaacatggacgtggagatctggaccaaggagggggagcgcaagaagctgcggccccgctggctggacgcccggacgtactccgaccccctcgccctgcgcgagttcaaggagttcgccgccggccggcgcagcgtgtccggggacctgatcctcgagatcggcaagctgccgcagcacctgacccagcgggcgcagaacgccctcgacaacctggtcatgctgcacaacagcgagcagggcgggcgcgcctaccggcacgccatggaggagctccccgacaccatcgagaccctgatgctgctcgcgctgatcgccgtgctgacgggcggggtgaccctcttcttcctgtccggcaaggggctgggcaagaccagcatcggcctcctgtgcgtcatggcctccagcgccctgctctggatggcctccgtggagccccactggatcgcggccagcatcatcctggagttcttcctgatggtgctcctgatccccgagccggaccgccagcggacgccccaggacaaccagctggcctacgtcgtgatcgggctcctgttcatgatcctgaccgtggccgccaacgagatgggcctcctggagacgaccaagaaggacctggggatcggccacgtcgcggtggagaaccaccaccacgccaccatgctcgacgtggacctgcaccccgcctccgcctggaccctgtacgccgtcgcgacgaccatcatcaccccgatgatgcgccacaccatcgagaacacgaccgccaacatcagcctcaccgccatcgccaaccaggccgcgatcctgatggggctggacaagggctggcccatctccaagatggacatcggcgtgcccctcctggccctggggtgctacagccaggtgaaccccctcaccctgacggccgccgtcctgatgctcgtggcgcactacgccatcatcggcccggggctgcaggccaaggccacccgggaggcccagaagcgcaccgcggccggcatcatgaagaaccccaccgtggacgggatcgtcgccatcgacctggaccccgtggtgtacgacgccaagttcgagaagcagctcggccagatcatgctgctgatcctctgcacgtcccagatcctgctgatgcgcaccacctgggccctctgcgagagcatcaccctggcgacgggccccctgaccaccctctgggaggggtccccgggcaagttctggaacaccacgatcgccgtcagcatggccaacatcttccgggggagctacctggccggcgccggcctggcgttctccctcatgaagtccctcgggggcgggcgccgggggaccggggcccagggcgagaccctgggcgagaagtggaagcgccagctcaaccagctgtccaagagcgagttcaacacctacaagcggtccgggatcatggaggtggaccgcagcgaggccaaggagggcctgcggcgcggggagacgaccaagcacgccgtgtcccggggcaccgcgaagctccgctggttcgtcgagcggaacctggtgaagcccgaggggaaggtgatcgacctgggctgcggccgcgggggctggagctactactgcgccgggctgaagaaggtcaccgaggtgaagggctacacgaagggcgggcccggccacgaggagcccatcccgatggccacctacgggtggaacctcgtgaagctgcactccggcaaggacgtcttcttcatcccgcccgagaagtgcgacaccctgctctgcgacatcggggagagctcccccaacccgaccatcgaggagggccggacgctgcgcgtgctgaagatggtggagccctggctccgggggaaccagttctgcatcaagatcctgaacccctacatgcccagcgtcgtggagaccctggagcagatgcagcgcaagcacggcggcatgctcgtgcggaacccgctgtcccgcaacagcacccacgagatgtactgggtctcctgcgggaccggcaacatcgtgagcgccgtgaacatgacctcccggatgctgctcaaccgcttcacgatggcccaccgcaagcccacctacgagcgggacgtcgacctgggggcgggcacccgccacgtggccgtggagcccgaggtcgccaacctggacatcatcggccagcggatcgagaacatcaagcacgagcacaagagcacctggcactacgacgaggacaacccctacaagacgtgggcctaccacgggtcctacgaggtgaagccgagcggcagcgcctccagcatggtcaacggggtggtgaagctcctgaccaagccctgggacgtcatccccatggtgacccagatcgcgatgaccgacacgacccccttcggccagcagcgcgtgttcaaggagaaggtcgacacccggaccccgaaggccaagcgcgggacggcccagatcatggaggtgaccgcccggtggctgtggggcttcctctcccgcaacaagaagccccggatctgcacccgcgaggagttcacccggaaggtgcgcagcaacgccgcgatcggcgccgtcttcgtggacgagaaccagtggaactccgccaaggaggccgtggaggacgagcggttctgggacctggtccaccgcgagcgggagctgcacaagcaggggaagtgcgcgacgtgcgtgtacaacatgatgggcaagcgcgagaagaagctcggggagttcggcaaggccaaggggagccgggccatctggtacatgtggctgggcgcccgcttcctggagttcgaggccctcggcttcatgaacgaggaccactggttctcccgggagaacagcctgtccggggtggagggcgaggggctgcacaagctcggctacatcctgcgcgacatcagcaagatccccgggggcaacatgtacgcggacgacaccgccggctgggacacccggatcaccgaggacgacctgcagaacgaggccaagatcacggacatcatggagccggagcacgccctcctggccacctccatcttcaagctgacctaccagaacaaggtcgtgcgcgtgcagcgccccgcgcggaacgggaccgtcatggacgtgatcagccgccgggaccagcgcggctccggccaggtgggcacgtacggcctcaacaccttcaccaacatggaggcccagctgatccggcagatggagagcgaggggatcttctcccccagcgagctggagacccccaacctcgccgagcgcgtcctggactggctggagaagcacggcgtggagcggctcaagcgcatggccatctccggggacgactgcgtggtcaagccgatcgacgaccggttcgccacggcgctgagcgccctgaacgacatgggcaaggtgcgcaaggacatcccccagtgggagcccagcaaggggtggaacgactggcagcaggtccccttctgctcccaccacttccaccagctcatcatgaaggacggccgggagatcgtcgtgccgtgccgcaaccaggacgagctggtgggccgggcccgcgtcagccagggggccggctggtccctgcgggagaccgcctgcctcggcaagagctacgcgcagatgtggcagctgatgtacttccaccgccgggacctgcgcctcgccgccaacgccatctgctccgcggtgcccgtggactgggtccccaccagccggaccacgtggtccatccacgcccaccaccagtggatgaccaccgaggacatgctgagcgtgtggaaccgcgtgtggatcgaggagaacccctggatggaggacaagacccacatctccagctggggcgacgtcccgtacctggggaagcgcgaggaccagtggtgcggctccctcatcggcctgacggcccgggccacctgggccaccaacatccaggtggcgatcaaccaggtgcgccggctgatcgggaacgagaactacctcgactacatgaccagcatgaagcgcttcaagaacgagtccgaccccgagggcgccctgtggtga

SEQ ID NO: 8391 - RNA, 9879 nt, synthetic construct
  misc_feature 1..9879: note = derived and/or modified CDS sequence (opt1) from DENV-1__FJ410222__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtcacctacgggacctgcagccagacgggcgagcaccggcgggacaagcggtccgtggccctcgcgccccacgtgggcctggggctggagacccgcaccgagacctggatgagctccgagggcgcctggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggagctggccgagacccagcacggcaccgtgctggtgcagatcaagtacgagggcaccgacgcgccctgcaagatccccttcagcacgcaggacgagaagggggtcacccagaacggccggctgatcaccgccaacccgatcgtgaccgacaaggagaagcccgtgaacatcgaggccgagccgcccttcggggagtcctacatcgtcatcggcgccggcgagaaggcgctcaagctgagctggttcaagaaggggtccagcatcggcaagatgttcgaggccacggcccgcggggcccggcgcatggccatcctgggcgacaccgcgtgggacttcgggtccatcggcggcgtgttcaccagcgtggggaagctcgtccaccagatcttcggcaccgcctacggggtgctgttctccggcgtgagctggacgatgaagatcgggatcggcgtcctgctcacctggctgggcctgaactcccgcagcacctccctcagcatgacctgcatcgccgtggggctggtgacgctgtacctcggcgtcatggtgcaggccgactccgggtgcgtgatcaactggaagggccgggagctgaagtgcgggagcggcatcttcgtcaccaacgaggtgcacacctggaccgagcagtacaagttccaggccgacagcccgaagcgcctgtccgcggccatcggcaaggcctgggaggagggggtgtgcggcatccggagcgccacccgcctcgagaacatcatgtggaagcagatctccaacgagctgaaccacatcctgctcgagaacgacatgaagttcacggtcgtggtgggggacgtcgccggcatcctggcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctgaagctccgggacagctacacccaggtctgcgaccaccgcctgatgtccgcggccatcaaggacagcaaggccgtgcacgccgacatgggctactggatcgagtccgagaagaacgagacctggaagctggcccgggcgagcttcatcgaggtgaagacgtgcatctggcccaagtcccacaccctctggagcaacggcgtcctggagtccgagatgatcatccccaagatctacgggggcccgatcagccagcacaactaccgccccgggtacttcacccagaccgccggcccctggcacctggggaagctcgagctggacttcgacctgtgcgagggcacgaccgtggtggtcgacgagcactgcggcaaccgggggccgtccctccgcaccaccacggtgaccggcaagatcatccacgagtggtgctgccggagctgcaccctgccgcccctgcgcttccgcggggaggacggctgctggtacgggatggagatccgccccgtgaaggagaaggaggagaacctcgtcaagtccatggtgagcgccggcagcggcgaggtggactccttcagcctggggctgctctgcatctccatcatgatcgaggaggtcatgcggagccgctggtcccggaagatgctgatgaccggcacgctggccgtgttcttcctcctgatcatggggcagctgacctggaacgacctcatccgcctgtgcatcatggtgggcgccaacgcgagcgaccgcatggggatgggcaccacctacctggccctcatggccacgttcaagatgcggccgatgttcgccgtcggcctgctgttccgccggctcacctcccgcgaggtgctgctgctcaccatcgggctgagcctggtggcctccgtcgagctccccaacagcctggaggagctgggcgacgggctcgcgatgggcatcatgatcctgaagctgctcaccgacttccagtcccaccagctgtgggccacgctgctcagcctgaccttcatcaagaccaccttctccctgcactacgcctggaagacgatggccatggtgctcagcatcgtctccctgctgcccctctgcctgagcaccacctcccagaagaccacgtggctgcccgtgctcctgggcagcctggggtgcaagccgctcaccatgttcctgatcgcggagaacaagatctggggccggcgctcctggcccctgaacgaggggatcatggccgtgggcatcgtcagcatcctcctgagctccctgctcaagaacgacgtgcccctggccgggcccctgatcgccggcggcatgctcatcgcctgctacgtgatcagcgggtccagcgcggacctgtccctggagaaggccgccgaggtcagctgggaggaggaggccgagcactccggcgccagccacaacatcctcgtggaggtgcaggacgacgggaccatgaagatcaaggacgaggagcgggacgacaccctgaccatcctgctcaaggcgacgctgctggccgtctccggcgtgtacccgctcagcatccccgccaccctgttcgtgtggtacttctggcagaagaagaagcagcgctccggggtcctgtgggacacccccagcccgcccgaggtggagcgggccgtgctggacgacggcatctaccgcatcatgcagcggggcctcctggggcgctcccaggtcggcgtgggggtgttccaggagaacgtcttccacaccatgtggcacgtgacgcggggcgccgtgctgatgtaccaggggaagcgcctcgagcccagctgggcgtccgtcaagaaggacctgatcagctacggcggcgggtggcggctgcagggctcctggaacaccggggaggaggtccaggtgatcgccgtcgagcccggcaagaaccccaagaacgtgcagaccgcccccgggaccttcaagacgcccgagggcgaggtgggcgccatcgccctcgacttcaagcccgggaccagcggctcccccatcgtcaaccgcgaggggaagatcgtgggcctgtacggcaacggggtggtcaccaccagcggcacgtacgtgagcgcgatcgcccaggccaaggcctcccaggaggggccgctgcccgagatcgaggacgaggtgttccggaagcgcaacctcaccatcatggacctgcaccccggcagcgggaagacccggcgctacctgccggcgatcgtccgggaggccatcaagcgcaagctccgcaccctgatcctggcccccacgcgggtggtggcctccgagatggccgaggcgctcaagggcatgcccatccgctaccagaccaccgccgtcaagagcgagcacaccggcaaggagatcgtggacctgatgtgccacgccacgttcaccatgcggctgctctcccccgtgcgcgtcccgaactacaacatgatcatcatggacgaggcccacttcaccgaccccagctccatcgccgcgcgggggtacatcagcacccgcgtgggcatgggggaggccgccgccatcttcatgacggccacgccgcccggctccgtggaggcgttcccgcagagcaacgccgtcatccaggacgaggagcgggacatccccgagcgctcctggaacagcgggtacgagtggatcaccgacttccccggcaagaccgtgtggttcgtgccctccatcaagagcggcaacgacatcgccaactgcctgcggaagaacgggaagcgcgtcatccagctgtcccggaagacgttcgacaccgagtaccagaagaccaagaacaacgactgggactacgtggtgaccacggacatcagcgagatgggcgccaacttccgcgcggaccgggtcatcgacccgcgccggtgcctcaagcccgtgatcctgaaggacgggcccgagcgcgtgatcctggccggccccatgccggtcaccgtggcctccgccgcccagcggcgcgggcggatcggccgcaaccacaacaaggagggcgaccagtacatctacatggggcagcccctcaacaacgacgaggaccacgcgcactggaccgaggccaagatgctgctggacaacatcaacacccccgagggcatcatccccgccctcttcgagccggagcgcgagaagtccgccgccatcgacggggagtaccggctgcgcggcgaggcgcggaagacgttcgtcgagctgatgcgccgcggggacctccccgtgtggctgtcctacaaggtggccagcgagggcttccagtacagcgaccgccggtggtgcttcgacggcgagcgcaacaaccaggtcctggaggagaacatggacgtggagatctggaccaaggagggggagcggaagaagctccgcccccggtggctggacgcccgcacctactccgaccccctggccctccgggagttcaaggagttcgccgcgggccgccggagcgtgtccggggacctgatcctggagatcggcaagctcccgcagcacctgacccagcgcgcccagaacgccctggacaacctcgtcatgctgcacaacagcgagcagggcgggcgggcctaccgccacgcgatggaggagctgcccgacacgatcgagaccctcatgctgctggccctcatcgccgtgctgaccggcggggtgaccctgttcttcctctccggccgggggctgggcaagaccagcatcggcctgctctgcgtcatggcctccagcgtgctgctgtggatggcctccgtggagccccactggatcgcggccagcatcatcctcgagttcttcctgatggtcctgctcatccccgagccggaccgccagcggacgccccaggacaaccagctggcctacgtggtgatcgggctcctgttcatgatcctgaccgtcgccgccaacgagatgggcctgctcgagaccaccaagaaggacctggggatcggccacgtggcggtggagaaccaccaccacgccgccatgctggacgtcgacctccaccccgcctccgcctggacgctgtacgcggtggccaccaccatcatcaccccgatgatgcgccacacgatcgagaacaccaccgccaacatcagcctgaccgccatcgccaaccaggcggccatcctcatggggctggacaagggctggcccatctccaagatggacatcggcgtgcccctgctcgccctggggtgctacagccaggtcaaccccctgacgctcaccgccgcggtgctgatgctggtggcccactacgccatcatcggcccggggctccaggccaaggccacccgcgaggcgcagaagcggaccgccgccggcatcatgaagaaccccacggtcgacgggatcgtggccatcgacctggaccccgtggtctacgacgccaagttcgagaagcagctgggccagatcatgctcctgatcctgtgcacctcccagatcctcctgatgcgcaccacctgggcgctgtgcgagagcatcacgctcgccaccggccccctgaccaccctgtgggaggggtccccgggcaagttctggaacacgaccatcgccgtgagcatggccaacatcttccgggggtcctacctcgccggcgcgggcctggccttcagcctgatgaagtccctcgggggcgggcgccggggcaccggggcccagggcgagaccctgggcgagaagtggaagcgccagctgaaccagctctccaagagcgagttcaacacgtacaagcggtccgggatcatggaggtggaccgcagcgaggccaaggagggcctgaagcgcggggagaccaccaagcacgcggtctcccgcggcaccgccaagctgcggtggttcgtggagcgcaacctggtgaagcccgaggggaaggtcatcgacctcggctgcggccgcggcgggtggagctactactgcgccgggctgaagaaggtgacggaggtgaaggggtacaccaagggcggccccggccacgaggagcccatcccgatggccacctacgggtggaacctggtcaagctccactccggcaaggacgtgttcttcatcccgcccgagaagtgcgacaccctgctgtgcgacatcggggagagctcccccaacccgacgatcgaggagggccgcaccctccgggtgctgaagatggtcgagccctggctgcgcgggaaccagttctgcatcaagatcctcaacccctacatgcccagcgtggtggagaccctggagcagatgcagcggaagcacggcggcatgctggtccgcaacccgctctcccggaacagcacccacgagatgtactgggtgtcctgcgggaccggcaacatcgtgagcgccgtcaacatgacgtcccgcatgctgctgaaccgcttcaccatggcgcaccggaagcccacctacgagcgcgacgtggacctcggggccggcacccggcacgtggccgtcgagcccgaggtggccaacctggacatcatcggccagcgcatcgagaacatcaagcacgagcacaagagcacgtggcactacgacgaggacaacccctacaagacctgggcctaccacgggtcctacgaggtgaagccgagcggctccgcgagcagcatggtcaacggggtggtcaagctgctcaccaagccctgggacgtgatccccatggtgacccagatcgccatgacggacaccacccccttcggccagcagcgggtcttcaaggagaaggtggacacccgcacgccgaaggccaagcgggggaccgcccagatcatggaggtgaccgccaagtggctgtggggcttcctgtcccgcaacaagaagccccggatctgcacccgcgaggagttcacgcggaaggtccgcagcaacgcggccatcggcgccgtgttcgtggacgagaaccagtggaactccgccaaggaggcggtcgaggacgagcggttctgggacctcgtgcaccgcgagcgggagctgcacaagcaggggaagtgcgcgacctgcgtgtacaacatgatgggcaagcgcgagaagaagctgggggagttcggcaaggccaaggggagccgggccatctggtacatgtggctcggcgcccgcttcctggagttcgaggcgctgggcttcatgaacgaggaccactggttctcccgggagaacagcctctccggggtcgagggcgaggggctgcacaagctgggctacatcctccgcgacatcagcaagatccccgggggcaacatgtacgccgacgacaccgccggctgggacacccggatcacggaggacgacctgcagaacgaggcccgcatcaccgacatcatggagccggagcacgccctgctcgcgaagtccatcttcaagctgacctaccagaacaaggtggtgcgcgtccagcggcccgccaagaacgggaccgtgatggacgtgatcagccgccgggaccagcgcggctccgggcaggtcggcacgtacggcctgaacaccttcaccaacatggaggcccagctcatccggcagatggagagcgaggggatcttctcccccagcgagctggagacccccaacctggccaagcgcgtgctcgactggctggagaagtacggcgtggagcggctgaagcgcatggccatctccggggacgactgcgtcgtgaagccgatcgacgaccggttcgcgacggccctcaccgccctgaacgacatgggcaaggtgcgcaaggacatcccccagtgggagcccagcaaggggtggaacgactggcagcaggtccccttctgctcccaccacttccaccagctgatcatgaaggacggccgggagatcgtggtgccgtgccgcaaccaggacgagctcgtcggccgggcccgcgtgagccagggggccggctggagcctgcgggagaccgcgtgcctggggaagtcctacgcccagatgtggcagctcatgtacttccaccgccgggacctgcgcctggccgccaacgcgatctgcagcgccgtgcccgtcgactggatccccacctcccggacgacctggagcatccacgcccaccaccagtggatgaccaccgaggacatgctctccgtgtggaaccgcgtgtggatcgaggagaacccctggatggaggacaagacgcacatcagctcctggggcgacgtcccgtacctggggaagcgcgaggaccagtggtgcggcagcctgatcggcctcaccgcccgggccacctgggcgaccaacatccaggtggccatcaaccaggtgcgccggctgatcgggaacgagaactacctggactacatgacctccatgaagcgcttcaagaacgagagcgaccccgagggcgccctctggtga

SEQ ID NO: 8392 - RNA, 9879 nt, synthetic construct
  misc_feature 1..9879: note = derived and/or modified CDS sequence (opt1) from DENV-1__FJ461319__SS-prME
  source 1..9879: mol_type = other RNA
agcgtgaccatgctgctcatgctgatgcccaccgccctggccttccacctcaccacccggggcggggagccccacatggtggtgagcaagcaggagcggggcaagagcctgctgttcaagaccagcgccggggtgaacatgtgcaccctcatcgccatggacctgggcgagctgtgcgaggacaccatgacctacaagtgcccccggatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtggagacctgggccctccgccaccccgggttcacggtgatcgccctgttcctggcgcacgccatcggcaccagcatcacccagaaggggatcatcttcatcctcctgatgctggtcaccccctccatggccatgcggtgcgtgggcatcggcagccgcgacttcgtggaggggctctccggcgccacgtgggtcgacgtggtgctggagcacgggagctgcgtcaccaccatggccaaggacaagcccaccctggacatcgagctcctgaagacggaggtgaccaaccccgcgatcctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtcctgttctccggcgtcagctggaccatgaagatcgggctgggcgtgctgctcacgtggctgggcctgaactcccgcagcacctccctcagcatgacctgcatcgccgtggggctggtcaccctgtacctcggcgtgatggtgcaggccgactccgggtgcgtcatcaactggaagggccgggagctgaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctcgagaacgtgatgtggaagcagatctccaacgagctgaaccacatcctgctcgagaacgacatgaagttcaccgtggtcgtgggggacgtggcgggcatcctggcccaggggaagaagatgatccggccccagcccatggagcacaagtacagctggaagtcctggggcaaggccaagatcatcggcgccgacgtccagaacacgaccttcatcatcgacgggcccaacaccccggagtgccccgacgaccagcgcgcgtggaacatctgggaggtggaggactacggcttcgggatcttcaccacgaacatctggctgaagctccgggacagctacacccaggtgtgcgaccaccgcctgatgtccgccgccatcaaggacagcaaggccgtccacgccgacatgggctactggatcgagtccgagaagaacgagacctggaagctggcgcgggccagcttcatcgaggtgaagacctgcatctggcccaagtcccacacgctctggagcaacggcgtgctggagtccgagatgatcatccccaagatctacgggggcccgatcagccagcacaactaccgccccgggtacttcacccagaccgccggcccctggcacctggggaagctcgagctggacttcgacctgtgcgagggcaccacggtcgtggtggacgagcactgcggcaaccgggggccgtccctccgcaccaccaccgtcacgggcaagatcatccacgagtggtgctgccggagctgcaccctgccgcccctgcgcttccgcggggaggacggctgctggtacgggatggagatccgccccgtgaaggagaaggaggagaacctcgtgaagtccatggtcagcgccggcagcggcgaggtggactccttcagcctggggctgctctgcatctccatcatgatcgaggaggtgatgcggagccgctggtcccggaagatgctgatgaccggcaccctggccgtcttcctcctgctgatcatggggcagctcacgtggaacgacctgatccgcctgtgcatcatggtgggcgcgaacgccagcgaccgcatggggatgggcaccacctacctcgccctgatggccaccttcaagatgcggccgatgttcgccgtggggctcctgttccgccggctgacgtcccgcgaggtcctgctcctgaccatcgggctgagcctcgtggcgtccgtcgagctgcccaacagcctggaggagctcggcgacgggctggccatgggcatcatgatcctgaagctcctgaccgacttccagtcccaccagctgtgggccaccctcctgagcctgacgttcatcaagaccaccttctccctccactacgcctggaagaccatggcgatggtgctgagcatcgtgtccctgttccccctctgcctgagcacgacctcccagaagaccacctggctgcccgtcctcctgggcagcctggggtgcaagccgctcacgatgttcctgatcgccgagaacaagatctggggccggcgctcctggcccctgaacgaggggatcatggccgtgggcatcgtgagcatcctcctgagctccctgctcaagaacgacgtccccctggccgggcccctgatcgccggcggcatgctcatcgcgtgctacgtgatcagcgggtccagcgccgacctgtccctggagaaggccgccgaggtgagctgggaggaggaggccgagcactccggcgcgagccacaacatcctcgtcgaggtgcaggacgacgggaccatgaagatcaaggacgaggagcgggacgacaccctgaccatcctgctcaaggccaccctgctggccgtgtccggcgtctacccgctcagcatccccgccacgctgttcgtgtggtacttctggcagaagaagaagcagcgctccggggtgctgtgggacacccccagcccgcccgaggtcgagcgggccgtgctggacgacggcatctaccgcatcatgcagcggggcctcctggggcgctcccaggtgggcgtcggggtgttccaggagaacgtgttccacaccatgtggcacgtcacccggggcgcggtgctgatgtaccaggggaagcgcctcgagcccagctgggcctccgtgaagaaggacctgatcagctacggcggcgggtggcggctgcagggctcctggaacacgggggaggaggtccaggtgatcgccgtggagcccggcaagaaccccaagaacgtccagaccgcccccgggaccttcaagacccccgagggcgaggtgggcgccatcgcgctcgacttcaagcccgggacgagcggctcccccatcgtgaaccgcgaggggaagatcgtcggcctgtacggcaacggggtggtgaccaccagcggcacctacgtcagcgccatcgcccaggccaaggcgtcccaggaggggccgctgcccgagatcgaggacgaggtgttccggaagcgcaacctcacgatcatggacctgcaccccggcagcgggaagacccggcgctacctgccggccatcgtgcgggaggccatcaagcgcaagctccgcaccctgatcctggcccccacccgggtcgtggcctccgagatggcggaggccctcaagggcatgcccatccgctaccagacgaccgccgtcaagagcgagcacaccggcaaggagatcgtcgacctgatgtgccacgccaccttcacgatgcggctgctctcccccgtgcgcgtgccgaactacaacatgatcatcatggacgaggcccacttcaccgaccccagctccatcgcggcccgggggtacatcagcacccgcgtcggcatgggggaggccgccgccatcttcatgaccgcgacgccgcccggctccgtggaggccttcccgcagagcaacgccgtgatccaggacgaggagcgggacatccccgagcgctcctggaacagcgggtacgagtggatcaccgacttccccggcaagaccgtctggttcgtgccctccatcaagagcggcaacgacatcgccaactgcctgcggaagaacgggaagcgcgtgatccagctgtcccggaagaccttcgacacggagtaccagaagaccaagaacaacgactgggactacgtcgtgaccaccgacatcagcgagatgggcgcgaacttccgcgccgaccgggtgatcgacccgcgccggtgcctcaagcccgtcatcctgaaggacgggcccgagcgcgtgatcctggccggccccatgccggtcacggtggcctccgccgcgcagcggcgcgggcggatcggccgcaaccacaacaaggagggcgaccagtacatctacatggggcagcccctcaacaacgacgaggaccacgcccactggaccgaggccaagatgctgctggacaacatcaacacccccgagggcatcatccccgccctcttcgagccggagcgcgagaagtccgccgcgatcgacggggagtaccggctgcgcggcgaggcccggaagaccttcgtggagctgatgcgccgcggggacctccccgtctggctgtcctacaaggtggccagcgagggcttccagtacagcgaccgccggtggtgcttcgacggcgagcgcaacaaccaggtgctggaggagaacatggacgtcgagatctggacgaaggagggggagcggaagaagctccgcccccggtggctggacgcccgcacctactccgaccccctggccctccgggagttcaaggagttcgcggccggccgccggagcgtgtccggggacctgatcctggagatcggcaagctcccgcagcacctgacccagcgcgcccagaacgccctggacaacctcgtgatgctgcacaacagcgagcagggcgggcgggcgtaccgccacgccatggaggagctgcccgacaccatcgagacgctcatgctgctggccctcatcgccgtcctgaccggcggggtgaccctgttcttcctctccggccgggggctgggcaagaccagcatcggcctgctctgcgtgatggcctccagcgtcctgctgtggatggcgtccgtggagccccactggatcgccgccagcatcatcctcgagttcttcctgatggtgctgctcatccccgagccggaccgccagcggacgccccaggacaaccagctggcctacgtcgtgatcgggctcctcttcatgatcctgacggtggccgcgaacgagatgggcctgctcgagaccaccaagaaggacctggggatcggccacgccgccgtcgggaaccaccaccacgccgccatgctggacgtggacctccaccccgcgtccgcctggaccctgtacgccgtggccacgaccatcatcaccccgatgatgcgccacaccatcgagaacacgaccgccaacatcagcctgaccgcgatcgccaaccaggccgccatcctcatgggcctggacaagggctggcccatctccaagatggacatcggggtccccctgctcgcgctgggctgctacagccaggtgaaccccctgaccctcacggccgccgtgctgatgctggtcgcccactacgccatcatcgggccgggcctccaggcgaaggccacccgcgaggcccagaagcggaccgccgccgggatcatgaagaaccccaccgtggacggcatcgtggcgatcgacctggaccccgtcgtgtacgacgccaagttcgagaagcagctgggccagatcatgctcctgatcctgtgcacgtcccagatcctcctgatgcgcaccacctgggccctgtgcgagagcatcaccctcgccgccgggcccctgacgaccctgtgggagggctccccggggaagttctggaacaccaccatcgcggtgagcatggccaacatcttccggggctcctacctcgccggcgccgggctggcgttcagcctgatgaagtccctcggcgggggccgccgggggacgggcgcccagggcgagaccctgggggagaagtggaagcgccagctgaaccagctctccaagagcgagttcaacacctacaagcggtccggcatcatggaggtcgaccgcagcgaggccaaggaggggctgaagcggggcgagaccacgaagcacgccgtgtcccgcgggaccgccaagctgcggtggttcgtggagcgcaacctggtcaagcccgagggcaaggtgatcgacctcggctgcgggcggggcgggtggagctactactgcgcgggcctgaagaaggtgaccgaggtcaaggggtacaccaagggcggccccgggcacgaggagcccatcccgatggccacgtacggctggaacctggtgaagctccactccgggaaggacgtgttcttcatcccgcccgagaagtgcgacaccctgctgtgcgacatcggcgagagctcccccaacccgaccatcgaggaggggcgcaccctccgggtcctgaagatggtggagccctggctgcgcggcaaccagttctgcatcaagatcctcaacccctacatgcccagcgtggtcgagacgctggagcagatgcagcggaagcacggcgggatgctggtgcgcaacccgctctcccggaacagcacccacgagatgtactgggtgtcctgcggcaccgggaacatcgtcagcgccgtgaacatgacctcccgcatgctgctgaaccgcttcaccatggcccaccggaagcccacgtacgagcgcgacgtggacctcggcgccggcacccggcacgtcgcggtggagcccgaggtggccaacctggacatcatcgggcagcgcatcgagaacatcaagcacgagcacaagagcacctggcactacgacgaggacaacccctacaagacctgggcctaccacggctcctacgaggtcaagccgagcgggtccgccagcagcatggtgaacggcgtcgtgaagctgctcacgaagccctgggacgtgatccccatggtcacccagatcgccatgaccgacaccacgcccttcgggcagcagcgggtgttcaaggagaaggtggacacccgcaccccgaaggcgaagcggggcaccgcccagatcatggaggtcacggccaagtggctgtggggcttcctgtcccgcaacaagaagccccggatctgcacccgcgaggagttcacccggaaggtgcgcagcaacgccgcgatcggggccgtgttcgtcgacgagaaccagtggaactccgccaaggaggccgtggaggacgagcggttctgggacctcgtgcaccgcgagcgggagctgcacaagcagggcaagtgcgcgacctgcgtctacaacatgatggggaagcgcgagaagaagctgggcgagttcgggaaggcgaagggcagccgggccatctggtacatgtggctcggcgcccgcttcctggagttcgaggccctggggttcatgaacgaggaccactggttctcccgggagaacagcctctccggcgtggagggggagggcctgcacaagctggggtacatcctccgcgacatcagcaagatccccggcggcaacatgtacgccgacgacacggcggggtgggacacccggatcaccgaggacgacctgcagaacgaggcccgcatcaccgacatcatggagccggagcacgccctgctcgccaagtccatcttcaagctgacgtaccagaacaaggtggtccgcgtgcagcggcccgccaagaacggcaccgtgatggacgtcatcagccgccgggaccagcgcgggtccggccaggtgggcacctacgggctgaacaccttcacgaacatggaggcgcagctcatccggcagatggagagcgagggcatcttctcccccagcgagctggagacccccaacctggccgagcgcgtgctcgactggctggagaagtacggggtcgagcggctgaagcgcatggccatctccggcgacgactgcgtggtgaagccgatcgacgaccggttcgccaccgccctcaccgcgctgaacgacatggggaaggtccgcaaggacatcccccagtgggagcccagcaagggctggaacgactggcagcaggtccccttctgctcccaccacttccaccagctgatcatgaaggacggccgggagatcgtggtcccgtgccgcaaccaggacgagctcgtggggcgggcccgcgtgagccagggcgccgggtggagcctgcgggagacggcctgcctgggcaagtcctacgcgcagatgtggcagctcatgtacttccaccgccgggacctgcgcctggccgccaacgccatctgcagcgccgtccccgtggactggatccccacctcccggaccacctggagcatccacgcgcaccaccagtggatgacgaccgaggacatgctctccgtgtggaaccgcgtctggatcgaggagaacccctggatggaggacaagacccacatcagctcctggggcgacgtgccgtacctgggcaagcgcgaggaccagtggtgcggcagcctgatcgggctcaccgcccgggccacgtgggccaccaacgtgcaggtcgccatcaaccaggtgcgccggctgatcggcaacgagaactacctggactacatgacctccatgaagcgcttcaagaacgagagcgaccccgagggggcgctctggtga

SEQ ID NO: 8393 - RNA, 9879 nt, synthetic construct
  misc_feature 1..9879: note = derived and/or modified CDS sequence (opt1) from DENV-1__FJ461320__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgccggggtgaacatgtgcaccctcatcgccatggacctgggggagctgtgcgaggacaccatgacctacaagtgcccccggatcaccgaggccgagcccgacgacgtggactgctggtgcaacgccaccgacacctgggtgacctacgggacctgcagccagacgggggagcaccggcgcgacaagcggagcgtggccctcgcgccccacgtgggcctggggctggagacccgcaccgagacctggatgtccagcgagggcgcctggaagcagatccagcgggtggagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccgtgggcggcgtgttcaccagcgtcgggaagctggtgcaccagatcttcggcaccgcctacggggtcctgttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggccgactccgggtgcgtcatcaactggaagggccgggagctcaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctggagaacatcatgtggaagcagatctccaacgagctcaaccacatcctgctggagaacgacatgaagttcaccgtggtggtcggggacgtggtgggcatcctcgcgcaggggaagaagatgatccggccccagcccatggagcacaagtacagctggaagtcctggggcaaggccaagatcatcggcgccgacgtccagaacacgaccttcatcatcgacgggcccaacaccccggagtgccccgacgaccagcgcgcctggaacatctgggaggtggaggactacggcttcgggatcttcaccacgaacatctggctgaagctgcgggacagctacacccaggtgtgcgaccaccgcctcatgtccgcggccatcaaggacagcaaggccgtccacgccgacatgggctactggatcgagtccgagaagaacgagacctggaagctggcccgggcgagcttcatcgaggtgaagacctgcatctggcccaagtcccacacgctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcaccacggtcgtggtggacgagcactgcggcaaccgggggccgtccctgcgcaccaccaccgtcacgggcaagatcatccacgagtggtgctgccggagctgcaccctgccgcccctccgcttcaagggggaggacggctgctggtacgggatggagatccggcccgtgaaggagaaggaggagaacctggtgaagtccatggtcagcgccggcagcggcgaggtggactccttcagcctcgggctgctgtgcatctccatcatggtggaggaggtcatgcgcagccggtggtcccgcaagatgctcatgaccggcaccctggccgtgttcctgctcctgatcatggggcagctgacgtggaacgacctcatccggctgtgcatcatggtgggcgccaacgcgagcgaccgcatggggatgggcaccacctacctggccctcatggccaccttcaagatccgcccgatgttcgccgtcggcctgctgttccggcgcctcacgtcccgggaggtgctgctgctcaccatcgggctgagcctggtcgcctccgtggagctccccaacagcctggaggagctgggcgacgggctcgcgatgggcatcatgatcctgaagctgctcaccgacttccagtcccaccagctgtgggccaccctgctcagcctgacgttcatcaagaccaccctgtccctccactacgcctggaagaccatggccatggtgctgagcatcgtctccctgttccccctctgcctgagcacgacctcccagaagaccacctggctgcccgtgctcctgggcagcctggggtgcaagccgctcacgatgttcctgatcaccgagaacaagatctggggccgcaagtcctggcccctgaacgaggggatcatggcggtgggcgtcgtgagcatcctcctgagctccctgctcaagaacgacgtgcccctggccgggcccctgatcgccggcggcatgctcatcgcctgctacgtcatcagcgggtccagcgccgacctgtccctggagaaggcggccgaggtgagctgggaggaggaggccgagcactccggcgccagccacaacatcctcgtggaggtccaggacgacgggaccatgaagatcaaggacgaggagcgggacgacaccctgaccatcctgctcaaggccacgctgctggcggtgtccggcgtgtacccgctcagcatccccgccaccctgttcgtctggtacttctggcagaagaagaagcagcgctccggggtgctgtgggacacccccagcccgcccgaggtggagcgggccgtcctggacgacggcatctaccgcatcatgcagcggggcctcctggggcgctcccaggtgggcgtgggggtcttccaggagaacgtgttccacaccatgtggcacgtgacgcggggcgccgtcctgatgtaccaggggaagcgcctcgagcccagctgggcctccgtgaagaaggacctgatcagctacggcggcgggtggcggctgcagggctcctggaacaccggggaggaggtgcaggtcatcgcggtggagcccggcaagaaccccaagaacgtgcagaccgcccccgggaccttcaagacgcccgagggcgaggtcggcgccatcgccctcgacttcaagcccgggaccagcggctcccccatcgtgaaccgcgaggggaagatcgtgggcctgtacggcaacggggtcgtgaccaccagcggcacgtacgtgagcgccatcgcgcaggccaaggcctcccaggaggggccgctgcccgagatcgaggacgaggtcttccggaagcgcaacctcaccatcatggacctgcaccccggcagcgggaagacccggcgctacctgccggccatcgtgcgggaggcgatcaagcgcaagctccggaccctgatcctggcccccacgcgcgtggtcgcctccgagatggccgaggccctcaagggcatgcccatccgctaccagaccaccgcggtcaagagcgagcacaccggcaaggagatcgtggacctgatgtgccacgccacgttcaccatgcggctgctctcccccgtccgcgtgccgaactacaacatgatcatcatggacgaggcccacttcaccgaccccagctccatcgccgcccgggggtacatcagcacccgcgtgggcatgggggaggcggccgccatcttcatgacggccacgccgcccggctccgtcgaggccttcccgcagagcaacgcggtgatccaggacgaggagcgggacatccccgagcgctcctggaacagcgggtacgagtggatcaccgacttccccggcaagaccgtgtggttcgtcccctccatcaagagcggcaacgacatcgccaactgcctgcggaagaacgggaagcgcgtgatccagctgtcccggaagacgttcgacaccgagtaccagaagaccaagaacaacgactgggactacgtggtcaccacggacatcagcgagatgggcgccaacttccgcgccgaccgggtgatcgacccgcgccggtgcctcaagcccgtcatcctgaaggacgggcccgagcgcgtgatcctggcgggccccatgccggtgaccgtcgcctccgccgcccagcggcgcgggcggatcggccgcaaccacaacaaggagggcgaccagtacatctacatggggcagcccctcaacaacgacgaggaccacgcccactggaccgaggcgaagatgctgctggacaacatcaacacccccgagggcatcatccccgccctcttcgagccggagcgggagaagtccgccgccatcgacggggagtaccgcctgcgcggcgaggcccggaagacgttcgtggagctgatgcgccgcggggacctccccgtgtggctgtcctacaaggtcgcgagcgagggcttccagtacagcgaccgccggtggtgcttcgacggcgagcgcaacaaccaggtgctggaggagaacatggacgtggagatctggaccaaggagggggagcggaagaagctccgcccccggtggctggacgcccgcacctactccgaccccctggccctccgggagttcaaggagttcgccgccggccgccggagcgtctccggggacctgatcctggagatcggcaagctcccgcagcacctgacccagcgcgcgcagaacgccctggacaacctcgtgatgctgcacaacagcgagcagggcgggcgggcctaccgccacgccatggaggagctgcccgacacgatcgagaccctcatgctgctggcgctcatcgccgtgctgaccggcggggtcaccctgttcttcctctccggccgggggctgggcaagaccagcatcggcctgctctgcgtgatggcctccagcgtgctgctgtggatggcctccgtcgagccccactggatcgccgcgagcatcatcctcgagttcttcctgatggtgctgctcatccccgagccggaccgccagcggacgccccaggacaaccagctggcctacgtggtcatcgggctcctcttcatgatcctgaccgtggccgccaacgagatgggcctgctcgagaccaccaagaaggacctggggatcggccacgtggccgtcgagaaccaccaccacgcgacgatgctggacgtggacctccaccccgcctccgcctggaccctgtacgccgtggccaccaccatcatcacgccgatgatgcgccacaccatcgagaacaccaccgcgaacatcagcctgacggccatcgccaaccaggccgccatcctcatggggctggacaagggctggcccatctccaagatggacatcggcgtccccctgctcgcgctggggtgctacagccaggtgaaccccctgaccctcaccgccgccgtgctgatgctggtcgcccactacgcgatcatcggcccggggctccaggccaaggccacccgggaggcccagaagcgcacggccgcgggcatcatgaagaaccccaccgtggacgggatcgtggccatcgacctggaccccgtcgtgtacgacgccaagttcgagaagcagctgggccagatcatgctcctgatcctgtgcacctcccagatcctcctgatgcgcaccacgtgggccctgtgcgagagcatcaccctcgccaccggccccctgaccacgctgtgggaggggtccccgggcaagttctggaacaccaccatcgcggtgagcatggccaacatcttccgggggtcctacctcgccggcgccggcctggccttcagcctgatgaagtccctcgggggcgggcgccggggcaccggggcgcagggcgagacgctgggcgagaagtggaagcgccagctgaaccagctctccaagagcgagttcaacatctacaagcggtccgggatcatggaggtcgaccgcagcgaggccaaggagggcctgaagcgcggggagaccacccgccacgccgtgtcccggggcaccgccaagctgcgctggttcgtggagcggaacctggtcaagcccgaggggaaggtgatcgacctcggctgcggccgcgggggctggagctactactgcgcggggctgaagaaggtgacggaggtcaagggctacaccaagggcgggcccggccacgaggagcccatcccgatggccacctacgggtggaacctggtgaagctccactccggcaaggacgtgttcttcacgccgcccgagaagtgcgacacgctgctgtgcgacatcggggagagctcccccaacccgaccatcgaggagggccggaccctccgcgtcctgaagatggtggagccctggctgcgggggaaccagttctgcatcaagatcctcaacccctacatgcccagcgtggtcgagaccctggagcagatgcagcgcaagcacggcggcatgctggtgcggaacccgctctcccgcaacagcacccacgagatgtactgggtgtcctgcgggacgggcaacatcgtcagcgccgtgaacatgacctcccggatgctgctgaaccgcttcaccatggcccaccgcaagcccacctacgagcgggacgtggacctcggggccggcacgcgccacgtcgcggtggagcccgaggtcgccaacctggacatcatcggccagcggatcgagaacatcaagcacgagcacaagagcacctggcactacgacgaggacaacccctacaagacctgggcctaccacgggtcctacgaggtgaagccgagcggctccgccagcagcatggtgaacggggtcgtgaagctgctcaccaagccctgggacgtgatccccatggtcacgcagatcgccatgaccgacaccacccccttcggccagcagcgcgtgttcaaggagaaggtggacacgcggaccccgaaggcgaagcgcgggaccgcccagatcatggaggtcaccgcccggtggctgtggggcttcctgtcccgcaacaagaagccccggatctgcacgcgcgaggagttcacccggaaggtgcgcagcaacgccgccatcggcgcggtgttcgtcgacgagaaccagtggaactccgccaaggaggccgtggaggacgagcggttctgggacctcgtgcagaaggagcgcgagctgcacaagcaggggaagtgcgcgacctgcgtctacaacatgatgggcaagcgggagaagaagctgggggagttcggcaaggcgaaggggagccgcgccatctggtacatgtggctcggcgcccggttcctggagttcgaggccctgggcttcatgaacgaggaccactggttctcccgcgagaacagcctctccggggtggagggcgaggggctgcacaagctgggctacatcctccgggacatcagcaagatccccgggggcaacatgtacgccgacgacaccgcgggctgggacacgcgcatcaccgaggacgacctgcagaacgaggccaagatcaccgacatcatggagccggagcacgccctgctcgccacctccatcttcaagctgacgtaccagaacaaggtggtccgggtgcagcgccccgccaagaacgggaccgtgatggacgtcatcagccgccgggaccagcgcggctccggccaggtgggcacctacggcctgaacaccttcacgaacatggaggcgcagctcatccggcagatggagagcgaggggatcttcctgccctccgagctggagacccccaacctcgccgagcgcgtgctggactggctggagaagtacggcgtcgagcggctcaagcgcatggccatcagcggggacgactgcgtggtgaagccgatcgacgaccggttcgccaccgccctgaccgcgctgaacgacatgggcaaggtccgcaaggacatcccccagtgggagccctccaaggggtggaacgactggcagcaggtccccttctgcagccaccacttccaccagctcatcatgaaggacggccgggagatcgtggtcccgtgccgcaaccaggacgagctggtgggccgggcccgcgtgtcccagggggccggctggagcctgcgggagacggcctgcctcggcaagagctacgcccagatgtggcagctgatgtacttccaccgccgggacctgcgcctcgcggccaacgccatctgctccgccgtccccgtggactgggtgcccaccagccggaccacctggtccatccacgcgcaccaccagtggatgacgaccgaggacatgctgagcgtctggaaccgcgtgtggatcgaggagaacccctggatggaggacaagacccacgtgtccagctggggcgacgtcccgtacctggggaagcgggaggaccagtggtgcggctccctcatcggcctgaccgcccgcgccacctgggccagcaacatccaggtggccatcaaccaggtgcgccggctgatcgggaacgagaactacctcgactacatgacgtccatgaagcgcttcaagaacgagggcgaccccgagggggcgctgtggtga

SEQ ID NO: 8394 - RNA, 9879 nt, synthetic construct
  misc_feature 1..9879: note = derived and/or modified CDS sequence (opt1) from DENV-1__FJ410225__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgagaccgagcccgacgacgtggactgctggtgcaacgccacggacacctgggtgacctacgggacctgcagccagacgggcgagcaccggcgcgacaagcggtccgtggccctcgcgccccacgtgggcctggggctggagacccgcaccgagacctggatgagctccgagggcgcgtggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcatcgggaagctggtccaccagatcttcggcaccgcctacggggtgctgttctccggcgtgagctggacgatgaagatcgggatcggcgtcctgctgacctggctcggcctgaactcccgcagcacctccctgagcatgacctgcatcgccgtggggctcgtgacgctgtacctgggcgtcatggtgcaggccgactccgggtgcgtgatcaactggaagggccgggagctcaagtgcgggagcggcatcttcgtcaccaacgaggtgcacacctggaccgagcagtacaagttccaggccgacagcccgaagcgcctgtccgcggccatcggcaaggcctgggaggagggggtgtgcggcatccggagcgccacccgcctggagaacatcatgtggaagcagatctccaacgagctcaaccacatcctgctggagaacgacatgaagttcacggtcgtggtgggggacgtcgccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctgaagctgcgggacagctacacccaggtctgcgaccaccgcctcatgtccgcggccatcaaggacagcaaggccgtgcacgccgacatgggctactggatcgagtccgagaagaacgagacctggaagctggcccgggcgagcttcatcgaggtgaagacgtgcatctggcccaagtcccacaccctgtggagcaacggcgtcctcgagtccgagatgatcatccccaagatctacgggggcccgatcagccagcacaactaccgccccgggtacttcacccaggccgccggcccctggcacctggggaagctggagctcgacttcgacctgtgcgagggcaccacggtggtggtcgacgagcactgcggcaaccgggggccgtccctgcgcaccaccaccgtgacgggcaagatcatccacgagtggtgctgccggagctgcaccctgccgcccctccgcttccgcggggaggacggctgctggtacgggatggagatccgccccgtgaaggagaaggaggagaacctggtcaagtccatggtgagcgccggcagcggcgaggtggactccttcagcctcgggctgctgtgcatctccatcatgatcgaggaggtcatgcggagccgctggtcccggcgcatgctcatgaccggcaccctggccgtgttcttcctgctcatcatggggcagctgacgtggaacgacctgatccgcctctgcatcatggtgggcgcgaacgccagcgaccggatggggatgggcaccacctacctggccctgatggccaccttcaagatgcgcccgatgttcgccgtcggcctcctgttccggcgcctgacgtcccgggaggtgctcctgctgaccatcgggctcagcctggtggcgtccgtcgagctgcccaacagcctcgaggagctgggcgacgggctggccatgggcatcatgatcctcaagctgctgaccgacttccagtcccaccagctctgggccaccctgctgagcctcacgttcatcaagaccaccttctccctgcactacgcctggaagaccatggcgatggtgctgagcatcgtctccctcttccccctgtgcctgagcacgacctcccagaagaccacctggctccccgtgctgctgggcagcctcgggtgcaagccgctgacgatgttcctgatcgccgagaacaagatctggggccgccggtcctggcccctcaacgaggggatcatggccgtgggcatcgtcagcatcctgctgagctccctcctgaagaacgacgtgcccctggccgggcccctcatcgccggcggcatgctgatcgcgtgctacgtgatcagcgggtccagcgccgacctgtccctcgagaaggccgccgagatcagctgggaggaggaggccgagcactccggcgcgagccacaacatcctggtcgaggtgcaggacgacgggaccatgaagatcaaggacgaggagcgcgacgacaccctgaccatcctcctgaaggccaccctgctcgccgtgtccggcgtctacccgctgagcatccccgccacgctgttcgtgtggtacttctggcagaagaagaagcagcggtccggggtgctctgggacacccccagcccgcccgaggtcgagcgcgccgtgctggacgacggcatctaccggatcatgcagcgcggcctgctggggcggtcccaggtgggcgtcggggtgttccaggagaacgtgttccacaccatgtggcacgtcacccgcggcgcggtgctcatgtaccaggggaagcggctggagcccagctgggcctccgtgaagaaggacctgatcagctacggcggcgggtggcgcctccagggctcctggaacacgggggaggaggtccaggtgatcgccgtggagcccggcaagaaccccaagaacgtccagaccgcccccgggaccttcaagacccccgagggcgaggtgggcgccatcgcgctggacttcaagcccgggacgagcggctcccccatcgtgaaccgggaggggaagatcgtcggcctgtacggcaacggggtggtgaccaccagcggcacctacgtcagcgccatcgcccaggccaaggcgtcccaggaggggccgctccccgagatcgaggacgaggtgttccgcaagcggaacctgacgatcatggacctgcaccccggcagcgggaagacccgccggtacctcccggccatcgtgcgcgaggccatcaagcgcaagctgcggaccctgatcctcgcccccacccgcgtcgtggcctccgagatggcggaggccctgaagggcatgcccatccggtaccagacgaccgccgtcaagagcgagcacaccggcaaggagatcgtcgacctgatgtgccacgccaccttcacgatgcgcctcctgtcccccgcccgggtgccgaactacaacatgatcatcatggacgaggcgcacttcaccgaccccagctccatcgccgcccgcgggtacatcagcacccgggtgggcatgggggaggccgccgcgatcttcatgaccgccacgccgcccggctccgtcgaggccttcccgcagagcaacgccgtgatccaggacgaggagcgcgacatccccgagcggtcctggaacagcgggtacgagtggatcaccgacttccccggcaagaccgtgtggttcgtcccctccatcaagagcggcaacgacatcgcgaactgcctgcgcaagaacgggaagcgggtgatccagctctcccgcaagaccttcgacacggagtaccagaagaccaagaacaacgactgggactacgtggtcaccaccgacatcagcgagatgggcgccaacttccgggccgaccgcgtgatcgacccgcggcgctgcctgaagcccgtgatcctgaaggacgggcccgagcgggtcatcctcgccggccccatgccggtgacggtggcctccgcggcccagcgccgggggcgcatcggccgcaaccacaacaaggagggcgaccagtacatctacatggggcagcccctgaacaacgacgaggaccacgcccactggaccgaggccaagatgctgctcgacaacatcaacacccccgagggcatcatccccgccctgttcgagccggagcgggagaagtccgcggccatcgacggggagtaccgcctgcggggcgaggcccgcaagaccttcgtcgagctcatgcggcgcggggacctgcccgtgtggctgtcctacaaggtcgccagcgagggcttccagtacagcgaccggcgctggtgcttcgacggcgagcggaacaaccaggtgctcgaggagaacatggacgtggagatctggacgaaggagggggagcgcaagaagctgcggccccgctggctggacgcccggacctactccgaccccctcgcgctgcgcgagttcaaggagttcgccgccggccggcgcagcgtctccggggacctgatcctcgagatcggcaagctgccgcagcacctgacccagcgggcccagaacgcgctcgacaacctggtgatgctgcacaacagcgagcagggcgggcgcgcctaccggcacgccatggaggagctccccgacaccatcgagacgctgatgctgctcgccctgatcgccgtgctgaccggcggggtcaccctcttcttcctgtccggccgcgggctgggcaagaccagcatcggcctcctgtgcgtgatggcgtccagcgtgctgctctggatggcctccgtcgagccccactggatcgccgccagcatcatcctggagttcttcctgatggtgctcctgatccccgagccggaccggcagcgcacgccccaggacaaccagctggcctacgtggtcatcgggctcctgttcatgatcctgacggtggcggccaacgagatgggcctcctggagaccaccaagaaggacctggggatcggccacgtggccgtcgagaaccaccaccacgccgccatgctcgacgtggacctgcaccccgcgtccgcctggaccctgtacgccgtggccacgaccatcatcaccccgatgatgcgccacaccatcgagaacacgaccgccaacatcagcctcaccgcgatcgccaaccaggccgccatcctgatggggctggacaagggctggcccatctccaagatggacatcggcgtccccctcctggcgctggggtgctacagccaggtgaaccccctcaccctgacggccgccgtgctgatgctcgtcgcccactacgccatcatcggcccggggctgcaggcgaaggccacccgggaggcccagaagcgcaccgccgccggcatcatgaagaaccccaccgtggacgggatcgtggcgatcgacctggaccccgtcgtgtacgacgccaagttcgagaagcagctcggccagatcatgctgctgatcctctgcacgtcccagatcctgctgatgcggaccacctgggccctctgcgagagcatcaccctggccacgggccccctgaccaccctctgggaggggtccccgggcaagttctggaacaccacgatcgccgtgagcatggcgaacatcttccgcgggtcctacctggccggcgccggcctggccttcagcctcatgaagtccctcgggggcgggcggcgcgggaccggggcgcagggcgagaccctgggcgagaagtggaagcggcagctcaaccagctgtccaagagcgagttcaacacctacaagcgctccgggatcatggaggtcgaccggagcgaggccaaggagggcctgaagcgcggggagacgaccaagcacgccgtgtcccggggcaccgccaagctccgctggttcgtggagcggaacctggtcaagcccgaggggaaggtgatcgacctgggctgcggccgcgggggctggagctactactgcgccgggctgaagaaggtgaccgaggtcaagggctacacgaagggcggccccggccacgaggagcccatcccgatggcgacctacgggtggaacctcgtgaagctgcactccggcaaggacgtgttcttcatcccgcccgagaagtgcgacaccctgctctgcgacatcggggagagctcccccaacccgaccatcgaggagggccggacgctgcgcgtcctgaagatggtggagccctggctccgggggaaccagttctgcatcaagatcctgaacccctacatgcccagcgtggtcgagaccctggagcagatgcagcgcaagcacggcggcatgctcgtgcggaacccgctgtcccgcaacagcacccacgagatgtactgggtgtcctgcgggaccggcaacatcgtcagcgccgtgaacatgacctcccgcatgctgctcaaccggttcacgatggcccaccgcaagcccacctacgagcgggacgtggacctgggggccggcacccgccacgtcgccgtggagcccgaggtggcgaacctggacatcatcggccagcggatcgagaacatcaagcacgagcacaagagcacctggcactacgacgaggacaacccctacaagacgtgggcctaccacgggtcctacgaggtcaagccgagcggctccgccagcagcatggtgaacggggtggtcaagctcctgaccaagccctgggacgtgatccccatggtcacccagatcgccatgaccgacacgacccccttcggccagcagcgcgtgttcaaggagaaggtggacacccggaccccgaaggccaagcgcgggacggcgcagatcatggaggtcaccgccaagtggctgtggggcttcctctcccggaacaagaagccccgcatctgcacccgggaggagttcacccgcaaggtgcggagcaacgccgccatcggcgcggtgttcgtcgacgagaaccagtggaactccgccaaggaggccgtggaggacgagcgcttctgggacctggtgcaccgggagcgcgagctgcacaagcaggggaagtgcgccacgtgcgtctacaacatgatgggcaagcgggagaagaagctcggggagttcggcaaggccaaggggagccgcgcgatctggtacatgtggctgggcgcccggttcctggagttcgaggccctcggcttcatgaacgaggaccactggttctcccgcgagaacagcctgtccggggtggagggcgaggggctgcacaagctcggctacatcctgcgggacatcagcaagatccccgggggcaacatgtacgccgacgacaccgccggctgggacacccgcatcaccgaggacgacctgcagaacgaggcgcgcatcacggacatcatggagccggagcacgccctcctggccaagtccatcttcaagctgacctaccagaacaaggtggtccgggtgcagcgccccgccaagaacgggaccgtgatggacgtcatcagccggcgcgaccagcggggctccggccaggtggggacctacggcctcaacacgttcaccaacatggaggcccagctgatccgccagatggagagcgaggggatcttctcccccagcgagctggagacccccaacctcgcggagcgggtgctggactggctggagaagtacggcgtcgagcgcctcaagcggatggccatctccggggacgactgcgtggtgaagccgatcgacgaccgcttcgccaccgccctgacggccctgaacgacatgggcaaggtccggaaggacatcccccagtgggagcccagcaaggggtggaacgactggcagcaggtccccttctgctcccaccacttccaccagctcatcatgaaggacggccgcgagatcgtggtcccgtgccggaaccaggacgagctggtgggccgcgcgcgggtgagccagggggccggctggagcctgcgcgagaccgcctgcctcgggaagtcctacgcccagatgtggcagctgatgtacttccaccggcgcgacctgcggctcgcggccaacgccatctgcagcgccgtccccgtggactggatccccacctcccgcaccacgtggagcatccacgcccaccaccagtggatgaccaccgaggacatgctgtccgtgtggaaccgcgtctggatcgaggagaacccctggatggaggacaagacccacatcagctcctggggcgacgtgccgtacctggggaagcgggaggaccagtggtgcggcagcctcatcggcctgacggcgcgcgccacctgggccaccaacatccaggtggccatcaaccaggtccggcgcctgatcgggaacgagaactacctcgactacatgacctccatgaagcggttcaagaacgagagcgaccccgagggcgccctgtggtga

SEQ ID NO: 8395 - RNA, 9879 nt, synthetic construct
  misc_feature 1..9879: note = derived and/or modified CDS sequence (opt1) from DENV-1__FJ410226__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagaccagcgccggggtgaacatgtgcaccctcatcgccatggacctgggcgagttctgcgaggacaccatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtcgagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggaccagcggggcctccaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctcgtccagatcaagtacgagggcaccgacgccccctgcaagatccccttctccacccaggacgagaagggggtgacccagaacggccggctgatcacggccaacccgatcgtgaccgacaaggacaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacaccgcctgggacttcgggagcatcggcggcgtgttcacgtccgtcgggaagctggtgcaccagatcttcggcaccgcctacggggtgctgttcagcggcgtctcctggaccatgaagatcgggatcggcgtgctcctgacctggctgggcctcaacagccgctccacgagcctgtccatgacctgcatcgccgtggggctggtcaccctctacctgggcgtgatggtgcaggccgacagcgggtgcgtcgtgaactggaagggccgggagctgaagtgcgggagcggcatcttcgtgaccaacgaggtccacacgtggaccgagcagtacaagttccaggcggactccccgaagcgcctcagcgccgccatcggcaaggcctgggaggagggggtgtgcggcatccggtccgccacccgcctggagaacatcatgtggaagcagatcagcaacgagctgaaccacatcctcctggagaacgacatgaagttcaccgtggtcgtgggggacgtggcgggcatcctggcccaggggaagaagatgatccggccccagcccatggagtacaagtactcctggaagtcctggggcaaggccaagatcatcggcgccgacgtccagaacaccacgttcatcatcgacgggcccaacaccccggagtgccccgacgaccagcgcgcgtggaacatctgggaggtggaggactacggcttcgggatcttcaccaccaacatctggctcaagctgcgggactcctacacccaggtgtgcgaccaccgcctgatgagcgccgccatcaaggactccaaggccgtccacgccgacatgggctactggatcgagagcgagaagaacgagacctggaagctcgcgcgggcctccttcatcgaggtgaagacctgcatctggcccaagagccacaccctgtggtccaacggcgtgctggagagcgagatgatcatccccaagatctacgggggcccgatctcccagcacaactaccgccccgggtacttcacgcagaccgccggcccctggcacctcgggaagctggagctggacttcgacctctgcgagggcaccaccgtcgtggtggacgagcactgcggcaaccgggggccgagcctgcgcacgaccaccgtcaccggcaagatcatccacgagtggtgctgccggtcctgcacgctgccgcccctgcgcttcaagggggaggacggctgctggtacgggatggagatccggcccgtgaaggagaaggaggagaacctggtcaagagcatggtcagcgccggctccggcgaggtggacagcttctccctggggctcctgtgcatcagcatcatgatcgaggaggtgatgcgctcccggtggagccgcaagatgctgatgaccggcaccctcgccgtcttcttcctgctgatcatggggcagctcacctggaacgacctgatccggctgtgcatcatggtgggcgcgaacgcctccgaccgcatggggatgggcacgacctacctcgccctgatggccaccttcaagatgcgcccgatgttcgccgtgggcctcctgttccggcgcctgaccagccgggaggtcctgctcctgacgatcgggctgtccctcgtggcgagcgtcgagctgcccaactccctggaggagctcggcgacgggctggccatgggcatcatgatcctgaagctcctgaccgacttccagagccaccagctgtgggccaccctcctgtccctgaccttcatcaagacgaccttcagcctccactacgcctggaagaccatggcgatggtgctgtccatcgtgagcctgttccccctctgcatgtccaccacgagccagaagaccacctggctgcccgtcctgctcggctccctggggtgcaagccgctgaccatgttcctcatcgccgagaacaagatctggggccgcaagagctggcccctgaacgaggggatcatggccgtgggcatcgtgagcatcctgctctccagcctgctgaagaacgacgtccccctcgccgggcccctgatcgccggcggcatgctgatcgcgtgctacgtgatctccgggagctccgccgacctcagcctggagaaggccgccgaggtgtcctgggaggaggaggccgagcacagcggcgcgtcccacaacatcctggtcgaggtgcaggacgacgggacgatgaagatcaaggacgaggagcgggacgacaccctcaccatcctgctgaaggccaccctcctggccgtgagcggcgtctacccgctgtccatccccgccaccctcttcgtgtggtacttctggcagaagaagaagcagcgcagcggggtgctgtgggacacgcccagcccgcccgaggtcgagcgggccgtgctggacgacggcatctaccgcatcatgcagcggggcctcctggggcgcagccaggtgggcgtcggggtgttccaggagaacgtgttccacaccatgtggcacgtcacccggggcgcggtgctgatgtaccaggggaagcgcctggagccctcctgggccagcgtgaagaaggacctcatctcctacggcggcgggtggcggctgcagggcagctggaacaccggggaggaggtccaggtgatcgccgtggagcccggcaagaaccccaagaacgtccagacggcccccgggaccttcaagacctccgagggcgaggtgggcgccatcgcgctggacttcaagcccgggaccagcggcagccccatcgtgaaccgcgaggggaagatcgtcggcctctacggcaacggggtggtgacgacctccggcacctacgtcagcgccatcgcccaggccaaggcgtcccaggaggggcccctgccggagatcgaggacgaggtgttccggaagcgcaacctgaccatcatggacctccaccccggcagcgggaagacgcggcgctacctgcccgccatcgtgcgggaggccatcaagcgcaagctgcggaccctcatcctggccccgacccgcgtcgtggcctccgagatggcggaggccctgaagggcatgcccatccgctaccagaccacggccgtcaagagcgagcacaccggcaaggagatcgtcgacctcatgtgccacgccaccttcaccatgcggctgctgtcccccgtgcgcgtgcccaactacaacatgatcatcatggacgaggcccacttcacggacccgagctccatcgcggcccgggggtacatcagcacccgcgtcggcatgggggaggccgccgccatcttcatgaccgcgacgccgcccggctccgtggaggccttcccccagagcaacgccgtgatccaggacgaggagcgggacatcccggagcgctcctggaacagcgggtacgagtggatcacggacttccccggcaagaccgtctggttcgtgccctccatcaagagcggcaacgacatcgccaactgcctccggaagaacgggaagcgcgtgatccagctgtcccggaagaccttcgacaccgagtaccagaagacgaagaacaacgactgggactacgtcgtgaccaccgacatcagcgagatgggcgcgaacttccgcgccgaccgggtgatcgacccccgccggtgcctgaagccggtcatcctcaaggacgggcccgagcgcgtgatcctggccggccccatgcccgtcaccgtggcctccgccgcgcagcggcgcgggcggatcggccgcaaccacaacaaggagggcgaccagtacgtgtacatggggcagccgctgaacaacgacgaggaccacgcccactggacggaggccaagatgctcctggacaacatcaacacccccgagggcatcatccccgccctgttcgagcccgagcgggagaagtccgccgcgatcgacggggagtaccgcctccgcggcgaggcccggaagaccttcgtcgagctgatgcgccgcggggacctgccggtgtggctcagctacaaggtggcctccgagggcttccagtacagcgaccgccggtggtgcttcgacggcgagcgcaacaaccaggtcctggaggagaacatggacgtggagatctggaccaaggagggggagcggaagaagctgcgcccccggtggctcgacgcccgcacgtactccgaccccctggccctgcgggagttcaaggagttcgcggccggccgccggagcgtgtccggggacctcatcctggagatcggcaagctgccccagcacctcacccagcgcgcccagaacgccctggacaacctggtcatgctccacaacagcgagcagggcgggcgggcgtaccgccacgccatggaggagctgccggacaccatcgagaccctgatgctcctggccctgatcgccgtgctcacgggcggggtgaccctgttcttcctgtccggccgggggctcggcaagaccagcatcggcctgctgtgcgtcatggcctccagcgtgctcctgtggatggcgtccgtggagccccactggatcgccgccagcatcatcctggagttcttcctcatggtcctgctgatccccgagcccgaccgccagcggaccccgcaggacaaccagctcgcctacgtggtgatcgggctgctgttcatgatcctcaccgtcgccgcgaacgagatgggcctgctggagacgaccaagaaggacctcgggatcggccacgtggccgtggagaaccaccaccacgccgccatgctggacgtcgacctgcaccccgcctccgcgtggaccctctacgccgtggccaccacgatcatcacccccatgatgcgccacaccatcgagaacaccacggccaacatcagcctgaccgccatcgcgaaccaggccgccatcctgatggggctcgacaagggctggccgatctccaagatggacatcggcgtgcccctgctggccctcgggtgctacagccaggtcaaccccctgaccctgaccgcggccgtgctcatgctggtggcccactacgccatcatcggccccgggctgcaggccaaggcgacgcgggaggcccagaagcgcaccgccgccggcatcatgaagaacccgaccgtcgacgggatcgtggccatcgacctcgaccccgtggtctacgacgcgaagttcgagaagcagctgggccagatcatgctgctcatcctgtgcacctcccagatcctgctcatgcgcacgacctgggccctgtgcgagagcatcaccctggccaccggccccctcacgaccctgtgggaggggtcccccggcaagttctggaacaccaccatcgccgtgagcatggccaacatcttccgggggagctacctggcgggcgccggcctcgccttctccctgatgaagtccctcgggggcgggcgccgggggacgggggcccagggcgagaccctcggcgagaagtggaagcgccagctgaaccagctgtccaagagcgagttcaacacctacaagcggtccgggatcatggaggtggaccgcagcgaggcgaaggagggcctcaagcgcggggagaccacgaagcacgccgtctcccgcggcaccgccaagctgcggtggttcgtggagcgcaacctggtgaagccggaggggaaggtcatcgacctcggctgcggccgcggcgggtggagctactactgcgccgggctgaagaaggtgaccgaggtgaaggggtacaccaagggcggccccggccacgaggagcccatccccatggccacgtacgggtggaacctggtcaagctgcactccggcaaggacgtgttcttcatcccgcccgagaagtgcgacaccctcctgtgcgacatcggggagagctcccccaaccccaccatcgaggagggccgcaccctgcgggtgctcaagatggtcgagccgtggctgcgcgggaaccagttctgcatcaagatcctgaacccctacatgcccagcgtggtggagacgctcgagcagatgcagcggaagcacggcggcatgctggtccgcaaccccctgtcccggaacagcacccacgagatgtactgggtgtcctgcgggaccggcaacatcgtgagcgcggtcaacatgacctcccgcatgctcctgaaccggttcaccatggcccaccgcaagccgacgtacgagcgcgacgtggacctgggggccggcacccggcacgtggccgtcgagcccgaggtggccaacctcgacatcatcggccagcgcatcgagaacatcaagcacgagcacaagagcacctggcactacgacgaggacaacccctacaagacctgggcgtaccacgggtcctacgaggtcaagcccagcggcagcgcctccagcatggtgaacggggtggtcaagctgctgacgaagccgtgggacgtgatccccatggtgacccagatcgccatgaccgacaccacgcccttcggccagcagcgggtcttcaaggagaaggtggacacccgcacccccaaggccaagcgggggaccgcccagatcatggaggtgacggcgaagtggctctggggcttcctgtcccgcaacaagaagccgcggatctgcacccgcgaggagttcacccggaaggtccgcagcaacgccgccatcggcgccgtgttcgtggacgagaaccagtggaactccgcgaaggaggccgtcgaggacgagcggttctgggacctggtgcaccgcgagcgggagctccacaagcaggggaagtgcgcgacctgcgtgtacaacatgatgggcaagcgcgagaagaagctgggggagttcggcaaggccaaggggagccgggccatctggtacatgtggctgggcgcgcgcttcctcgagttcgaggccctgggcttcatgaacgaggaccactggttctcccgggagaacagcctgtccggggtcgagggcgaggggctccacaagctgggctacatcctgcgcgacatcagcaagatccccgggggcaacatgtacgccgacgacacggccggctgggacacccggatcaccgaggacgacctccagaacgaggccaagatcaccgacatcatggagcccgagcacgcgctgctggccaagtccatcttcaagctcacgtaccagaacaaggtggtgcgcgtccagcggccggccaagaacgggaccgtgatggacgtgatcagccgccgcgaccagcggggctccgggcaggtcggcacctacggcctgaacaccttcacgaacatggaggcccagctgatccgccagatggagagcgaggggatcttctcccccagcgagctcgagacccccaacctggccggccgggtgctggactggctcgagaagcacggggtggagcgcctgaagcggatggcgatctccggcgacgactgcgtcgtgaagcccatcgacgaccgcttcgccaccgccctgaccgccctcaacgacatggggaaggtgcggaaggacatcccgcagtgggagcccagcaagggctggaacgactggcagcaggtccccttctgcagccaccacttccaccagctgatcatgaaggacggccgcgagatcgtggtgccctgccggaaccaggacgagctggtcgggcgcgcccgggtgtcccagggcgcggggtggagcctccgcgagacggcctgcctgggcaagtcctacgcccagatgtggcagctgatgtacttccaccggcgcgacctccggctggccgcgaacgccatctgcagcgccgtgccggtcgactgggtgcccacctcccgcaccacctggagcatccacgcccaccaccagtggatgacgaccgaggacatgctgtccgtgtggaaccgggtctggatcgaggagaacccctggatggaggacaagacccacatcagctcctggggcgacgtgccctacctcggcaagcgcgaggaccagtggtgcggcagcctgatcgggctgaccgcccgggcgacgtgggccaccaacatccaggtggccatcaaccaggtccgccgcctcatcggcaacgagaactacctggactacatgacctccatgaagcggttcaagaacgagagcgacccggagggggccctgtggtga

SEQ ID NO: 8396 - RNA, 9879 nt, synthetic construct
  misc_feature 1..9879: note = derived and/or modified CDS sequence (opt1) from DENV-1__FJ410227__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgcgggggtgaacatgtgcaccctcatcgccatggacctgggcgagttctgcgaggacacgatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtcgagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggaccagcggggcctccaccagccaggagacctggaaccggaaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctcgtccagatcaagtacgagggcaccgacgccccctgcaagatccccttctccacccaggacgagaagggggtgacccagaacggccggctgatcacggccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacaccgcctgggacttcgggagcatcggcggcgtgttcacgtccgtcgggaagctggtgcaccagatcttcggcaccgcctacggggtgctgttcagcggcgtctcctggaccatgaagatcgggatcggcgtgctcctgacctggctgggcctcaacagccgctccacgagcctgtccatgacctgcatcgccgtggggctggtcaccctctacctgggcgtgatggtgcaggccgacagcgggtgcgtcatcaactggaagggccgggagctgaagtgcgggagcggcatcttcgtgaccaacgaggtgcacacgtggaccgagcagtacaagttccaggcggactccccgaagcgcctcagcgccgccatcggcaaggcctgggaggagggggtctgcggcatccggtccaccacccgcctggagaacatcatgtggaagcagatcagcaacgagctgaaccacatcctcctggagaacgacatgaagttcaccgtggtggtcggggacgtggccggcatcctggcgcaggggaagaagatgatccggccccagcccatggagtacaagtactcctggaagtcctggggcaaggccaagatcatcggcgccgacgtgcagaacacgaccttcatcatcgacgggcccaacaccccggagtgccccgacgaccagcgcgcctggaacatctgggaggtcgaggactacggcttcgggatcttcaccacgaacatctggctcaagctgcgggactcctacacccaggtgtgcgaccaccgcctgatgagcgcggccatcaaggactccaaggccgtgcacgccgacatgggctactggatcgagagcgagaagaacgagacctggaagctcgcccgggcgtccttcatcgaggtcaagacctgcatctggcccaagagccacacgctgtggtccaacggcgtgctggagagcgagatgatcatccccaagatctacgggggcccgatctcccagcacaactaccgccccgggtacttcacccagaccgccggcccctggcacctcgggaagctggagctggacttcgacctctgcgagggcaccacggtggtcgtggacgagcactgcggcaaccgggggccgagcctgcgcaccaccaccgtgacgggcaagatcatccacgagtggtgctgccggtcctgcaccctgccgcccctgcgcttcaagggggaggacggctgctggtacgggatggagatccggcccgtcaaggagaaggaggagaacctggtcaagagcatggtgagcgccggctccggcgaggtcgacagcttctccctggggctcctgtgcatcagcatcatgatcgaggaggtgatgcgctcccggtggagccgcaagatgctgatgaccggcaccctcgccgtgttcttcctgctgatcatggggcagctcacgtggaacgacctgatccggctgtgcatcatggtcggcgccaacgcgtccgaccgcatggggatgggcaccacctacctcgccctgatggccaccttcaagatgcgcccgatgttcgccgtgggcctcctgttccggcgcctgacgagccgggaggtgctgctcctgaccatcgggctgtccctcgtcgccagcgtggagctgcccaactccctggaggagctcggcgacgggctggcgatgggcatcatgatcctgaagctcctgaccgacttccagagccaccagctgtgggccaccctcctgtccctgacgttcatcaagaccaccttcagcctccactacgcctggaagaccatggccatggtcctgtccatcgtgagcctgttccccctctgcctgtccacgaccagccagaagaccacctggctgcccgtgctcctgggctccctggggtgcaagccgctcacgatgttcctgatcgcggagaacaagatctggggccgcaagagctggcccctgaacgaggggatcatggccgtcggcatcgtgagcatcctcctgtccagcctgctcaagaacgacgtgcccctggccgggcccctgatcgccggcggcatgctcatcgcctgctacgtcatctccgggagctccgcggacctgagcctggagaaggccgccgaggtgtcctgggaggaggaggccgagcacagcggcgcctcccacaacatcctcgtggaggtccaggacgacgggaccatgaagatcaaggacgaggagcgggacgacaccctgaccatcctgctcaaggcgaccctgctggccgtgagcggcgtgtacccgctctccatccccgccacgctgttcgtctggtacttctggcagaagaagaagcagcgcagcggggtgctgtgggacacccccagcccgcccgaggtggagcgggccgtcctcgacgacggcatctaccgcatcatgcagcggggcctgctggggcgcagccaggtgggcgtgggggtcttccaggagaacgtgttccacaccatgtggcacgtgacccggggcgccgtcctgatgtaccaggggaagcgcctcgagccctcctgggcgagcgtgaagaaggacctgatctcctacggcggcgggtggcggctgcagggcagctggaacacgggggaggaggtgcaggtcatcgccgtggagcccggcaagaaccccaagaacgtgcagaccgcccccgggaccttcaagacctccgagggcgaggtcggcgccatcgccctcgacttcaagcccgggacgagcggcagccccatcgtgaaccgcgaggggaagatcgtgggcctgtacggcaacggggtcgtgaccacctccggcacctacgtgagcgcgatcgcccaggccaaggcctcccaggaggggcccctgccggagatcgaggacgaggtcttccggaagcgcaacctcacgatcatggacctgcaccccggcagcgggaagacccggcgctacctgcccgcgatcgtgcgggaggccatcaagcgcaagctccggaccctgatcctggccccgacccgcgtggtcgcctccgagatggccgaggcgctcaagggcatgcccatccgctaccagacgaccgccgtcaagagcgagcacaccggcaaggagatcgtggacctgatgtgccacgccaccttcacgatgcggctgctctcccccgtccgcgtgcccaactacaacatgatcatcatggacgaggcccacttcaccgacccgagctccatcgccgcgcgggggtacatcagcacccgcgtgggcatgggggaggccgccgccatcttcatgaccgccacgccgcccggctccgtcgaggcgttcccccagagcaacgccgtgatccaggacgaggagcgggacatcccggagcgctcctggaacagcgggtacgagtggatcaccgacttccccggcaagaccgtgtggttcgtcccctccatcaagagcggcaacgacatcgccaactgcctgcggaagaacgggaagcgcgtgatccagctgtcccggaagaccttcgacacggagtaccagaagaccaagaacaacgactgggactacgtggtcaccaccgacatcagcgagatgggcgccaacttccgcgcggaccgggtgatcgacccccgccggtgcctcaagccggtgatcctgaaggacgggcccgagcgcgtcatcctggccggccccatgcccgtgacggtcgcctccgccgcccagcggcgcgggcggatcggccgcaaccacaacaaggagggcgaccagtacatctacatggggcagccgctcaacaacgacgaggaccacgcgcactggaccgaggccaagatgctgctggacaacatcaacacccccgagggcatcatccccgccctcttcgagcccgagcgggagaagtccgccgccatcgacggggagtaccgcctgcgcggcgaggcgcggaagaccttcgtggagctgatgcgccgcggggacctcccggtgtggctgagctacaaggtcgcctccgagggcttccagtacagcgaccgccggtggtgcttcgacggcgagcgcaacaaccaggtgctggaggagaacatggacgtggagatctggacgaaggagggggagcggaagaagctccgcccccggtggctggacgcccgcacctactccgaccccctggccctccgggagttcaaggagttcgccgcgggccgccggagcgtctccggggacctgatcctggagatcggcaagctcccccagcacctgacccagcgcgcccagaacgccctggacaacctcgtgatgctgcacaacagcgagcagggcgggcgggcctaccgccacgcgatggaggagctgccggacaccatcgagacgctcatgctgctggccctcatcgccgtgctgaccggcggggtcaccctgttcttcctctccggccgggggctgggcaagaccagcatcggcctgctctgcgtgatggcctccagcgtgctgctgtggatggcctccgtcgagccccactggatcgcggccagcatcatcctcgagttcttcctgatggtgctgctcatccccgagcccgaccgccagcggaccccgcaggacaaccagctggcctacgtggtcatcgggctcctcttcatgatcctgacggtggccgccaacgagatgggcctgctcgagaccaccaagaaggacctggggatcggccacgtggcggccgagaaccaccaccacgccgccatgctggacgtcgacctccaccccgcctccgcgtggaccctgtacgccgtggccacgaccatcatcacccccatgatgcgccacaccatcgagaacacgaccgccaacatcagcctgaccgccatcgcgaaccaggccgccatcctcatggggctggacaagggctggccgatctccaagatggacatcggcgtgcccctgctcgccctggggtgctacagccaggtcaaccccctgaccctcacggcggccgtgctgatgctggtggcccactacgccatcatcggccccgggctccaggccaaggcgacccgggaggcccagaagcgcaccgccgccggcatcatgaagaacccgaccgtcgacgggatcgtggccatcgacctggaccccgtggtctacgacgcgaagttcgagaagcagctgggccagatcatgctcctgatcctgtgcacgtcccagatcctcctgatgcgcaccacctgggccctgtgcgagagcatcaccctcgccacgggccccctgaccaccctgtgggaggggtcccccggcaagttctggaacaccacgatcgccgtgagcatggccaacatcttccgggggagctacctcgcgggcgccggcctggccttctccctgatgaagtccctcgggggcgggcgccggggcaccggggcccagggcgagaccctgggcgagaagtggaagcgccagctgaaccagctctccaagagcgagttcaacacctacaagcggtccgggatcatggaggtggaccgcagcgaggcgaaggagggcctgaagcgcggggagacgaccaagcacgccgtctcccgcggcaccgccaagctgcggtggttcgtggagcgcaacctcgtgaagccggaggggaaggtcatcgacctgggctgcggccgcggcgggtggagctactactgcgccgggctgaagaaggtgaccgaggtgaaggggtacacgaagggcgggcccggccacgaggagcccatccccatggccacctacgggtggaacctggtcaagctccactccggcaaggacgtgttcttcatcccgcccgagaagtgcgacaccctgctgtgcgacatcggggagagctcccccaaccccaccatcgaggagggccgcacgctccgggtgctgaagatggtcgagccgtggctgcgcgggaaccagttctgcatcaagatcctcaacccctacatgcccagcgtggtggagaccctggagcagatgcagcggaagcacggcggcatgctggtccgcaaccccctctcccggaacagcacccacgagatgtactgggtgtcctgcgggaccggcaacatcgtgagcgcggtcaacatgacctcccgcatgctgctgaaccggttcacgatggcccaccgcaagccgacctacgagcgcgacgtggacctcggggccggcacccggcacgtggccgtcgagcccgaggtggccaacctggacatcatcggccagcgcatcgagaacatcaagcacgagcacaagagcacctggcactacgacgaggacaacccctacaagacgtgggcgtaccacgggtcctacgaggtgaagcccagcggcagcgcctccagcatggtcaacggggtggtcaagctgctcaccaagccgtgggacgtgatccccatggtgacccagatcgccatgaccgacacgacccccttcggccagcagcgggtcttcaaggagaaggtggacacccgcacccccaaggccaagcgggggacggcccagatcatggaggtgaccgcgaagtggctgtggggcttcctgtcccgcaacaagaagccgcggatctgcacccgcgaggagttcacccggaaggtccgcagcaacgccgccatcggcgccgtgttcgtggacgagaaccagtggaactccgcgaaggaggccgtcgaggacgagcggttctgggacctcgtgcaccgcgagcgggagctgcacaagcaggggaagtgcgccacgtgcgtgtacaacatgatgggcaagcgcgagaagaagctgggggagttcggcaaggccaaggggagccgggccatctggtacatgtggctcggcgcgcgcttcctggagttcgaggccctgggcttcatgaacgaggaccactggttctcccgggagaacagcctctccggggtcgagggcgaggggctgcacaagctgggctacatcctccgcgacatcagcaagatccccgggggcaacatgtacgccgacgacaccgccggctgggacacccggatcaccgaggacgacctgcagaacgaggccaagatcacggacatcatggagcccgagcacgcgctgctcgccaagtccatcttcaagctgacctaccagaacaaggtggtgcgcgtccagcggccggccaagaacgggaccgtgatggacgtgatcagccgccgcgaccagcggggctccgggcaggtcggcacctacggcctgaacacgttcaccaacatggaggcccagctcatccgccagatggagagcgaggggatcttctcccccagcgagctggagacccccaacctggccggccgggtgctcgactggctggagaagcacggggtggagcgcctgaagcggatggcgatctccggcgacgactgcgtcgtgaagcccatcgacgaccgcttcgccaccgccctcacggccctgaacgacatggggaaggtgcggaaggacatcccgcagtgggagcccagcaagggctggaacgactggcagcaggtccccttctgcagccaccacttccaccagctgatcatgaaggacggccgcgagatcgtggtgccctgccggaaccaggacgagctcgtcgggcgcgcccgggtgtcccagggcgcggggtggagcctgcgcgagaccgcctgcctgggcaagtcctacgcccagatgtggcagctcatgtacttccaccggcgcgacctgcggctggccgcgaacgccatctgcagcgccgtgccggtcgactgggtgcccacctcccgcaccacgtggagcatccacgcccaccaccagtggatgaccaccgaggacatgctctccgtgtggaaccgggtctggatcgaggagaacccctggatggaggacaagacccacatcagctcctggggcgacgtgccctacctgggcaagcgcgaggaccagtggtgcggcagcctgatcgggctcacggcccgggcgacctgggccaccaacatccaggtggccatcaaccaggtccgccgcctgatcggcaacgagaactacctggactacatgacctccatgaagcggttcaagaacgagagcgacccggagggggccctctggtga

SEQ ID NO: 8397 - RNA, 9879 nt, synthetic construct
  misc_feature 1..9879: note = derived and/or modified CDS sequence (opt1) from DENV-1__FJ859029__SS-prME
  source 1..9879: mol_type = other RNA
agcgtgaccatgctgctcatgctgatgcccaccgccctggccttccacctcacgacccggggcggggagccccacatgatcgtgtccaagcaggagcggggcaagagcctgctgttcaagacctccgccggggtgaacatgtgcaccctcatcgccatggacctgggcgagttctgcgaggacaccatgacctacaagtgcccccggatcaccgaggccgagcccgacgacgtggactgctggtgcaacgccaccgacacgtgggtcacctacgggacctgcagccagaccggcgagcaccggcgcgacaagcggtccgtggccctggcgccccacgtgggcctcgggctggagacgcgcaccgagacctggatgagctccgagggcgcctggaagcagatccagaaggtcgagacctgggccctgcggcaccccgggttcacggtgatcgccctcttcctggcgcacgccatcggcaccagcatcacccagaaggggatcatcttcatcctgctcatgctggtgaccccctccatggccatgcgctgcgtcggcatcggcagccgggacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcgcaagctgtgcatcgaggccaagatctccaacaccaccacggacagccggtgcccgacccagggcgaggccaccctcgtggaggagcaggacgccaacttcgtctgccgccggaccttcgtggaccgcggctgggggaacggctgcgggctgttcggcaaggggtccctgatcacgtgcgccaagttcaagtgcgtgaccaagctcgagggcaagaccgtccagcacgagaacctgaagtacagcgtgatcgtgaccgtccacacgggcgaccagcaccaggtggggaacgagtccaccgagcacggcaccaccgcgaccatcacgccccaggcccccagcaccgagatccagctgaccgactacggggccctcaccctggactgcagcccccggacgggcctggacttcaacgagatggtcctcctgaccatgaaggagaagtcctggctggtgcacaagcagtggttcctcgacctgccgctgccctggaccagcggggcctccaccagccaggagacgtggaaccgcaaggacctcctggtgaccttcaagaccgcccacgcgaagaagcaggaggtcgtggtgctgggctcccaggagggcgccatgcacaccgccctcacgggggccaccgagatccagaccagcggcaccacgaccatcttcgccgggcacctgaagtgccggctgaagatggacaagctcaccctgaagggcacctcctacgtcatgtgcacggggagcttcaagctggagaaggaggtggcggagacccagcacggcaccgtgctcgtccagatcaagtacgagggcaccgacgccccctgcaagatccccttctccacgcaggacgagaagggggtgacccagaacggccgcctgatcaccgccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccacggcccgcggggcccgccggatggcgatcctcggcgacaccgcctgggacttcgggagcatcggcggcgtgttcacctccgtcgggaagctggtgcaccagatcttcggcaccgcctacggggtgctgttcagcggcgtctcctggacgatgaagatcgggatcggcgtgctcctgacctggctgggcctcaacagccgctccaccagcctgtccatgacctgcatcgccgtggggctggtcacgctctacctgggcgtgatggtgcaggccgacagcgggtgcgtcatcaactggaagggccgcgagctgaagtgcgggagcggcatcttcgtgaccaacgaggtgcacacctggaccgagcagtacaagttccaggcggactccccgaagcggctcagcgccgccatcggcaaggcctgggaggagggggtctgcggcatccgctccgccacccggctggagaacatcatgtggaagcagatcagcaacgagctgaaccacatcctcctggagaacgacatgaagttcacggtggtggtcggggacgtggcgggcatcctggcccaggggaagaagatgatccgcccccagcccatggagtacaagtactcctggaagtcctggggcaaggccaagatcatcggcgccgacgtgcagaacaccaccttcatcatcgacgggcccaacaccccggagtgccccgacgaccagcgggcgtggaacatctgggaggtcgaggactacggcttcgggatcttcacgaccaacatctggctcaagctgcgcgactcctacacccaggtgtgcgaccaccggctgatgagcgccgccatcaaggactccaaggccgtgcacgccgacatgggctactggatcgagagcgagaagaacgagacctggaagctcgcgcgcgcctccttcatcgaggtcaagacgtgcatctggcccaagagccacaccctgtggtccaacggcgtgctggagagcgagatgatcatccccaagatctacgggggcccgatctcccagcacaactaccggcccgggtacttcacccagaccgccggcccctggcacctcgggaagctggagctggacttcgacctctgcgagggcacgaccgtggtcgtggacgagcactgcggcaaccgcgggccgagcctgcggaccaccacggtgaccggcaagatcatccacgagtggtgctgccgctcctgcaccctgccgcccctccggttcaagggggaggacggctgctggtacgggatggagatccgccccgtcaaggagaaggaggagaacctggtcaagagcatggtgagcgccggctccggcgaggtcgacagcttctccctggggctcctgtgcatcagcatcatgatcgaggaggtgatgcggtcccgctggagccggaagatgctgatgaccggcacgctcgccgtgttcctgctgctcatcatggggcagctgacctggaacgacctgatccgcctctgcatcatggtcggcgcgaacgcctccgaccggatggggatgggcaccacctacctggccctgatggccacgttcaagatgcgcccgatgttcgccgtggggctcctgttccgccggctgaccagccgcgaggtgctcctgctgaccatcgggctctccctggtcgcgagcgtggagctgcccaactccctcgaggagctgggcgacgggctggccatgggcatcatgatcctcaagctgctgaccgacttccagagccaccagctctgggccacgctgctgtccctcaccttcatcaagaccaccttcagcctgcactacgcctggaagacgatggcgatggtcctgtccatcgtgagcctcttccccctgtgcctgtccaccaccagccagaagaccacgtggctccccgtgctgctgggctccctcgggtgcaagccgctgaccatgttcctgatcgccgagaacaagatctggggccgcaagagctggcccctcaacgaggggatcatggccgtcggcatcgtgagcatcctgctgtccagcctcctgaagaacgacgtgcccctggccgggcccctcatcgccggcggcatgctgatcgcgtgctacgtcatctccgggagctccgccgacctgagcctcgagaaggccgccgaggtgtcctgggaggaggaggccgagcacagcggcgcgtcccacaacatcctggtggaggtccaggacgacgggaccatgaagatcaaggacgaggagcgcgacgacaccctgaccatcctcctgaaggccacgctgctcgccgtgagcggcgtgtacccgctgtccatccccgccaccctgttcgtctggtacttctggcagaagaagaagcagcggagcggggtgctctgggacacccccagcccgcccgaggtggagcgcgccgtcctggacgacggcatctaccggatcatgcagcgcggcctgctggggcggagccaggtgggcgtgggggtcttccaggagaacgtgttccacaccatgtggcacgtgacgcgcggcgcggtcctcatgtaccaggggaagcggctggagccctcctgggccagcgtgaagaaggacctgatctcctacggcggcgggtggcgcctccagggcagctggaacaccggggaggaggtgcaggtcatcgccgtggagcccggcaagaaccccaagaacgtgcagaccgcccccgggaccttcaagacgtccgagggcgaggtcggcgccatcgcgctggacttcaagcccgggaccagcggcagccccatcgtgaaccgggaggggaagatcgtgggcctgtacggcaacggggtcgtgaccacctccggcacgtacgtgagcgccatcgcccaggccaaggcgtcccaggaggggcccctcccggagatcgaggacgaggtcttccgcaagcggaacctgaccatcatggacctgcaccccggcagcgggaagacccgccggtacctccccgccatcgtgcgcgaggccatcaagcggaagctgcgcaccctgatcctcgccccgacgcgggtggtcgcctccgagatggcggaggccctgaagggcatgcccatccgctaccagaccaccgccgtgaagggcgagcacaccgggaaggagatcgtggacctgatgtgccacgccacgttcaccatgcgcctcctgagccccgtccgggtgcccaactacaacatgatcatcatggacgaggcccacttcaccgacccgtccagcatcgcggcccgcggctacatctccacccgggtggggatgggcgaggccgccgccatcttcatgacggcgacgccgcccgggagcgtcgaggccttcccccagtccaacgccgtgatccaggacgaggagcgcgacatcccggagcggagctggaactccggctacgagtggatcaccgacttccccggcaagaccgtgtggttcgtccccagcatcaagtccgggaacgacatcgccaactgcctgcgcaagaacggcaagcgggtgatccagctcagccgcaagacgttcgacaccgagtaccagaagaccaagaacaacgactgggactacgtggtcaccacggacatctccgagatgggggcgaacttccgggccgaccgcgtgatcgacccccggcgctgcctgaagccggtgatcctgaaggacggccccgagcgggtcatcctcgccgggcccatgcccgtgaccgtcgccagcgccgcgcagcgccggggccgcatcggccggaaccacaacaaggagggggaccagtacatctacatgggccagccgctgaacaacgacgaggaccacgcccactggaccgaggccaagatgctgctcgacaacatcaacacccccgaggggatcatccccgccctgttcgagcccgagcgcgagaagtccgccgcgatcgacggcgagtaccggctgcgcggggaggcccgcaagacgttcgtggagctcatgcggcgcggcgacctgccggtgtggctgagctacaaggtcgccagcgagggcttccagtactccgaccggcgctggtgcttcgacggggagcggaacaaccaggtgctcgaggagaacatggacgtggagatctggaccaaggagggcgagcgcaagaagctgcggccccgctggctggacgcccggacctacagcgaccccctcgccctgcgcgagttcaaggagttcgcggccgggcggcgctccgtcagcggcgacctgatcctcgagatcggcaagctgccccagcacctgacccagcgggcccagaacgccctcgacaacctggtgatgctgcacaactccgagcagggcgggcgcgcgtaccggcacgccatggaggagctcccggacacgatcgagaccctgatgctgctcgccctgatcgccgtgctgaccgggggcgtcaccctcttcttcctgagcgggcgcggcctgggcaagacctccatcgggctcctgtgcgtgatggccagctccgcgctgctctggatggccagcgtggagccccactggatcgccgcctccatcatcctggagttcttcctgatggtcctcctgatccccgagcccgaccggcagcgcacgccgcaggacaaccagctggcctacgtggtgatcggcctcctgttcatgatcctgaccgtcgcggccaacgagatggggctcctggagaccaccaagaaggacctgggcatcgggcacgtggccgtggagaaccaccaccacgccgccatgctcgacgtcgacctgcaccccgcgagcgcctggacgctgtacgccgtggccaccaccatcatcacccccatgatgcggcacacgatcgagaacaccaccgccaacatctccctcaccgcgatcgccaaccaggccgccatcctgatgggcctggacaagggctggccgatcagcaagatggacatcggggtgcccctcctggcgctgggctgctactcccaggtcaaccccctcacgctgaccgccgccgtgctgatgctcgtggcccactacgccatcatcgggcccggcctgcaggcgaaggccacccgcgaggcccagaagcggaccgccgccgggatcatgaagaacccgacggtcgacggcatcgtggcgatcgacctggaccccgtggtctacgacgccaagttcgagaagcagctcggccagatcatgctgctggtgctctgcaccagccagatcctgctgatgcgcaccacctgggccctctgcgagtccatcacgctggccaccgggcccctgaccaccctctgggagggcagccccgggaagttctggaacacgaccatcgccgtgtccatggcgaacatcttccgcggcagctacctggccggcgccgggctggccttcagcctcatgaagtccctgggcgggggccggcgcgggaccggcgcgcagggcgagaccctgggggagaagtggaagcggcagctcaaccagctgagcaagtccgagttcaacacgtacaagcgcagcggcatcatggaggtcgaccggtccgaggccaaggaggggctgaagcgcggcgagaccaccaagcacgccgtgagccgggggaccgccaagctccgctggttcgtggagcggaacctggtcaagccggagggcaaggtgatcgacctgggctgcgggcgcggcgggtggtcctactactgcgccggcctgaagaaggtgacggaggtcaaggggtacaccaagggcggccccgggcacgaggagcccatccccatggcgacctacggctggaacctcgtgaagctgcacagcgggaaggacgtgttcttcatcccgcccgagaagtgcgacaccctgctctgcgacatcggcgagtccagccccaaccccacgatcgaggaggggcggaccctgcgcgtcctgaagatggtggagccgtggctccggggcaaccagttctgcatcaagatcctgaacccctacatgccctccgtggtcgagaccctggagcagatgcagcgcaagcacggcgggatgctcgtgcggaaccccctgagccgcaactccacccacgagatgtactgggtgagctgcggcaccgggaacatcgtctccgccgtgaacatgacgagccggatgctgctcaaccgcttcaccatggcccaccggaagccgacctacgagcgcgacgtggacctgggcgccggcacccgccacgtcgccgtggagcccgaggtggcgaacctggacatcatcgggcagcggatcgagaacatcaagcacgagcacaagtccacgtggcactacgacgaggacaacccctacaagacctgggcctaccacggcagctacgaggccaagccctccgggagcgccagctccatggtcaacggcgtggtcaagctcctgaccaagccgtgggacgtgatccccatggtgacccagatcgccatgacggacaccacccccttcgggcagcagcgcgtcttcaaggagaaggtggacacccggacgcccaaggcgaagcgcggcaccgcccagatcatggaggtgaccgccaagtggctgtggggcttcctcagccggaacaagaagccgcgcatctgcacccgggaggagttcacgcgcaaggtccggtccaacgccgcgatcggggccgtgttcgtggacgagaaccagtggaacagcgccaaggaggccgtcgaggacgagcgcttctgggacctggtgcaccgggagcgcgagctgcacaagcagggcaagtgcgcgacctgcgtgtacaacatgatggggaagcgggagaagaagctcggcgagttcgggaaggcgaagggctcccgcgccatctggtacatgtggctgggcgcccggttcctggagttcgaggccctcgggttcatgaacgaggaccactggttcagccgcgagaactccctgagcggcgtcgagggggagggcctgcacaagctcgggtacatcctgcgggacatctccaagatccccggcggcaacatgtacgccgacgacaccgcggggtgggacacccgcatcacggaggacgacctgcagaacgaggccaagatcaccgacatcatggagcccgagcacgccctcctggccaagagcatcttcaagctgacctaccagaacaaggtggtgcgggtccagcgcccggccaagaacggcaccgtgatggacgtgatctcccggcgcgaccagcgcgggagcggccaggtcggcacgtacgggctcaacaccttcaccaacatggaggcgcagctgatccggcagatggagtccgaggagatcttcagcccctccgagctggagacccccaacctcgccggccgcgtgctggactggctggagaagcacggggtggagcggctcaagcgcatggccatcagcggcgacgactgcgtcgtgaagcccatcgacgaccggttcgccacggccctgaccgcgctgaacgacatggggaaggtgcgcaaggacatcccgcagtgggagccctccaagggctggaacgactggcagcaggtccccttctgcagccaccacttccaccagctcatcatgaaggacggccgggagatcgtggtgccctgccgcaaccaggacgagctggtcgggcgggcccgcgtgagccagggcgccgggtggtccctgcgggagaccgcctgcctcggcaagagctacgcgcagatgtggcagctgatgtacttccaccgccgggacctgcgcctcgccgccaacgccatctgctccgccgtgccggtcgactgggtgcccaccagccggacgacctggtccatccacgcgcaccaccagtggatgaccaccgaggacatgctgagcgtgtggaaccgcgtctggatcgaggagaacccctggatggaggacaagacgcacatctccagctggggcgacgtgccctacctgggcaagcgggaggaccagtggtgcggctccctcatcgggctgaccgcccgcgccacctgggccaccaacatccaggtggccatcaaccaggtccggcgcctgatcggcaacgagaactacctcgactacatgaccagcatgaagcgcttcaagaacgagtccgacccggagggggcgctgtggtga

SEQ ID NO: 8398 - RNA, 9879 nt, synthetic construct
  misc_feature 1..9879: note = derived and/or modified CDS sequence (opt1) from DENV-1__FJ547065__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacacgatgacctacaagtgcccccggatcaccgagaccgagcccgacgacgtggactgctggtgcaacgccacggacacctgggtgacctacgggacctgcagccagacgggcgagcaccggcgcgacaagcggtccgtggccctcgcgccccacgtgggcctggggctggagacccgcaccgagacctggatgagctccgagggcgcgtggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtcgggaagctggtgcaccagatcttcggcaccgcctacggggtgctgttctccggcgtcagctggacgatgaagatcgggatcggcgtgctgctgacctggctcggcctgaactcccgcagcacctccctgagcatgacctgcatcgccgtggggctcgtcacgctgtacctgggcgtgatggtgcaggccgactccgggtgcgtcatcaactggaagggccgggagctcaagtgcgggagcggcatcttcgtgaccaacgaggtgcacacctggaccgagcagtacaagttccaggccgacagcccgaagcgcctgtccgcggccatcggcaaggcctgggaggagggggtctgcggcatccggagcgccacccgcctggagaacatcatgtggaagcagatctccaacgagctcaaccacatcctgctggagaacgacatgaagttcacggtggtggtcggggacgtggccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgacctgcgcgcctggaacatctgggaggtcgaggactacggcttcgggatcttcacgaccaacatctggctgaagctccgggacagctacacccaggtgtgcgaccaccgcctgatgtccgcggccatcaaggacagcaaggccgtgcacgccgacatgggctactggatcgagtccgagaagaacgagacctggaagctggcccgggcgagcttcatcgaggtcaagacgtgcatctggcccaagtcccacaccctctggagcaacggcgtgctggagtccgagatgatcatccccaagatctacgggggcccgatcagccagcacaactaccgccccgggtacttcacccaggccgccggcccctggcacctggggaagctcgagctggacttcgacctgtgcgagggcaccacggtggtcgtggacgagcactgcggcaaccgggggccgtccctccgcaccaccaccgtgacgggcaagatcatccacgagtggtgctgccggagctgcaccctgccgcccctgcgcttccgcggggaggacggctgctggtacgggatggagatccgccccgtcaaggagaaggaggagaacctcgtgaagtccatggtgagcgccggcagcggcgaggtcgactccttcagcctggggctgctctgcatctccatcatgatcgaggaggtgatgcggagccgctggtcccggcgcatgctgatgaccggcaccctggccgtgttcttcctcctgatcatggggcagctgacgtggaacgacctcatccgcctgtgcatcatggtcggcgcgaacgccagcgaccggatggggatgggcaccacctacctggccctcatggccaccttcaagatgcgcccgatgttcgccgtgggcctgctgttccggcgcctcacgtcccgggaggtgctgctgctcaccatcgggctgagcctggtcgcgtccgtggagctccccaacagcctggaggagctgggcgacgggctcgccatgggcatcatgatcctgaagctgctcaccgacttccagtcccaccagctgtgggccaccctgctcagcctgacgttcatcaagaccaccttctccctgcactacgcctggaagaccatggcgatggtcctcagcatcgtgtccctgttccccctgtgcctcagcacgacctcccagaagaccacctggctgcccgtgctgctcggcagcctggggtgcaagccgctgacgatgttcctcatcgccgagaacaagatctggggccgccggtcctggcccctgaacgaggggatcatggccgtcggcatcgtgagcatcctgctcagctccctgctgaagaacgacgtgcccctcgccgggcccctgatcgccggcggcatgctgatcgcgtgctacgtcatcagcgggtccagcgccgacctctccctggagaaggccgccgaggtgagctgggaggaggaggccgagcactccggcgcgagccacaacatcctggtggaggtccaggacgacgggaccatgaagatcaaggacgaggagcgcgacgacaccctcaccatcctgctgaaggccaccctcctggccgtgtccggcgtgtacccgctgagcatccccgccaccctcttcgtctggtacttctggcagaagaagaagcagcggtccggggtgctgtgggacacccccagcccgcccgaggtggagcgcgccgtcctggacgacggcatctaccggatcatgcagcgcggcctgctcgggcggtcccaggtgggcgtgggggtcttccaggagaacgtgttccacaccatgtggcacgtgacccgcggcgcggtcctgatgtaccaggggaagcggctggagcccagctgggcctccgtgaagaaggacctcatcagctacggcggcgggtggcgcctgcagggctcctggaacacgggggaggaggtgcaggtcatcgccgtggagcccggcaagaaccccaagaacgtgcagaccgcccccgggaccttcaagacccccgagggcgaggtcggcgccatcgcgctggacttcaagcccgggacgagcggctcccccatcgtgaaccgggaggggaagatcgtgggcctctacggcaacggggtcgtgaccaccagcggcacctacgtgagcgccatcgcccaggccaaggcgtcccaggaggggccgctgcccgagatcgaggacgaggtcttccgcaagcggaacctgacgatcatggacctccaccccggcagcgggaagacccgccggtacctgccggccatcgtgcgcgaggccatcaagcgcaagctgcggaccctcatcctggcccccacccgcgtggtcgcctccgagatggcggaggccctgaagggcatgcccatccggtaccagacgaccgccgtcaagagcgagcacaccggcaaggagatcgtggacctcatgtgccacgccaccttcacgatgcgcctgctgtcccccgtccgggtgccgaactacaacatgatcatcatggacgaggcccacttcaccgaccccagctccatcgcggcccgcgggtacatcagcacccgggtgggcatgggggaggccgccgccatcttcatgaccgcgacgccgcccggctccgtcgaggccttcccgcagagcaacgccgtgatccaggacgaggagcgcgacatccccgagcggtcctggaacagcgggtacgagtggatcaccgacttccccggcaagaccgtgtggttcgtcccctccatcaagagcggcaacgacatcgccaactgcctccgcaagaacgggaagcgggtgatccagctgtcccgcaagaccttcgacacggagtaccagaagacccggaacaacgactgggactacgtggtcaccaccgacatcagcgagatgggcgcgaacttccgcgccgaccgggtgatcgacccgcgccggtgcctgaagcccgtgatcctcaaggacgggcccgagcgcgtcatcctggccggccccatgccggtgacggtcgcctccgccgcgcagcggcgcgggcgcatcggccggaaccacaacaaggagggcgaccagtacatctacatggggcagcccctgaacaacgacgaggaccacgcccactggaccgaggccaagatgctcctggacaacatcaacacccccgagggcatcatccccgccctgttcgagccggagcgcgagaagtccgccgcgatcgacggggagtaccggctccgcggcgaggcccggaagaccttcgtggagctgatgcgccgcggggacctgcccgtgtggctctcctacaaggtcgccagcgagggcttccagtacagcgaccgcaagtggtgcttcgacggcgagcggaacaaccaggtgctggaggagaacatggacgtggagatctggacgaaggagggggagcgcaagaagctgcggccccgctggctcgacgcccggacctactccgaccccctggccctgcgcgagttcaaggagttcgcggccggccggcgcagcgtctccggggacctcatcctggagatcggcaagctgccgcagcacctcacccagcgggcccagaacgccctggacaacctggtgatgctccacaacagcgagcagggcgggcgcgcgtaccggcacgccatggaggagctgcccgacaccatcgagacgctgatgctcctggccctgatcgccgtgctcaccggcggggtcaccctgttcttcctgtccggccgcgggctcggcaagaccagcatcggcctgctgtgcgtgatggcctccagcgtgctcctgtggatggcgtccgtcgagccccactggatcgccgccagcatcatcctggagttcttcctcatggtgctgctgatccccgagccggaccggcagcgcacgccccaggacaaccagctcgcctacgtggtcatcgggctgctgttcatgatcctcacggtggccgcgaacgagatgggcctgctggagaccaccaagaaggacctcgggatcggccacgtggccgtcgagaaccaccaccacgccgccatgctggacgtggacctgcaccccgcctccgcgtggaccctctacgccgtggccacgaccatcatcaccccgatgatgcgccacaccatcgagaacacgaccgccaacatcagcctgaccgccatcgcgaaccaggccgccatcctgatggggctcgacaagggctggcccatctccaagatggacatcggcgtccccctgctggccctcgggtgctacagccaggtgaaccccctgaccctgacggcggccgtgctcatgctggtcgcccactacgccatcatcggcccggggctgcaggccaaggcgacccgggaggcccagaagcgcaccgccgccggcatcatgaagaaccccaccgtggacgggatcgtggccatcgacctcgaccccgtcgtgtacgacgcgaagttcgagaagcagctgggccagatcatgctgctcatcctgtgcacgtcccagatcctgctcatgcggaccacctgggccctgtgcgagagcatcaccctggccacgggccccctcaccaccctgtgggaggggtccccgggcaagttctggaacaccacgatcgccgtgagcatggccaacatcttccgcgggtcctacctggcgggcgccggcctcgccttcagcctgatgaagtccctcgggggcgggcggcgcgggaccggggcccagggcgagaccctcggcgagaagtggaagcggcagctgaaccagctgtccaagagcgagttcaacacctacaagcgctccgggatcatggaggtcgaccggagcgaggcgaaggagggcctcaagcgcggggagacgaccaagcacgccgtgtcccggggcaccgccaagctgcgctggttcgtggagcggaacctggtcaagcccgaggggaaggtgatcgacctgggctgcggccgcgggggctggagctactactgcgccgggctcaagaaggtgaccgaggtcaagggctacacgaagggcggccccggccacgaggagcccatcccgatggccacctacgggtggaacctggtgaagctgcactccggcaaggacgtgttcttcatcccgcccgagaagtgcgacaccctcctgtgcgacatcggggagagctcccccaacccgaccatcgaggagggccggacgctgcgcgtcctcaagatggtggagccctggctgcgggggaaccagttctgcatcaagatcctgaacccctacatgcccagcgtggtcgagaccctcgagcagatgcagcgcaagcacggcggcatgctggtgcggaacccgctgtcccgcaacagcacccacgagatgtactgggtgtcctgcgggaccggcaacatcgtcagcgcggtgaacatgacctcccgcatgctcctgaaccggttcacgatggcccaccgcaagcccacctacgagcgggacgtggacctgggggccggcacccgccacgtcgccgtggagcccgaggtggccaacctcgacatcatcggccagcggatcgagaacatcaagcacgagcacaagagcacctggcactacgacgaggacaacccctacaagacgtgggcgtaccacgggtcctacgaggtcaagccgagcggctccgccagcagcatggtgaacggggtcgtgaagctgctgaccaagccctgggacgtgatccccatggtcacccagatcgccatgaccgacacgacccccttcggccagcagcgcgtgttcaaggagaaggtggacacccggaccccgaaggccaagcgcgggacggcccagatcatggaggtcaccgcgaagtggctctggggcttcctgtcccggaacaagaagccccgcatctgcacccgggaggagttcacccgcaaggtgcggagcaacgccgccatcggcgccgtgttcgtcgacgagaaccagtggaactccgcgaaggaggccgtggaggacgagcgcttctgggacctggtgcaccgggagcgcgagctccacaagcaggggaagtgcgccacgtgcgtctacaacatgatgggcaagcgggagaagaagctgggggagttcggcaaggccaaggggagccgcgccatctggtacatgtggctgggcgcgcggttcctcgagttcgaggccctgggcttcatgaacgaggaccactggttctcccgcgagaacagcctgtccggggtggagggcgaggggctccacaagctgggctacatcctgcgggacatcagcaagatccccgggggcaacatgtacgccgacgacaccgccggctgggacacccgcatcaccgaggacgacctccagaacgaggcccgcatcacggacatcatggagccggagcacgcgctgctggccaagtccatcttcaagctcacctaccagaacaaggtggtccgggtgcagcgccccgccaagaacgggaccgtgatggacgtcatcagccggcgcgaccagcggggctccggccaggtggggacctacggcctgaacacgttcaccaacatggaggcccagctgatccgccagatggagagcgaggggatcttctcccccagcgagctcgagacccccaacctggccgagcgggtgctggactggctcgagaagtacggcgtcgagcgcctgaagcggatggcgatctccggggacgactgcgtggtgaagccgatcgacgaccgcttcgccaccgccctgacggccctcaacgacatgggcaaggtccggaaggacatcccccagtgggagcccagcaaggggtggaacgactggcagcaggtccccttctgctcccaccacttccaccagctgatcatgaaggacggccgcgagatcgtggtcccgtgccggaaccaggacgagctggtgggccgcgcccgggtgagccagggggcgggctggagcctccgcgagaccgcctgcctggggaagtcctacgcccagatgtggcagctgatgtacttccaccggcgcgacctccggctggccgcgaacgccatctgcagcgccgtccccgtggactggatccccacctcccgcaccacgtggagcatccacgcccaccaccagtggatgaccaccgaggacatgctgtccgtgtggaaccgcgtctggatcgaggagaacccctggatggaggacaagacccacatcagctcctggggcgacgtgccgtacctcgggaagcgggaggaccagtggtgcggcagcctgatcggcctgacggcccgcgcgacctgggccaccaacatccaggtggccatcaaccaggtccggcgcctcatcgggaacgagaactacctggactacatgacctccatgaagcggttcaagaacgagagcgaccccgagggcgccctgtggtga

SEQ ID NO: 8399 - RNA, 9879 nt, synthetic construct
  misc_feature 1..9879: note = derived and/or modified CDS sequence (opt1) from DENV-1__FJ410230__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagacctccgccggggtgaacatgtgcaccctcatcgccatggacctgggcgagctgtgcgaggacacgatgacctacaagtgcccccggatcaccgagaccgagcccgacgacgtggactgctggtgcaacgccacggacacctgggtcacctacgggacctgcagccagacgggcgagcaccggcgcgacaagcggtccgtggccctcgcgccccacgtgggcctggggctggagacccgcaccgagacctggatgagctccgagggcgcgtggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgatcggggccaccgagatccagacctccggcaccacgaccatcttcgccgggcacctgaagtgccgcctcaagatggacaagctgaccctgaagggcatgagctacgtcatgtgcaccgggtccttcaagctcgagaaggagctggccgagacgcagcacggcaccgtgctggtgcagatcaagtacgagggcaccgacgcgccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgccggcgagaaggcgctcaagctgagctggttcaagaaggggtccagcatcggcaagatgttcgaggccaccgcccgcggggcccggcgcatggccatcctgggcgacacggcgtgggacttcgggtccatcggcggcgtgttcaccagcgtggggaagctcgtccaccagatcttcggcaccgcctacggggtgctgttctccggcgtgagctggaccatgaagatcgggatcggcgtcctgctcacgtggctgggcctgaactcccgcagcacctccctcagcatgacctgcatcgccgtggggctggtgaccctgtacctcggcgtcatggtgcaggccgactccgggtgcgtgatcaactggaagggccgggagctgaagtgcgggagcggcatcttcgtcacgaacgaggtgcacacctggaccgagcagtacaagttccaggccgacagcccgaagcgcctgtccgcggccatcggcaaggcctgggaggagggggtgtgcggcatccggagcgccacccgcctcgagaacatcatgtggaagcagatctccaacgagctgaaccacatcctgctcgagaacgacatgaagttcaccgtcgtggtgggggacgtcgccggcatcctggcgcaggggaagaagatgatccggccccagcccatggagcacaagtacagctggaagtcctggggcaaggccaagatcatcggcgccgacgtgcagaacacgaccttcatcatcgacgggcccaacaccccggagtgccccgacgaccagcgcgcctggaacatctgggaggtggaggactacggcttcgggatcttcaccacgaacatctggctgaagctccgggacagctacacccaggtctgcgaccaccgcctgatgtccgcggccatcaaggacagcaaggccgtgcacgccgacatgggctactggatcgagtccgagaagaacgagacctggaagctggcccgggcgagcttcatcgaggtgaagacctgcatctggcccaagtcccacacgctctggagcaacggcgtcctggagtccgagatgatcatccccaagatctacgggggcccgatcagccagcacaactaccgccccgggtacttcacccagaccgccggcccctggcacctggggaagctcgagctggacttcgacctgtgcgagggcaccacggtggtggtcgacgagcactgcggcaaccgggggccgtccctccgcaccaccaccgtgacgggcaagatcatccacgagtggtgctgccggagctgcaccctgccgcccctgcgcttccgcggggaggacggctgctggtacgggatggagatccgccccgtgaaggagaaggaggagaacctcgtcaagtccatggtgagcgccggcagcggcgaggtggactccttcagcctggggctgctctgcatctccatcatgatcgaggaggtcatgcggagccgctggtcccggaagatgctgatgaccggcaccctggccgtgttcttcctcctgatcatggggcagctgacgtggaacgacctcatccgcctgtgcatcatggtgggcgccaacgcgagcgaccgcatggggatgggcaccacctacctggccctcatggccaccttcaagatgcggccgatgttcgccgtcggcctgctgttccgccggctcacgtcccgcgaggtgctgctgctcaccatcgggctgagcctggtggcctccgtcgagctccccaacagcctggaggagctgggcgacgggctcgcgatgggcatcatgatcctgaagctgctcaccgacttccagtcccaccagctgtgggccaccctgctcagcctgacgttcatcaagaccaccttctccctgcactacgcctggaagaccatggccatggtgctcagcatcgtctccctgttccccctgtgcctcagcacgacctcccagaagaccacctggctgcccgtgctgctcggcagcctggggtgcaagccgctgacgatgttcctcatcgcggagaacaagatctggggccggcgctcctggcccctgaacgaggggatcatggccgtgggcatcgtcagcatcctgctcagctccctgctgaagaacgacgtgcccctcgccgggcccctgatcgccggcggcatgctgatcgcctgctacgtgatcagcgggtccagcgcggacctctccctggagaaggccgccgaggtcagctgggaggaggaggccgagcactccggcgccagccacaacatcctggtggaggtgcaggacgacgggaccatgaagatcaaggacgaggagcgggacgacaccctcaccatcctgctgaaggcgaccctcctggccgtctccggcgtgtacccgctgagcatccccgccaccctgttcgtgtggtacttctggcagaagaagaagcagcgctccggggtcctgtgggacacccccagcccgcccgaggtggagcgggccgtgctggacgacggcatctaccgcatcatgcagcggggcctgctcgggcgctcccaggtcggcgtgggggtgttccaggagaacgtcttccacaccatgtggcacgtgacccggggcgccgtgctgatgtaccaggggaagcgcctggagcccagctgggcgtccgtcaagaaggacctcatcagctacggcggcgggtggcggctgcagggctcctggaacacgggggaggaggtccaggtgatcgccgtcgagcccggcaagaaccccaagaacgtgcagaccgcccccgggaccttcaagacccccgagggcgaggtgggcgccatcgccctggacttcaagcccgggacgagcggctcccccatcgtcaaccgcgaggggaagatcgtgggcctctacggcaacggggtggtcaccaccagcggcacctacgtgagcgcgatcgcccaggccaaggcctcccaggaggggccgctgcccgagatcgaggacgaggtgttccggaagcgcaacctgacgatcatggacctccaccccggcagcgggaagacccggcgctacctgccggcgatcgtccgggaggccatcaagcgcaagctgcgcaccctcatcctggcccccacccgggtggtggcctccgagatggccgaggcgctgaagggcatgcccatccgctaccagacgaccgccgtcaagagcgagcacaccggcaaggagatcgtggacctcatgtgccacgccaccttcacgatgcggctgctgtcccccgtgcgcgtcccgaactacaacatgatcatcatggacgaggcccacttcaccgaccccagctccatcgccgcgcgggggtacatcagcacccgcgtgggcatgggggaggccgccgccatcttcatgaccgccacgccgcccggctccgtggaggcgttcccgcagagcaacgccgtcatccaggacgaggagcgggacatccccgagcgctcctggaacagcgggtacgagtggatcaccgacttccccggcaagaccgtgtggttcgtgccctccatcaagagcggcaacgacatcgccaactgcctccggaagaacgggaagcgcgtcatccagctgtcccggaagaccttcgacacggagtaccagaagaccaagaacaacgactgggactacgtggtgaccaccgacatcagcgagatgggcgccaacttccgcgcggaccgggtcatcgacccgcgccggtgcctgaagcccgtgatcctcaaggacgggcccgagcgcgtgatcctggccggccccatgccggtcacggtggcctccgccgcccagcggcgcgggcggatcggccgcaaccacaacaaggagggcgaccagtacatctacatggggcagcccctgaacaacgacgaggaccacgcgcactggaccgaggccaagatgctcctggacaacatcaacacccccgagggcatcatccccgccctgttcgagccggagcgcgagaagtccgccgccatcgacggggagtaccggctccgcggcgaggcgcggaagaccttcgtcgagctgatgcgccgcggggacctgcccgtgtggctctcctacaaggtggccagcgagggcttccagtacagcgaccgccggtggtgcttcgacggcgagcgcaacaaccaggtcctggaggagaacatggacgtggagatctggacgaaggagggggagcggaagaagctgcgcccccggtggctcgacgcccgcacctactccgaccccctggccctgcgggagttcaaggagttcgccgcgggccgccggagcgtgtccggggacctcatcctggagatcggcaagctgccgcagcacctcacccagcgcgcccagaacgccctggacaacctggtcatgctccacaacagcgagcagggcgggcgggcctaccgccacgcgatggaggagctgcccgacaccatcgagacgctgatgctcctggccctgatcgccgtgctcaccggcggggtgaccctgttcttcctgtccggccgggggctcggcaagaccagcatcggcctgctgtgcgtcatgtccagctccgtgctcctgtggatggccagcgtggagccccactggatcgccgcgtccatcatcctggagttcttcctcatggtcctgctgatccccgagccggaccgccagcggacgccccaggacaaccagctcgcctacgtggtgatcgggctgctgttcatgatcctcacggtcgccgccaacgagatgggcctgctggagaccaccaagaaggacctcgggatcggccacgtggccgtggagaaccaccaccacgcggccatgctggacgtcgacctgcaccccgccagcgcctggaccctctacgccgtggcgacgaccatcatcaccccgatgatgcgccacaccatcgagaacacgaccgccaacatctccctgaccgccatcgccaaccaggccgcgatcctgatggggctcgacaagggctggcccatcagccgcatggacatcggcgtgcccctgctggccctcgggtgctactcccaggtcaaccccctgaccctgacggccgccgtgctcatgctggtggcgcactacgccatcatcggcccggggctgcaggccaaggccacccgggaggcccagaagcgcaccgcggccggcatcatgaagaaccccaccgtcgacgggatcgtggccatcgacctcgaccccgtggtctacgacgccaagttcgagaagcagctgggccagatcatgctgctcatcctgtgcacgagccagatcctgctcatgcggaccacctgggccctgtgcgagtccatcaccctggcgacgggccccctcaccaccctgtgggaggggagcccgggcaagttctggaacaccacgatcgccgtgtccatggccaacatcttccgcgggagctacctggccggcgccggcctcgcgttcagcctgatgaagtccctcgggggcgggcggcgcgggaccggggcccagggcgagaccctcggcgagaagtggaagcggcagctgaaccagctgagcaagtccgagttcaacacctacaagcgcagcgggatcatggaggtggaccggtccgaggccaaggagggcctcaagcgcggggagacgaccaagcacgccgtcagccggggcaccgcgaagctgcgctggttcgtggagcggaacctggtgaagcccgaggggaaggtcatcgacctgggctgcggccgcgggggctggtcctactactgcgccgggctcaagaaggtgaccgaggtgaagggctacacgaagggcgggcccggccacgaggagcccatcccgatggccacctacgggtggaacctggtcaagctgcacagcggcaaggacgtgttcttcatcccgcccgagaagtgcgacaccctcctgtgcgacatcggggagtccagccccaacccgaccatcgaggagggccggacgctgcgcgtgctcaagatggtcgagccctggctgcgggggaaccagttctgcatcaagatcctgaacccctacatgccctccgtggtggagaccctcgagcagatgcagcgcaagcacggcggcatgctggtccggaacccgctgagccgcaactccacccacgagatgtactgggtgagctgcgggaccggcaacatcgtgtccgccgtcaacatgaccagccgcatgctcctgaaccggctgacgatggcccaccgcaagcccacctacgagcgggacgtggacctcggggcgggcacccgccacgtggccgtcgagcccgaggtggccaacctggacatcatcggccagcggatcgagaacatcaagcacgagcacaagtccacctggcactacgacgaggacaacccctacaagacgtgggcctaccacgggagctacgaggtgaagccgtccggcagcgccagctccatggtcaacggggtggtcaagctgctcaccaagccctgggacgtgatccccatggtgacccagatcgcgatgaccgacacgacccccttcggccagcagcgcgtcttcaaggagaaggtggacacccggaccccgaaggccaagcgcgggacggcccagatcatggaggtgaccgccaagtggctgtggggcttcctgagccggaacaagaagccccgcatctgcacccgggaggagttcacccgcaaggtccggtccaacgccgcgatcggcgccgtgttcgtggacgagaaccagtggaacagcgccaaggaggccgtcgaggacgagcgcttctgggacctcgtgcaccgggagcgcgagctgcacaagcaggggaagtgcgcgacgtgcgtgtacaacatgatgggcaagcgggagaagaagctgggggagttcggcaaggccaaggggtcccgcgccatctggtacatgtggctcggcgcccggttcctggagttcgaggccctgggcttcatgaacgaggaccactggttcagccgcgagaactccctcagcggggtcgagggcgaggggctgcacaagctgggctacatcctccgggacatctccaagatccccgggggcaacatgtacgcggacgacaccgccggctgggacacccgcatcaccgaggacgacctgcagaacgaggcccgcatcacggacatcatggagccggagcacgccctgctcgccaagagcatcttcaagctgacctaccagaacaaggtggtgcgggtccagcgccccgcgaagaacgggaccgtgatggacgtgatctcccggcgcgaccagcggggcagcgggcaggtcggcacctacggcctgaacacgttcaccaacatggaggcccagctcatccgccagatggagtccgaggggatcttcagcccctccgagctggagacccccaacctggccgagcgggtgctcgactggctggagaagtacggcgtggagcgcctgaagcggatggccatcagcggggacgactgcgtcgtgaagccgatcgacgaccgcttcgccaccgcgctcacggccctgaacgacatgggcaaggtgcggaaggacatcccccagtgggagccctccaaggggtggaacgactggcagcaggtccccttctgcagccaccacttccaccagctgatcatgaaggacggccgcgagatcgtggtgccgtgccggaaccaggacgagctcgtcggccgcgcccgggtgagccagggggccggctggtccctgcgcgagaccgcctgcctgggcaagagctacgcgcagatgtggcagctcatgtacttccaccggcgcgacctgcggctggccgccaacgccatctgctccgcggtgcccgtcgactggatccccaccagccgcaccacgtggtccatccacgcccaccaccagtggatgaccaccgaggacatgctcagcgtgtggaaccgcgtgtggatcgaggagaacccctggatggaggacaagacccacatctccagctggggcgacgtcccgtacctggggaagcgggaggaccagtggtgcggctccctgatcggcctcacggcccgcgccacctgggccaccaacatccaggtggcgatcaaccaggtgcggcgcctgatcgggaacgagaactacctggactacatgaccagcatgaagcggttcaagaacgagtccgaccccgagggcgccctctggtga

SEQ ID NO: 8400 - RNA, 9879 nt, synthetic construct
  misc_feature 1..9879: note = derived and/or modified CDS sequence (opt1) from DENV-1__FJ410231__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgaggtggagcccgacgacgtggactgctggtgcaacaccaccgacacctgggtgacctacgggacctgcagccagacgggcgagcaccggcgcgacaagcggagcgtggccctcgcgccccacgtcggcctggggctggagacccgcgccgagacctggatgagctccgagggcgcgtggaagcagatccagaaggtggagacctgggccctccggcaccccgggttcacggtgatcgccctgttcctggcccacgcgatcggcaccagcatcacccagaaggggatcatcttcatcctcctgatgctggtcaccccctccatggccatgcgctgcgtgggcatcggcagccgggacttcgtggaggggctctccggcgccacgtgggtcgacgtggtgctggagcacgggagctgcgtcaccaccatggccaaggacaagcccaccctggacatcgagctcctgaagacggaggtgaccaaccccgccgtgctgcgcaagctctgcatcgaggcgaagatctccaacaccaccacggacagccggtgcccgacccagggcgaggccaccctggtcgaggagcaggacgccaacttcgtgtgccgccggaccttcgtggaccgcggctgggggaacggctgcgggctgttcggcaaggggtccctcatcacgtgcgccaagttcaagtgcgtcaccaagctggagggcaagatcgtgcagtacgagaacctgaagtacagcgtgatcgtcaccgtgcacaccggcgaccagcaccaggtcgggaacgagtccacggagcacggcaccaccgccaccatcacgccccaggcgcccacgagcgagatccagctcaccgactacggggccctgaccctggactgcagcccccggaccggcctcgacttcaacgagatggtgctgctgacgatgaaggagaagtcctggctcgtgcacaagcagtggttcctggacctgcccctcccctggaccagcggggcctccaccagccaggagacctggaaccgccaggacctgctggtcacgttcaagaccgcccacgccaagaagcaggaggtggtggtcctcggctcccaggagggcgcgatgcacaccgccctgaccggggccacggagatccagaccagcggcaccaccacgatcttcgccgggcacctgaagtgccggctcaagatggacaagctgaccctgaagggcatgtcctacgtgatgtgcaccgggagcttcaagctcgagaaggaggtggccgagacccagcacggcacggtcctggtgcagatcaagtacgagggcaccgacgcgccctgcaagatccccttctccacccaggacgagaagggggtgacccagaacggccgcctgatcacggccaacccgatcgtcaccgacaaggagaagcccgtgaacatcgaggccgagccgcccttcggggagagctacatcgtgatcggcgccggcgagaaggcgctgaagctctcctggttcaagaaggggagctccatcggcaagatgttcgaggccaccgcccgcggggcccgccggatggccatcctgggcgacaccgcgtgggacttcgggagcatcggcggcgtcttcacgtccgtggggaagctggtgcaccagatcttcggcaccgcctacggggtcctcttcagcggcgtgtcctggaccatgaagatcgggatcggcgtgctgctgacctggctcggcctgaacagccgctccacgagcctgtccatgacctgcatcgccgtcgggctcgtgaccctgtacctgggcgtgatggtccaggccgacagcgggtgcgtgatcaactggaagggccgcgagctcaagtgcgggagcggcatcttcgtgaccaacgaggtccacacgtggaccgagcagtacaagttccaggccgactccccgaagcggctgagcgcggccatcggcaaggcctgggaggagggggtgtgcggcatccgctccgccacccggctggagaacatcatgtggcgccagatcagcaacgagctcaaccacatcctgctggagaacgacatgaagttcaccgtggtcgtgggggacgtggtcggcatcctcgcccaggggaagaagatgatccggccccagcccatggagcacaagtactcctggaagtcctggggcaaggcgaagatcatcggcgccgacgtgcagaacaccacgttcatcatcgacgggcccaacaccccggagtgccccgacgaccagcgcgcctggaacatctgggaggtggaggactacggcttcgggatcttcaccaccaacatctggctgaagctgcgggactcctacacgcaggtctgcgaccaccgcctcatgagcgccgcgatcaaggactccaaggccgtgcacgccgacatgggctactggatcgagagcgagaagaacgagacctggaagctggcccgggcctccttcatcgaggtgaagacctgcatctggcccaagagccacaccctgtggtccaacggcgtcctcgagagcgagatgatcatccccaagatctacgggggcccgatctcccagcacaactaccgccccgggtacttcacgcagaccgcgggcccctggcacctggggaagctggagctcgacttcgacctgtgcgagggcaccaccgtggtggtcgacgagcactgcggcaaccgggggccgagcctgcgcacgaccaccgtgaccggcaagatcatccacgagtggtgctgccggtcctgcacgctgccgcccctccgcttcaagggggaggacggctgctggtacgggatggagatccggcccgtgaaggagaaggaggagaacctggtcaagagcatggtgagcgccggctccggcgaggtggacagcttctccctcgggctgctgtgcatcagcatcatgatcgaggaggtcatgcgctcccggtggagccgcaagatgctcatgaccggcaccctggccgtgttcttcctgctcatcatggggcagctgacctggaacgacctgatccggtcctgcatcatggtgggcgccaacgccagcgaccgcatggggatgggcacgacctacctcgcgctgatggccaccttcaagatgcgcccgatgttcgccgtcgggctgctgttccggcgcctgacctcccgggaggtgctgctcctgacgatcgggctgagcctcgtcgcctccgtggagctgcccaacagcctggaggagctcggcgacgggctggccatgggcatcatgatcctgaagctcctgaccgacttccagtcctaccagctgtgggcgaccctcctgagcctgaccttcatcaagacgaccttctccctccactacgcctggaagaccatggccatggtgctgagcatcgtctccctgctccccctgtgcctgagcaccacgtcccagaagaccacctggctccccgtgctgctgggcagcctcgggtgcaagccgctgaccatgttcctgatcgccgagaacaagatctggggccgcaagagctggcccctcaacgaggggatcatggcggtgggcatcgtctccatcctgctgagctccctcctgaagaacgacgtgcccctggccgggcccctcatcgccggcggcatgctgatcgcctgctacgtgatcagcgggtccagcgccgacctgtccctcgagaaggcggccgaggtcagctgggaggaggaggccgagcactccggcgccagccacaacatcctggtggaggtgcaggacgacgggacgatgaagatcaaggacgaggagcgggacgacaccctgaccatcctcctgaaggccaccctgctcgcggtctccggcgtgtacccgctgagcatccccgccaccctgttcgtgtggtacttctggcagaagaagaagcagcgctccggggtcctctgggacacgcccagcccgcccgaggtggagcgggccgtgctggacgacggcatctaccgcatcatgcagcggggcctgctggggcgctcccaggtcggcgtgggggtgttccaggagaacgtcttccacaccatgtggcacgtgacccggggcgccgtgctcatgtaccaggggaagcgcctggagcccagctgggcctccgtcaagaaggacctgatcagctacggcggcgggtggcggctccagggctcctggaacaccggggaggaggtccaggtgatcgcggtcgagcccggcaagaaccccaagaacgtgcagacggcccccgggaccttcaagacccccgagggcgaggtgggcgccatcgccctggacttcaagcccgggaccagcggcagccccatcgtcaaccgcgaggggaagatcgtgggcctgtacggcaacggggtggtcacgacctccggcacctacgtgagcgccatcgcgcaggccaaggcctcccaggaggggccgctccccgagatcgaggacgaggtgttccggaagcgcaacctgaccatcatggacctgcaccccggcagcgggaagacgcggcgctacctcccggccatcgtccgggaggcgatcaagcgcaagctgcggaccctgatcctcgcccccacccgcgtggtggcctccgagatggccgaggccctgaagggcatgcccatccgctaccagaccacggcggtcaagagcgagcacaccggccgggagatcgtggacctgatgtgccacgccaccttcaccatgcgcctcctgtcccccgtgcgggtcccgaactacaacatgatcatcatggacgaggcccacttcacggaccccagctccatcgccgcccgcgggtacatcagcacccgggtgggcatgggggaggcggccgccatcttcatgaccgccacgccgcccggctccgtggaggccttcccgcagagcaacgcggtcatccaggacgaggagcgcgacatccccgagcggtcctggaacagcgggtacgagtggatcacggacttccccggcaagaccgtgtggttcgtgccctccatcaagagcggcaacgacatcgccaactgcctgcgcaagaacgggaagcgggtcatccagctctcccgcaagaccttcgacaccgagtaccagaagacgaagaacaacgactgggactacgtggtgaccaccgacatcagcgagatgggcgccaacttccgggccgaccgcgtcatcgacccgcggcgctgcctgaagcccgtgatcctgaaggacgggcccgagcgggtcatcctcgcgggccccatgccggtgaccgtggcctccgccgcccagcgccgggggcgcatcggccggaaccacaacaaggagggcgaccagtacatctacatggggcagcccctgaacaacgacgaggaccacgcccactggacggaggcgaagatgctgctcgacaacatcaacacccccgagggcatcatccccgccctgttcgagccggagcgcgagaagtccgccgccatcgacggggagtaccgcctgcggggcgaggcccgcaagaccttcgtcgagctcatgcggcgcggggacctgcccgtgtggctgagctacaaggtggcgtccgagggcttccagtacagcgaccggcgctggtgcttcgacggcgagcggaacaaccaggtcctcgaggagaacatggacgtggagatctggaccaaggagggggagcgcaagaagctgcggccccgctggctggacgcccggacgtactccgaccccctcgccctgcgcgagttcaaggagttcgccgccggccggcgcagcgtgtccggggacctgatcctcgagatcggcaagctgccgcagcacctgacccagcgggcgcagaacgccctcgacaacctggtcatgctgcacaacagcgagcagggcgggcgcgcctaccggcacgccatggaggagctccccgacaccatcgagaccctgatgctgctcgcgctgatcgccgtgctgacgggcggggtgaccctcttcttcctgtccggcaaggggctgggcaagaccagcatcggcctcctgtgcgtcatggcctccagcgccctgctctggatggcctccgtggagccccactggatcgcggccagcatcatcctggagttcttcctgatggtgctcctgatccccgagccggaccgccagcggacgccccaggacaaccagctggcctacgtcgtgatcgggctcctgttcatgatcctgaccgtggccgccaacgagatgggcctcctggagacgaccaagaaggacctggggatcggccacgtcgcggtggagaaccaccaccacgccaccatgctcgacgtggacctgcaccccgcctccgcctggaccctgtacgccgtcgcgacgaccatcatcaccccgatgatgcgccacaccatcgagaacacgaccgccaacatcagcctcaccgccatcgccaaccaggccgcgatcctgatggggctggacaagggctggcccatctccaagatggacatcggcgtgcccctcctggccctggggtgctacagccaggtgaaccccctcaccctgacggccgccgtcctgatgctcgtggcgcactacgccatcatcggcccggggctgcaggccaaggccacccgggaggcccagaagcgcaccgcggccggcatcatgaagaaccccaccgtggacgggatcgtcgccatcgacctggaccccgtggtgtacgacgccaagttcgagaagcagctcggccagatcatgctgctgatcctctgcacgtcccagatcctgctgatgcgcaccacctgggccctctgcgagagcatcaccctggcgacgggccccctgaccaccctctgggaggggtccccgggcaagttctggaacaccacgatcgccgtcagcatggccaacatcttccgggggagctacctggccggcgccggcctggcgttctccctcatgaagtccctcgggggcgggcgccgggggaccggggcccagggcgagaccctgggcgagaagtggaagcgccagctcaaccagctgtccaagagcgagttcaacacctacaagcggtccgggatcatggaggtggaccgcagcgaggccaaggagggcctgcggcgcggggagacgaccaagcacgccgtgtcccggggcaccgcgaagctccgctggttcgtcgagcggaacctggtgaagcccgaggggaaggtgatcgacctgggctgcggccgcgggggctggagctactactgcgccgggctgaagaaggtcaccgaggtgaagggctacacgaagggcgggcccggccacgaggagcccatcccgatggccacctacgggtggaacctcgtgaagctgcactccggcaaggacgtcttcttcatcccgcccgagaagtgcgacaccctgctctgcgacatcggggagagctcccccaacccgaccatcgaggagggccggacgctgcgcgtgctgaagatggtggagccctggctccgggggaaccagttctgcatcaagatcctgaacccctacatgcccagcgtcgtggagaccctggagcagatgcagcgcaagcacggcggcatgctcgtgcggaacccgctgtcccgcaacagcacccacgagatgtactgggtctcctgcgggaccggcaacatcgtgagcgccgtgaacatgacctcccggatgctgctcaaccgcttcacgatggcccaccgcaagcccacctacgagcgggacgtcgacctgggggcgggcacccgccacgtggccgtggagcccgaggtcgccaacctggacatcatcggccagcggatcgagaacatcaagcacgagcacaagagcacctggcactacgacgaggacaacccctacaagacgtgggcctaccacgggtcctacgaggtgaagccgagcggcagcgcctccagcatggtcaacggggtggtgaagctcctgaccaagccctgggacgtcatccccatggtgacccagatcgcgatgaccgacacgacccccttcggccagcagcgcgtgttcaaggagaaggtcgacacccggaccccgaaggccaagcgcgggacggcccagatcatggaggtgaccgccaagtggctgtggggcttcctctcccggaacaagaagccccgcatctgcacccgggaggagttcacccgcaaggtgcggagcaacgccgcgatcggcgccgtcttcgtggacgagaaccagtggaactccgccaaggaggccgtggaggacgagcgcttctgggacctggtccaccgggagcgcgagctgcacaagcaggggaagtgcgcgacgtgcgtgtacaacatgatgggcaagcgggagaagaagctcggggagttcggcaaggccaaggggagccgcgccatctggtacatgtggctgggcgcccggttcctggagttcgaggccctcggcttcatgaacgaggaccactggttctcccgcgagaacagcctgtccggggtggagggcgaggggctgcacaagctcggctacatcctgcgggacatcagcaagatccccgggggcaacatgtacgcggacgacaccgccggctgggacacccgcatcaccgaggacgacctgcagaacgaggccaagatcacggacatcatggagccggagcacgccctcctggccacctccatcttcaagctgacctaccagaacaaggtcgtgcgggtgcagcgccccgcgcgcaacgggaccgtcatggacgtgatcagccggcgcgaccagcggggctccggccaggtgggcacgtacggcctcaacaccttcaccaacatggaggcccagctgatccgccagatggagagcgaggggatcttctcccccagcgagctggagacccccaacctcgccgagcgggtcctggactggctggagaagcacggcgtggagcgcctcaagcggatggccatctccggggacgactgcgtggtcaagccgatcgacgaccgcttcgccacggcgctgagcgccctgaacgacatgggcaaggtgcggaaggacatcccccagtgggagcccagcaaggggtggaacgactggcagcaggtccccttctgctcccaccacttccaccagctcatcatgaaggacggccgcgagatcgtcgtgccgtgccggaaccaggacgagctggtgggccgcgcccgggtcagccagggggccggctggtccctgcgcgagaccgcctgcctcggcaagagctacgcgcagatgtggcagctgatgtacttccaccggcgcgacctgcggctcgccgccaacgccatctgctccgcggtgcccgtggactgggtccccaccagccgcaccacgtggtccatccacgcccaccaccagtggatgaccaccgaggacatgctgagcgtgtggaaccgggtgtggatcgaggagaacccctggatggaggacaagacccacatctccagctggggcgacgtcccgtacctggggaagcgcgaggaccagtggtgcggctccctcatcggcctgacggcccgcgccacctgggccaccaacatccaggtggcgatcaaccaggtgcggcgcctgatcgggaacgagaactacctcgactacatgaccagcatgaagcggttcaagaacgagtccgaccccgagggcgccctgtggtga

SEQ ID NO: 8401 - RNA, 9879 nt, synthetic construct
  misc_feature 1..9879: note = derived and/or modified CDS sequence (opt1) from DENV-1__FJ461323__SS-prME
  source 1..9879: mol_type = other RNA
agcgtgaccatgctgctcatgctgatgcccaccgccctggccttccacctcaccacccgcggcggggagccccacatgatcgtgagcaagcaggagcggggcaagagcctgctgttcaagaccagcgcgggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggtgctccgccaccccgggttcacggtgatcgccctgttcctggcccacgcgatcggcaccagcatcacccagaaggggatcatcttcatcctcctgatgctggtcaccccctccatggccatgcggtgcgtgggcatcggcagccgcgacttcgtggaggggctctccggcgccacgtgggtcgacgtggtgctggagcacgggagctgcgtcaccaccatggccaaggacaagcccaccctggacatcgagctcctgaagacggaggtgaccaaccccgccgtgctgcggaagctctgcatcgaggcgaagatctccaacaccaccacggacagccgctgcccgacccagggcgaggccaccctggtcgaggagcaggacgccaacttcgtgtgccggcgcaccttcgtggaccggggctgggggaacggctgcgggctgttcggcaaggggtccctcatcacgtgcgccaagttcaagtgcgtcaccaagctggagggcaagatcgtgcagtacgagaacctgaagtacagcgtgatcgtcaccgtgcacaccggcgaccagcaccaggtcgggaacgagtccacggagcacggcaccaccgccaccatcacgccccaggcgcccacgaccgagatccagctcaccgactacggggccctgaccctggactgcagcccccgcacgggcctcgacttcaacgagatggtgctgctgaccatgaaggagaagtcctggctcgtgcacaagcagtggttcctggacctgcccctcccctggaccagcggggccagcacctcccaggagacgtggaaccggcaggacctgctggtcaccttcaagaccgcccacgccaagaagcaggaggtggtggtcctcggcagccaggagggcgcgatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtggccgagacgcagcacggcaccgtcctggtgcagatcaagtacgagggcaccgacgcgccctgcaagatccccttcagcacccaggacgagaagggggtgacgcagaacggccggctgatcaccgccaacccgatcgtcaccgacaaggagaagcccgtgaacatcgaggccgagccgcccttcggggagtcctacatcgtgatcggcgccggcgagaaggcgctgaagctcagctggttcaagaaggggtccagcatcggcaagatgttcgaggccaccgcccgcggggcccggcgcatggccatcctgggcgacacggcgtgggacttcgggtccatcggcggcgtcttcaccagcgtggggaagctggtgcaccagatcttcggcaccgcctacggggtcctcttctccggcgtgagctggaccatgaagatcgggatcggcgtgctgctgacgtggctcggcctgaactcccgcagcacctccctgagcatgacctgcatcgccgtcgggctcgtgaccctgtacctgggcgtgatggtccaggccgactccgggtgcgtgatcaactggaagggccgggagctcaagtgcgggagcggcatcttcgtgacgaacgaggtccacacctggaccgagcagtacaagttccaggccgacagcccgaagcgcctgtccgcggccatcggcaaggcctgggaggagggggtgtgcggcatccggagcgccacccgcctggagaacatcatgtggaagcagatctccaacgagctcaaccacatcctgctggagaacgacatgaagctcaccgtggtcgtgggggacgtggccggcatcctggggcagggcaagaagatgatccggccccagcccatggagtacaagtacagctggaagtcctggggcaaggcgaagatcatcggggccgacgcccagaacacgaccttcatcatcgacggccccaacaccccggagtgccccgacgaccagcgcgcctggaacatctgggaggtcgaggactacgggttcggcatcttcaccacgaacatctggctgaagctccgggacagctacacccaggtgtgcgaccaccgcctgatgtccgcggccatcaaggacagcaaggccgtgcacgccgacatgggctactggatcgagtccgagaagaacgagacctggaagctggcccgggcgagcttcatcgaggtcaagacctgcatctggcccaagtcccacacgctctggagcaacggggtgctggagtccgagatgatcatccccaagatctacggcgggccgatcagccagcacaactaccgccccggctacttcacccagaccgccgggccctggcacctgggcaagctcgagctggacttcgacctgtgcgagggcaccacggtggtcgtggacgagcactgcgggaaccggggcccgtccctccgcaccaccaccgtgacggggaagatcatccacgagtggtgctgccggagctgcaccctgccgcccctgcgcttccggggcgaggacgggtgctggtacggcatggagatccgccccgtcaaggagaaggaggagaacctcgtgaagtccatggtgagcgccggcagcggggaggtcgactccttcagcctgggcctgctctgcatctccatcatgatcgaggaggtgatgcggagccgctggtcccggaagatgctgatgaccgggaccctggccgtgttcttcctcctgatcatgggccagctgacgtggaacgacctcatccgcctgtgcatcatggtcggggccaacgcgagcgaccgcatgggcatgggcaccacctacctggccctcatggccaccttcaagatgcggccgatgttcgccgtggggctgctgttccgccggctcacgtcccgcgaggtgctgctgctcaccatcggcctgagcctggtcgcctccgtggagctccccaacagcctggaggagctgggggacggcctcgcgatgggcatcatgatcctgaagctgctcaccgacttccagtcccaccagctgtgggccaccctgctcagcctgacgttcatcaagaccaccttctccctgcactacgcctggaagaccatggccatggtcctcagcatcgtgtccctgttccccctgtgcctcagcacgacctcccagaagaccacctggctgcccgtgctgctcgggagcctgggctgcaagccgctgacgatgttcctcatcgcggagaacaagatctgggggcggaagtcctggcccctgaacgagggcatcatggccgtcgggatcgtgagcatcctgctcagctccctgctgaagaacgacgtgcccctcgccggccccctgatcgccggcgggatgctgatcgcctgctacgtcatcagcggctccagcgcggacctctccctggagaaggccgccgaggtgagctgggaggaggaggccgagcactccggggccagccacaacatcctggtggaggtccaggacgacggcaccatgaagatcaaggacgaggagcgcgacgacaccctcaccatcctgctgaaggcgaccctcctggccgtgtccggggtgtacccgctgagcatccccgccaccctcttcgtctggtacttctggcagaagaagaagcagcggtccggcgtgctgtgggacacccccagcccgcccgaggtggagcgcgccgtcctggacgacggcatctaccggatcatgcagcgcgggctgctcggccggtcccaggtgggggtgggcgtcttccaggagaacgtgttccacaccatgtggcacgtgacccgcggggccgtcctgatgtaccagggcaagcggctggagcccagctgggcgtccgtgaagaaggacctcatcagctacggcgggggctggcgcctgcgggggtcctggaacacgggcgaggaggtgcaggtcatcgccgtggagcccgggaagaaccccaagaacgtgcagaccgcccccggcaccttcaagacccccgagggcgaggtcggggccatcgccctggacttcaagcccggcacgagcgggtcccccatcgtgaaccgcgagggcaagatcgtgggcctctacgggaacggcgtcgtgaccaccagcgggacctacgtgagcgcgatcgcccaggccaaggcctcccaggagggcccgctgcccgagatcgaggacgaggtcttccggaagcgcaacctgacgatcatggacctccaccccgggagcggcaagacccggcgctacctgccggcgatcgtgcgggaggccatcaagcgcaagctgcgcaccctcatcctggcccccacccgggtggtcgcctccgagatggccgaggcgctgaagggcatgcccatccgctaccagacgaccgccgtcaagagcgagcacaccgggaaggagatcgtggacctcatgtgccacgccaccttcacgatgcggctgctgtcccccgtccgcgtgccgaactacaacatgatcatcatggacgaggcccacttcaccgaccccagctccatcgccgcgcggggctacatcagcacccgcgtggggatgggcgaggccgccgccatcttcatgaccgccacgccgcccgggtccgtcgaggcgttcccgcagagcaacgccgtgatccaggacgaggagcgggacatccccgagcgctcctggaacagcggctacgagtggatcaccgacttccccggcaagaccgtgtggttcgtcccctccatcaagagcgggaacgacatcgccaactgcctccggaagaacggcaagcgcgtgatccagctgtcccggaagaccttcgacacggagtaccagaagaccaagaacaacgactgggactacgtggtcaccaccgacatcagcgagatgggggccaacttccgcgcggaccgggtgatcgacccgcgccggtgcctgaagcccgtgatcctcaaggacggccccgagcgcgtcatcctggccgggcccatgccggtgacggtcgcctccgccgcccagcggcgcggccggatcggccgcaaccacaacaaggagggggaccagtacatctacatgggccagcccctgaacaacgacgaggaccacgcgcactggaccgaggccaagatgctcctggacaacatcaacacccccgaggggatcatccccgccctgttcgagccggagcgcgagaagtccgccgccgtggacggcgagtaccggctccgcggggaggcgcggaagaccttcgtggagctgatgcgccggggcgacctgcccgtctggctctcctacaaggtggccagcgagggcttccagtacagcgaccgccggtggtgcttcgacggggagcgcaacaaccaggtgctggaggagaacatggacgtcgagatctggacgaaggagggcgagcggaagaagctgcgcccccggtggctcgacgcccgcacctactccgaccccctggccctgcgggagttcaaggagttcgccgcggggcgccggagcgtgtccggcgacctcatcctggagatcggcaagctgccgcagcacctcacccagcgcgcccagaacgccctggacaacctggtgatgctccacaacagcgagcagggcgggcgggcctaccgccacgcgatggaggagctgcccgacaccatcgagacgctgatgctcctggccctgatcgccgtcctcaccgggggcgtgaccctgttcttcctgtccgggcggggcctcggcaagaccagcatcgggctgctgtgcgtgatggcctccagcgtcctcctgtggatggcctccgtggagccccactggatcgcggccagcatcatcctggagttcttcctcatggtgctgctgatccccgagccggaccgccagcggacgccccaggacaaccagctcgcctacgtcgtgatcggcctgctgttcatgatcctcacggtggccgccaacgagatggggctgctggagaccaccaagaaggacctcggcatcgggcacgtcgcggtggagaaccaccaccacgccgccatgctggacgtggacctgcaccccgcctccgcctggaccctctacgcggtcgccacgaccatcatcaccccgatgatgcgccacaccatcgagaacacgaccgccaacatcagcctgaccgccatcgccaaccaggcggccatcctgatgggcctcgacaagggctggcccatctccaagatggacatcggggtgcccctgctggccctcggctgctacagccaggtgaaccccctgaccctgacggccgcggtcctcatgctggtggcccactacgccatcatcgggccgggcctgcaggccaaggccacccgcgaggcgcagaagcggaccgccgccgggatcatgaagaaccccaccgtggacggcatcgtcgccatcgacctcgaccccgtggtgtacgacgccaagttcgagaagcagctgggccagatcatgctgctcatcctgtgcacgtcccagatcctgctcatgcgcaccacctgggcgctgtgcgagagcatcaccctggccacggggcccctcaccaccctgtgggagggctccccggggaagttctggaacaccacgatcgccgtcagcatggccaacatcttccggggctcctacctggccggcgcggggctcgccttcagcctgatgaagtccctgggcgggggccgccgggggaccggcgcccagggcgagaccctcggggagaagtggaagcgccagctgaaccagctgtccaagagcgagttcaacacctacaagcggtccggcatcatggaggtggaccgcagcgaggccaaggaggggctcaagcggggcgagacgaccaagcacgcggtgtcccgcgggaccgccaagctgcggtggttcgtcgagcgcaacctggtgaagcccgagggcaaggtgatcgacctgggctgcgggcggggcgggtggagctactactgcgccggcctcaagaaggtcaccgaggtgaaggggtacacgaagggcggccccgggcacgaggagcccatcccgatggccacctacggctggaacctggtgaagctgcactccgggaaggacgtcttcttcatcccgcccgagaagtgcgacaccctcctgtgcgacatcggcgagagctcccccaacccgaccatcgaggaggggcgcacgctgcgggtgctcaagatggtggagccctggctgcgcggcaaccagttctgcatcaagatcctgaacccctacatgcccagcgtcgtggagaccctcgagcagatgcagcggaagcacggcgggatgctggtgcgcaacccgctgtcccggaacagcacccacgagatgtactgggtctcctgcggcaccgggaacatcgtgagcgccgtgaacatgacctcccgcatgctcctgaaccgcttcacgatggcgcaccggaagcccacctacgagcgcgacgtcgacctgggcaccggcacccggcacgtggccgtggagcccgaggtcgccaacctcgacatcatcgggcagcgcatcgagaacatcaagcacgagcacaagagcacgtggcactacgacgaggacaacccctacaagacctgggcctaccacggctcctacgaggtgaagccgagcgggtccgccagcagcatggtcaacggcgtggtgaagctgctgaccaagccctgggacgtcatccccatggtgacccagatcgcgatgacggacaccacccccttcgggcagcagcgggtgttcaaggagaaggtcgacacccgcacgccgaaggccaagcggggcaccgcccagatcatggaggtgaccgcccgctggctctggggcttcctgtcccggaacaagaagccccgcatctgcacccgggaggagttcacgcgcaaggtgcggagcaacgccgcgatcggggccgtcttcgtggacgagaaccagtggaactccgccaaggaggccgtggaggacgagcgcttctgggacctggtccaccgggagcgcgagctccacaagcagggcaagtgcgcgacctgcgtgtacaacatgatggggaagcgggagaagaagctgggcgagttcgggaaggccaagggcagccgcgccatctggtacatgtggctgggcgcccggttcctcgagttcgaggccctggggttcatgaacgaggaccactggttctcccgcgagaacagcctgtccggcgtggagggggagggcctccacaagctggggtacatcctgcgggacatcagcaagatccccggcggcaacatgtacgcggacgacaccgccgggtgggacacccgcatcacggaggacgacctccagaacgaggccaagatcaccgacatcatggagccggagcacgccctgctggccaaggcgatcttcaagctcacctaccagaacaaggtcgtgcgcgtgcagcggcccgccaagaacggcaccgtcatggacgtgatctcccgccgggaccagcgcgggagcggccaggtgggcacgtacgggctgaacaccttcaccaacatggaggcccagctgatccggcagatggagtccgagggcatcttcagcccctccgagctcgagacccccaacctggccgagcgcgccctggactggctcgagaagtacggggtcgagcggctgaagcgcatggcgatcagcggcgacgactgcgtggtgaagccgatcgacgaccggttcgccacggccctgaccgccctcaacgacatggggaaggtccgcaaggacatcccccagtgggagccctccaagggctggaacgactggcagcaggtccccttctgcagccaccacttccaccagctgatcatgaaggacggccgggagatcgtggtcccgtgccgcaaccaggacgagctggtggggcgggcccgcgtgtcccagggcgcggggtggagcctccgggagaccgcctgcctgggcaagagctacgcccagatgtggcagctgatgtacttccaccgccgggacctccgcctggccgcgaacgccatctgctccgccgtccccgtggactgggtgcccaccagccggacgacctggtccatccacgcccaccaccagtggatgaccaccgaggacatgctgagcgtctggaaccgcgtgtggatcgaggagaacccctggatggaggacaagacgcacatctccagctgggaggacgtgccgtacctcgggaagcgcgaggaccagtggtgcggctccctgatcggcctgaccgcccgggcgacctgggccaccaacatccaggtcgccatcaaccaggtgcgccggctcatcgggaacgagaactacctggactacatgaccagcatgaagcgcttcaagaacgagacggaccccgagggcgccctgtggtga

SEQ ID NO: 8402 - RNA, 9879 nt, synthetic construct
  misc_feature 1..9879: note = derived and/or modified CDS sequence (opt1) from DENV-1__FJ461325__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgagaccgagcccgacgacgtggactgctggtgcaacgccacggacacctgggtgacctacgggacctgcagccagacgggcgagcaccggcgcgacaagcggtccgtggccctcgcgccccacgtgggcctggggctggagacccgcaccgagacctggatgagctccgagggcgcctggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtcgggaagctggtgcaccagatcttcggcaccgcctacggggtgctgttctccggcgtcagctggacgatgaagatcgggatcggcgtgctgctgacctggctcggcctgaactcccgcagcacctccctgagcatgacctgcatcgccgtggggctcgtcacgctgtacctgggcgtgatggtgcaggccgactccgggtgcgtcatcaactggaagggccgggagctcaagtgcgggagcggcatcttcgtgaccaacgaggtgcacacctggaccgagcagtacaagttccaggccgacagcccgaagcgcctgtccgcggccatcggcaaggcctgggaggagggggtctgcggcatccggagcgccacccgcctggagaacatcatgtggaagcagatctccaacgagctcaaccacatcctgctggagaacgacatgaagttcacggtggtggtcggggacgtggccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtcgaggactacggcttcgggatcttcacgaccaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacgtgcatctggcccaagtcccacaccctgtggagcaacggcgtgctcgagtccgagatgatcatccccaagatctacgggggcccgatcagccagcacaactaccgccccgggtacttcacccaggccgccggcccctggcacctggggaagctggagctcgacttcgacctgtgcgagggcaccacggtggtcgtggacgagcactgcggcaaccgggggccgtccctgcgcaccaccaccgtgacgggcaagatcatccacgagtggtgctgccggagctgcaccctgccgcccctccgcttccgcggggaggacggctgctggtacgggatggagatccgccccgtcaaggagaaggaggagaacctggtgaagtccatggtgagcgccggcagcggcgaggtcgactccttcagcctcgggctgctgtgcatctccatcatgatcgaggaggtgatgcggagccgctggtcccggcgcatgctcatgaccggcaccctggccgtgttcttcctgctcatcatggggcagctgacgtggaacgacctgatccgcctctgcatcatggtcggcgcgaacgccagcgaccggatggggatgggcaccacctacctggccctgatggccaccttcaagatgcgcccgatgttcgccgtgggcctcctgttccggcgcctgacgtcccgggaggtgctcctgctgaccatcgggctcagcctggtcgcgtccgtggagctgcccaacagcctcgaggagctgggcgacgggctggccatgggcatcatgatcctcaagctgctgaccgacttccagtcccaccagctctgggccaccctgctgagcctcacgttcatcaagaccaccttctccctgcactacgcctggaagaccatggcgatggtcctgagcatcgtgtccctcttccccctgtgcctgagcacgacctcccagaagaccacctggctccccgtgctgctgggcagcctcgggtgcaagccgctgacgatgttcctgatcaccgagaacaagatctggggccgccggtcctggcccctcaacgaggggatcatggccgtcggcatcgtgagcatcctgctgagctccctcctgaagaacgacgtgcccctggccgggcccctcatcgccggcggcatgctgatcgcctgctacgtcatcagcgggtccagcgcggacctgtccctcgagaaggccgccgaggtgagctgggaggaggaggccgagcactccggcgccagccacaacatcctggtggaggtccaggacgacgggaccatgaagatcaaggacgaggagcgcgacgacaccctgaccatcctcctgaaggcgacgctgctcgccgtgtccggcgtgtacccgctgagcatccccgccaccctgttcgtctggtacttctggcagaagaagaagcagcggtccggggtgctctgggacacccccagcccgcccgaggtggagcgcgccgtcctggacgacggcatctaccggatcatgcagcgcggcctgctggggcggtcccaggtgggcgtgggggtcttccaggagaacgtgttccacaccatgtggcacgtgacgcgcggcgccgtcctcatgtaccaggggaagcggctggagcccagctgggcgtccgtgaagaaggacctgatcagctacggcggcgggtggcgcctccagggctcctggaacaccggggaggaggtgcaggtcatcgccgtggagcccggcaagaaccccaagaacgtgcagaccgcccccgggaccttcaagacgcccgagggcgaggtcggcgccatcgccctggacttcaagcccgggaccagcggctcccccatcgtgaaccgggaggggaagatcgtgggcctgtacggcaacggggtcgtgaccaccagcggcacgtacgtgagcgcgatcgcccaggccaaggcctcccaggaggggccgctccccgagatcgaggacgaggtcttccgcaagcggaacctgaccatcatggacctgcaccccggcagcgggaagacccgccggtacctcccggcgatcgtgcgcgaggccatcaagcgcaagctgcggaccctgatcctcgcccccacgcgcgtggtcgcctccgagatggccgaggcgctgaagggcatgcccatccggtaccagaccaccgccgtcaagagcgagcacaccggcaaggagatcgtggacctgatgtgccacgccacgttcaccatgcgcctcctgtcccccgtccgggtgccgaactacaacatgatcatcatggacgaggcccacttcaccgaccccagctccatcgccgcgcgcgggtacatcagcacccgggtgggcatgggggaggccgccgccatcttcatgacggccacgccgcccggctccgtcgaggcgttcccgcagagcaacgccgtgatccaggacgaggagcgcgacatccccgagcggtcctggaacagcgggtacgagtggatcaccgacttccccggcaagaccgtgtggttcgtcccctccatcaagagcggcaacgacatcgccaactgcctgcgcaagaacgggaagcgggtgatccagctctcccgcaagacgttcgacaccgagtaccagaagaccaagaacaacgactgggactacgtggtcaccacggacatcagcgagatgggcgccaacttccgggcggaccgcgtgatcgacccgcggcgctgcctgaagcccgtgatcctgaaggacgggcccgagcgggtcatcctcgccggccccatgccggtgaccgtcgcctccgccgcccagcgccgggggcgcatcggccgcaaccacaacaaggagggcgaccagtacatctacatggggcagcccctgaacaacgacgaggaccacgcgcactggaccgaggccaagatgctgctcgacaacatcaacacccccgagggcatcatccccgccctgttcgagccggagcgggagaagtccgccgccatcgacggggagtaccgcctgcggggcgaggcgcgcaagacgttcgtggagctcatgcggcgcggggacctgcccgtgtggctgtcctacaaggtcgccagcgagggcttccagtacagcgaccggcgctggtgcttcgacggcgagcggaacaaccaggtgctcgaggagaacatggacgtggagatctggaccaaggagggggagcgcaagaagctgcggccccgctggctggacgcccggacctactccgaccccctcgccctgcgcgagttcaaggagttcgccgcgggccggcgcagcgtctccggggacctgatcctcgagatcggcaagctgccgcagcacctgacccagcgggcccagaacgccctcgacaacctggtgatgctgcacaacagcgagcagggcgggcgcgcctaccggcacgcgatggaggagctccccgacacgatcgagaccctgatgctgctcgccctgatcgccgtgctgaccggcggggtcaccctcttcttcctgtccggccgcgggctgggcaagaccagcatcggcctcctgtgcgtgatggcctccagcgtgctgctctggatggcctccgtcgagccccactggatcgcggccagcatcatcctggagttcttcctgatggtgctcctgatccccgagccggaccggcagcgcacgccccaggacaaccagctggcctacgtggtcatcgggctcctgttcatgatcctgaccgtggccgccaacgagatgggcctcctggagaccaccaagaaggacctggggatcggccacgtggcggtcgagaaccaccaccacgccgccatgctcgacgtggacctgcaccccgcctccgcctggacgctgtacgcggtggccaccaccatcatcaccccgatgatgcgccacacgatcgagaacaccaccgccaacatcagcctcaccgccatcgccaaccaggcggccatcctgatggggctggacaagggctggcccatctccaagatggacatcggcgtccccctcctggccctggggtgctacagccaggtgaaccccctcacgctgaccgccgcggtgctgatgctcgtcgcccactacgccatcatcggcccggggctgcaggccaaggccacccgggaggcgcagaagcgcaccgccgccggcatcatgaagaaccccacggtggacgggatcgtggccatcgacctggaccccgtcgtgtacgacgccaagttcgagaagcagctcggccagatcatgctgctgatcctctgcacctcccagatcctgctgatgcggaccacctgggcgctctgcgagagcatcacgctggccaccggccccctgaccaccctctgggaggggtccccgggcaagttctggaacacgaccatcgccgtgagcatggccaacatcttccgcgggtcctacctggccggcgcgggcctggccttcagcctcatgaagtccctcgggggcgggcggcgcgggaccggggcccagggcgagaccctgggcgagaagtggaagcggcagctcaaccagctgtccaagagcgagttcaacacgtacaagcgctccgggatcatggaggtcgaccggagcgaggccaaggagggcctgaagcgcggggagaccaccaagcacgcggtgtcccggggcaccgccaagctccgctggttcgtggagcggaacctggtcaagcccgaggggaaggtgatcgacctgggctgcggccgcgggggctggagctactactgcgccgggctgaagaaggtgacggaggtcaagggctacaccaagggcggccccggccacgaggagcccatcccgatggccacctacgggtggaacctcgtgaagctgcactccggcaaggacgtgttcttcatcccgcccgagaagtgcgacaccctgctctgcgacatcggggagagctcccccaacccgacgatcgaggagggccggaccctgcgcgtcctgaagatggtggagccctggctccgggggaaccagttctgcatcaagatcctgaacccctacatgcccagcgtggtcgagaccctggagcagatgcagcgcaagcacggcggcatgctcgtgcggaacccgctgtcccgcaacagcacccacgagatgtactgggtgtcctgcgggaccggcaacatcgtcagcgccgtgaacatgacgtcccgcatgctgctcaaccggttcaccatggcgcaccgcaagcccacctacgagcgggacgtggacctgggggccggcacccgccacgtcgccgtggagcccgaggtggccaacctggacatcatcggccagcggatcgagaacatcaagcacgagcacaagagcacgtggcactacgacgaggacaacccctacaagacctgggcctaccacgggtcctacgaggtcaagccgagcggctccgcgagcagcatggtgaacggggtcgtgaagctcctgaccaagccctgggacgtgatccccatggtcacccagatcgccatgacggacaccacccccttcggccagcagcgcgtgttcaaggagaaggtggacacccggacgccgaaggccaagcgcgggaccgcccagatcatggaggtcaccgccaagtggctgtggggcttcctctcccggaacaagaagccccgcatctgcacccgggaggagttcacgcgcaaggtgcggagcaacgcggccatcggcgccgtgttcgtcgacgagaaccagtggaactccgccaaggaggcggtggaggacgagcgcttctgggacctggtgcaccgggagcgcgagctgcacaagcaggggaagtgcgcgacctgcgtctacaacatgatgggcaagcgggagaagaagctcggggagttcggcaaggccaaggggagccgcgccatctggtacatgtggctgggcgcccggttcctggagttcgaggcgctcggcttcatgaacgaggaccactggttctcccgcgagaacagcctgtccggggtggagggcgaggggctgcacaagctcggctacatcctgcgggacatcagcaagatccccgggggcaacatgtacgccgacgacaccgccggctgggacacccgcatcacggaggacgacctgcagaacgaggcccgcatcaccgacatcatggagccggagcacgccctcctggcgaagtccatcttcaagctgacctaccagaacaaggtggtccgggtgcagcgccccgccaagaacgggaccgtgatggacgtcatcagccggcgcgaccagcggggctccggccaggtggggacgtacggcctcaacaccttcaccaacatggaggcccagctgatccgccagatggagagcgaggggatcttctcccccagcgagctggagacccccaacctcgccgagcgggtgctggactggctggagaagtacggcgtcgagcgcctcaagcggatggccatctccggggacgactgcgtggtgaagccgatcgacgaccgcttcgcgacggccctgaccgccctgaacgacatgggcaaggtccggaaggacatcccccagtgggagcccagcaaggggtggaacgactggcagcaggtccccttctgctcccaccacttccaccagctcatcatgaaggacggccgcgagatcgtggtcccgtgccggaaccaggacgagctggtgggccgcgcccgggtgagccagggggccggctggagcctgcgcgagaccgcgtgcctcgggaagtcctacgcccagatgtggcagctgatgtacttccaccggcgcgacctgcggctcgccgccaacgcgatctgcagcgccgtccccgtggactggatccccacctcccgcacgacctggagcatccacgcccaccaccagtggatgaccaccgaggacatgctgtccgtgtggaaccgcgtctggatcgaggagaacccctggatggaggacaagacgcacatcagctcctggggcgacgtgccgtacctggggaagcgggaggaccagtggtgcggcagcctcatcggcctgaccgcccgcgccacctgggcgaccaacatccaggtggccatcaaccaggtccggcgcctgatcgggaacgagaactacctcgactacatgacctccatgaagcggttcaagaacgagagcgaccccgagggcgccctgtggtga

SEQ ID NO: 8403 - RNA, 9879 nt, synthetic construct
  misc_feature 1..9879: note = derived and/or modified CDS sequence (opt1) from DENV-1__FJ410232__SS-prME
  source 1..9879: mol_type = other RNA
agcgtgaccatgctgctcatgctgatgcccaccgccctggccttccacctcaccacccgcggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccaccccgggttcacggtgaccgccctgttcctggcgcacgccatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgcggtgctgcggaagctctgcatcgaggccaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgcgaccatcacgccccaggcccccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgcgaagaagcaggaggtcgtggtgctcggcagccaggagggcgccatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggcggagacccagcacggcaccgtgctggtccagatcaagtacgagggcaccgacgccccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccacggcccgcggggcccggcgcatggcgatcctgggcgacaccgcctgggacttcgggtccatcggcggcgtgttcaccagcgtcgggaagctggtgcaccagatcttcggcaccgcctacggggtcctcttctccggcgtcagctggacgatgaagatcgggatcggcgtgctgctgacctggctcggcctgaactcccgcagcacctccctgagcatgacctgcatcgccgtggggctcgtcacgctgtacctgggcgtgatggtgcaggccgactccgggtgcgtcatcaactggaagggccgggagctcaagtgcgggagcggcatcttcgtgaccaacgaggtgcacacctggaccgagcagtacaagttccaggcggacagcccgaagcgcctgtccgccgccatcggcaaggcctgggaggagggggtctgcggcatccggagcgccacccgcctggagaacatcatgtggaagcagatctccaacgagctcaaccacatcctgctggagaacgacatgaagctcacggtggtggtcggggacgtggcgggcatcctggggcagggcaagaagatgatccggccccagcccatggagtacaagtacagctggaagtcctggggcaaggccaagatcatcggggccgacgcccagaacaccaccttcatcatcgacggccccaacaccccggagtgccccgacgaccagcgcgcgtggaacatctgggaggtggaggactacgggttcggcatcttcacgaccaacatctggctgaagctccgggacagctacacccaggtctgcgaccaccgcctgatgtccgccgccatcaaggacagcaaggccgtgcacgccgacatgggctactggatcgagtccgagaagaacgagacctggaagctggcgcgggccagcttcatcgaggtgaagacgtgcatctggcccaagtcccacaccctctggagcaacggggtcctggagtccgagatgatcatccccaagatctacggcgggccgatcagccagcacaactaccgccccggctacttcacccagaccgccgggccctggcacctgggcaagctcgagctggacttcgacctgtgcgagggcacgaccgtggtggtcgacgagcactgcgggaaccggggcccgtccctccgcaccaccacggtgaccgggaagatcatccacgagtggtgctgccggagctgcaccctgccgcccctgcgcttccggggcgaggacgggtgctggtacggcatggagatccgccccgtgaaggagaaggaggagaacctcgtcaagtccatggtgagcgccggcagcggggaggtggactccttcagcctgggcctgctctgcatctccatcatgatcgaggaggtcatgcggagccgctggtcccggaagatgctgatgaccgggacgctggccgtgttcttcctcctgatcatgggccagctgacctggaacgacctcatccgcctgtgcatcatggtgggggcgaacgccagcgaccgcatgggcatgggcaccacctacctggccctcatggccacgttcaagatgcggccgatgttcgccgtcgggctgctgttccgccggctcacctcccgcgaggtgctgctgctcaccatcggcctgagcctggtggcgtccgtcgagctccccaacagcctggaggagctgggggacggcctcgccatgggcatcatgatcctgaagctgctcaccgacttccagtcccaccagctgtgggccacgctgctcagcctgaccttcatcaagaccaccttctccctgcactacgcctggaagacgatggcgatggtgctcagcatcgtctccctgttccccctgtgcctcagcaccacctcccagaagaccacgtggctgcccgtgctgctcgggagcctgggctgcaagccgctgaccatgttcctcatcgccgagaacaagatctgggggcggaagtcctggcccctgaacgagggcatcatggccgtggggatcgtcagcatcctgctcagctccctgctgaagaacgacgtgcccctcgccggccccctgatcgccggcgggatgctgatcgcgtgctacgtgatcagcggctccagcgccgacctctccctggagaaggccgccgaggtcagctgggaggaggaggccgagcactccggggcgagccacaacatcctggtggaggtgcaggacgacggcaccatgaagatcaaggacgaggagcgcgacgacaccctcaccatcctgctgaaggccacgctcctggccgtctccggggtgtacccgctgagcatccccgccaccctcttcgtgtggtacttctggcagaagaagaagcagcggtccggcgtcctgtgggacacccccagcccgcccgaggtggagcgcgccgtgctggacgacggcatctaccggatcatgcagcgcgggctgctcggccggtcccaggtcggggtgggcgtgttccaggagaacgtcttccacaccatgtggcacgtgacgcgcggggcggtgctgatgtaccagggcaagcggctggagcccagctgggcctccgtcaagaaggacctcatcagctacggcgggggctggcgcctgcgggggtcctggaacaccggcgaggaggtccaggtgatcgccgtcgagcccgggaagaaccccaagaacgtgcagaccgcccccggcaccttcaagacgcccgagggcgaggtgggggccatcgcgctggacttcaagcccggcaccagcgggtcccccatcgtcaaccgcgagggcaagatcgtgggcctctacgggaacggcgtggtcaccaccagcgggacgtacgtgagcgccatcgcccaggccaaggcgtcccaggagggcccgctgcccgagatcgaggacgaggtgttccggaagcgcaacctgaccatcatggacctccaccccgggagcggcaagacccggcgctacctgccggccatcgtccgggaggccatcaagcgcaagctgcgcaccctcatcctggcccccacgcgggtggtggcctccgagatggcggaggccctgaagggcatgcccatccgctaccagaccaccgccgtcaagagcgagcacaccgggaaggagatcgtggacctcatgtgccacgccacgttcaccatgcggctgctgtcccccgtgcgcgtcccgaactacaacatgatcatcatggacgaggcccacttcaccgaccccagctccatcgcggcccggggctacatcagcacccgcgtggggatgggcgaggccgccgccatcttcatgacggcgacgccgcccgggtccgtggaggccttcccgcagagcaacgccgtcatccaggacgaggagcgggacatccccgagcgctcctggaacagcggctacgagtggatcaccgacttccccggcaagaccgtgtggttcgtgccctccatcaagagcgggaacgacatcgccaactgcctccggaagaacggcaagcgcgtcatccagctgtcccggaagacgttcgacaccgagtaccagaagaccaagaacaacgactgggactacgtggtgaccacggacatcagcgagatgggggcgaacttccgcgccgaccgggtcatcgacccgcgccggtgcctgaagcccgtgatcctcaaggacggccccgagcgcgtgatcctggccgggcccatgccggtcaccgtggcctccgccgcgcagcggcgcggccggatcggccgcaaccacaacaaggagggggaccagtacatctacatgggccagcccctgaacaacgacgaggaccacgcccactggaccgaggccaagatgctcctggacaacatcaacacccccgaggggatcatccccgccctgttcgagccggagcgcgagaagtccgccgcggtcgacggcgagtaccggctccgcggggaggcccggaagacgttcgtggagctgatgcgccggggcgacctgcccgtgtggctctcctacaaggtcgccagcgagggcttccagtacagcgaccgccggtggtgcttcgacggggagcgcaacaaccaggtgctggaggagaacatggacgtggagatctggaccaaggagggcgagcggaagaagctgcgcccccggtggctcgacgcccgcacctactccgaccccctggccctgcgggagttcaaggagttcgcggccgggcgccggagcgtctccggcgacctcatcctggagatcggcaagctgccgcagcacctcacccagcgcgcccagaacgccctggacaacctggtgatgctccacaacagcgagcagggcgggcgggcgtaccgccacgccatggaggagctgcccgacacgatcgagaccctgatgctcctggccctgatcgccgtgctcaccgggggcgtcaccctgttcttcctgtccgggcggggcctcggcaagaccagcatcgggctgctgtgcgtgatggcctccagcgtgctcctgtggatggcgtccgtcgagccccactggatcgccgccagcatcatcctggagttcttcctcatggtgctgctgatccccgagccggaccgccagcggacgccccaggacaaccagctcgcctacgtggtcatcggcctgctgttcatgatcctcaccgtggccgcgaacgagatggggctgctggagaccaccaagaaggacctcggcatcgggcacgtggccgtcgagaaccaccaccacgccgccatgctggacgtggacctgcaccccgcctccgcgtggacgctctacgccgtggccaccaccatcatcaccccgatgatgcgccacacgatcgagaacaccaccgccaacatcagcctgaccgccatcgcgaaccaggccgccatcctgatgggcctcgacaagggctggcccatctccaagatggacatcggggtccccctgctggccctcggctgctacagccaggtgaaccccctgacgctgaccgcggccgtgctcatgctggtcgcccactacgccatcatcgggccgggcctgcaggccaaggcgacccgcgaggcccagaagcggaccgccgccgggatcatgaagaaccccacggtggacggcatcgtggccatcgacctcgaccccgtcgtgtacgacgcgaagttcgagaagcagctgggccagatcatgctgctcatcctgtgcacctcccagatcctgctcatgcgcaccacctgggccctgtgcgagagcatcacgctggccaccgggcccctcaccaccctgtgggagggctccccggggaagttctggaacacgaccatcgccgtgagcatggccaacatcttccggggctcctacctggcgggcgccgggctcgccttcagcctgatgaagtccctgggcgggggccgccgggggaccggcgcccagggcgagaccctcggggagaagtggaagcgccagctgaaccagctgtccaagagcgagttcaacacgtacaagcggtccggcatcatggaggtcgaccgcagcgaggcgaaggaggggctcaagcggggcgagaccaccaagcacgccgtgtcccgcgggaccgccaagctgcggtggttcgtggagcgcaacctggtcaagcccgagggcaaggtgatcgacctgggctgcgggcggggcgggtggagctactactgcgccggcctcaagaaggtgacggaggtcaaggggtacaccaagggcggccccgggcacgaggagcccatcccgatggccacctacggctggaacctggtgaagctgcactccgggaaggacgtgttcttcatcccgcccgagaagtgcgacaccctcctgtgcgacatcggcgagagctcccccaacccgacgatcgaggaggggcgcaccctgcgggtcctcaagatggtggagccctggctgcgcggcaaccagttctgcatcaagatcctgaacccctacatgcccagcgtggtcgagaccctcgagcagatgcagcggaagcacggcgggatgctggtgcgcaacccgctgtcccggaacagcacccacgagatgtactgggtgtcctgcggcaccgggaacatcgtcagcgcggtgaacatgacgtcccgcatgctcctgaaccgcttcaccatggcccaccggaagcccacctacgagcgcgacgtggacctgggcaccggcacgcggcacgtcgccgtggagcccgaggtggccaacctcgacatcatcgggcagcgcatcgagaacatcaagcacgagcacaagagcacctggcactacgacgaggacaacccctacaagacctgggcctaccacggctcctacgaggtcaagccgagcgggtccgcgagcagcatggtgaacggcgtcgtgaagctgctgaccaagccctgggacgtgatccccatggtcacgcagatcgccatgaccgacaccacccccttcgggcagcagcgggtgttcaaggagaaggtggacacgcgcaccccgaaggccaagcggggcaccgcccagatcatggaggtcaccgcccgctggctctggggcttcctgtcccggaacaagaagccccgcatctgcacgcgggaggagttcacccgcaaggtgcggagcaacgcggccatcggggccgtgttcgtcgacgagaaccagtggaactccgccaaggaggcggtggaggacgagcgcttctgggacctggtgcaccgggagcgcgagctccacaagcagggcaagtgcgcgacctgcgtctacaacatgatggggaagcgggagaagaagctgggcgagttcgggaaggccaagggcagccgcgccatctggtacatgtggctgggcgcccggttcctcgagttcgaggcgctggggttcatgaacgaggaccactggttctcccgcgagaacagcctgtccggcgtggagggggagggcctccacaagctggggtacatcctgcgggacatcagcaagatccccggcggcaacatgtacgccgacgacaccgccgggtgggacacgcgcatcaccgaggacgacctccagaacgaggccaagatcaccgacatcatggagccggagcacgccctgctggcgaaggccatcttcaagctcacctaccagaacaaggtggtccgcgtgcagcggcccgccaagaacggcacggtgatggacgtcatctcccgccgggaccagcgcgggagcggccaggtgggcacctacgggctgaacaccttcaccaacatggaggcccagctgatccggcagatggagtccgagggcatcttcagcccctccgagctcgagacgcccaacctggccgagcgcgcgctggactggctcgagaagtacggggtggagcggctgaagcgcatggccatcagcggcgacgactgcgtcgtgaagccgatcgacgaccggttcgccaccgccctgaccgccctcaacgacatggggaaggtgcgcaaggacatcccccagtgggagccctccaagggctggaacgactggcagcaggtccccttctgcagccaccacttccaccagctgatcatgaaggacggccgggagatcgtggtgccgtgccgcaaccaggacgagctggtcgggcgggcgcgcgtgtcccagggcgccgggtggagcctccgggagaccgcctgcctgggcaagagctacgcccagatgtggcagctgatgtacttccaccgccgggacctccgcctggcggccaacgccatctgctccgccgtgcccgtcgactgggtgcccacgagccggaccacctggtccatccacgcccaccaccagtggatgaccacggaggacatgctgagcgtgtggaaccgcgtctggatcgaggagaacccctggatggaggacaagacccacatctccagctgggaggacgtgccgtacctcgggaagcgcgaggaccagtggtgcggctccctgatcggcctgaccgcgcgggccacctgggccaccaacatccaggtggccatcaaccaggtccgccggctcatcgggaacgagaactacctggactacatgacgagcatgaagcgcttcaagaacgagtccgaccccgagggcgccctgtggtga

SEQ ID NO: 8404 - RNA, 9879 nt, synthetic construct
  misc_feature 1..9879: note = derived and/or modified CDS sequence (opt1) from DENV-1__FJ461327__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgagaccgagcccgacgacgtggactgctggtgcaacgccacggacacctgggtgacctacgggacctgcagccagacgggcgagcaccggcgcgacaagcggtccgtggccctcgcgccccacgtgggcctggggctggagacccgcaccgagacctggatgagctccgagggcgcgtggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtcgggaagctggtgcaccagatcttcggcaccgcctacggggtgctgttctccggcgtcagctggacgatgaagatcgggatcggcgtgctgctgacctggctcggcctgaactcccgcagcacctccctgagcatgacctgcatcgccgtggggctcgtcacgctgtacctgggcgtgatggtgcaggccgactccgggtgcgtcatcaactggaagggccgggagctcaagtgcgggagcggcatcttcgtgaccaacgaggtgcacacctggaccgagcagtacaagttccaggccgacagcccgaagcgcctgtccgcggccatcggcaaggcctgggaggagggggtctgcggcatccggagcgccacccgcctggagaacatcatgtggaagcagatctccaacgagctcaaccacatcctgctggagaacgacatgaagttcacggtggtggtcggggacgtggccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtcgaggactacggcttcgggatcttcacgaccaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacgtgcatctggcccaagtcccacaccctgtggagcaacggcgtgctcgagtccgagatgatcatccccaagatctacgggggcccgatcagccagcacaactaccgccccgggtacttcacccaggccgccggcccctggcacctggggaagctggagctcgacttcgacctgtgcgagggcaccacggtggtcgtggacgagcactgcggcaaccgggggccgtccctgcgcaccaccaccgtgacgggcaagatcatccacgagtggtgctgccggagctgcaccctgccgcccctccgcttccgcggggaggacggctgctggtacgggatggagatccgccccgtcaaggagaaggaggagaacctggtgaagtccatggtgagcgccggcagcggcgaggtcgactccttcagcctcgggctgctgtgcatctccatcatgatcgaggaggtgatgcggagccgctggtcccggcgcatgctcatgaccggcaccctggccgtgttcttcctgctcatcatggggcagctgacgtggaacgacctgatccgcctctgcatcatggtcggcgcgaacgccagcgaccggatggggatgggcaccacctacctggccctgatggccaccttcaagatgcgcccgatgttcgccgtgggcctcctgttccggcgcctgacgtcccgggaggtgctcctgctgaccatcgggctcagcctggtcgcgtccgtggagctgcccaacagcctcgaggagctgggcgacgggctggccatgggcatcatgatcctcaagctgctgaccgacttccagtcccaccagctctgggccaccctgctgagcctcacgttcatcaagaccaccttctccctgcactacgcctggaagaccatggcgatggtcctgagcatcgtgtccctcttccccctgtgcctgagcacgacctcccagaagaccacctggctccccgtgctgctgggcagcctcgggtgcaagccgctgacgatgttcctgatcgccgagaacaagatctggggccgccggtcctggcccctcaacgaggggatcatggccgtcggcatcgtgagcatcctgctgagctccctcctgaagaacgacgtgcccctggccgggcccctcatcgccggcggcatgctgatcgcgtgctacgtcatcagcgggtccagcgccgacctgtccctcgagaaggccgccgaggtgagctgggaggaggaggccgagcactccggcgcgagccacaacatcctggtggaggtccaggacgacgggaccatgaagatcaaggacgaggagcgcgacgacaccctgaccatcctcctgaaggccaccctgctcgccgtgtccggcgtgtacccgctgagcatccccgccacgctgttcgtctggtacttctggcagaagaagaagcagcggtccggggtgctctgggacacccccagcccgcccgaggtggagcgcgccgtcctggacgacggcatctaccggatcatgcagcgcggcctgctggggcggtcccaggtgggcgtgggggtcttccaggagaacgtgttccacaccatgtggcacgtgacccgcggcgcggtcctcatgtaccaggggaagcggctggagcccagctgggcctccgtgaagaaggacctgatcagctacggcggcgggtggcgcctccagggctcctggaacacgggggaggaggtgcaggtcatcgccgtggagcccggcaagaaccccaagaacgtgcagaccgcccccgggaccttcaagacccccgagggcgaggtcggcgccatcgcgctggacttcaagcccgggacgagcggctcccccatcgtgaaccgggaggggaagatcgtgggcctgtacggcaacggggtcgtgaccaccagcggcacctacgtgagcgccatcgcccaggccaaggcgtcccaggaggggccgctccccgagatcgaggacgaggtcttccgcaagcggaacctgacgatcatggacctgcaccccggcagcgggaagacccgccggtacctcccggccatcgtgcgcgaggccatcaagcgcaagctgcggaccctgatcctcgcccccacccgcgtggtcgcctccgagatggcggaggccctgaagggcatgcccatccggtaccagacgaccgccgtcaagagcgagcacaccggcaaggagatcgtggacctgatgtgccacgccaccttcacgatgcgcctcctgtcccccgtccgggtgccgaactacaacatgatcatcatggacgaggcccacttcaccgaccccagctccatcgcggcccgcgggtacatcagcacccgggtgggcatgggggaggccgccgccatcttcatgaccgcgacgccgcccggctccgtcgaggccttcccgcagagcaacgccgtgatccaggacgaggagcgcgacatccccgagcggtcctggaacagcgggtacgagtggatcaccgacttccccggcaagaccgtgtggttcgtcccctccatcaagagcggcaacgacatcgccaactgcctgcgcaagaacgggaagcgggtgatccagctctcccgcaagaccttcgacacggagtaccagaagaccaagaacaacgactgggactacgtggtcaccaccgacatcagcgagatgggcgcgaacttccgggccgaccgcgtgatcgacccgcggcgctgcctgaagcccgtgatcctgaaggacgggcccgagcgggtcatcctcgccggccccatgccggtgacggtcgcctccgccgcgcagcgccgggggcgcatcggccgcaaccacaacaaggagggcgaccagtacatctacatggggcagcccctgaacaacgacgaggaccacgcccactggaccgaggccaagatgctgctcgacaacatcaacacccccgagggcatcatccccgccctgttcgagccggagcgggagaagtccgccgcgatcgacggggagtaccgcctgcggggcgaggcccgcaagaccttcgtggagctcatgcggcgcggggacctgcccgtgtggctgtcctacaaggtcgccagcgagggcttccagtacagcgaccggcgctggtgcttcgacggcgagcggaacaaccaggtgctcgaggagaacatggacgtggagatctggacgaaggagggggagcgcaagaagctgcggccccgctggctggacgcccggacctactccgaccccctcgccctgcgcgagttcaaggagttcgcggccggccggcgcagcgtctccggggacctgatcctcgagatcggcaagctgccgcagcacctgacccagcgggcccagaacgccctcgacaacctggtgatgctgcacaacagcgagcagggcgggcgcgcgtaccggcacgccatggaggagctccccgacaccatcgagacgctgatgctgctcgccctgatcgccgtgctgaccggcggggtcaccctcttcttcctgtccggccgcgggctgggcaagaccagcatcggcctcctgtgcgtgatggcctccagcgtgctgctctggatggcgtccgtcgagccccactggatcgccgccagcatcatcctggagttcttcctgatggtgctcctgatccccgagccggaccggcagcgcacgccccaggacaaccagctggcctacgtggtcatcgggctcctgttcatgatcctgacggtggccgcgaacgagatgggcctcctggagaccaccaagaaggacctggggatcggccacgtggccgtcgagaaccaccaccacgccgccatgctcgacgtggacctgcaccccgcctccgcgtggaccctgtacgccgtggccacgaccatcatcaccccgatgatgcgccacaccatcgagaacacgaccgccaacatcagcctcaccgccatcgcgaaccaggccgccatcctgatggggctggacaagggctggcccatctccaagatggacatgggcgtccccctcctggccctggggtgctacagccaggtgaaccccctcaccctgacggcggccgtgctgatgctcgtcgcccactacgccatcatcggcccggggctgcaggccaaggcgacccgggaggcccagaagcgcaccgccgccggcatcatgaagaaccccaccgtggacgggatcgtggccatcgacctggaccccgtcgtgtacgacgcgaagttcgagaagcagctcggccagatcatgctgctgatcctctgcacgtcccagatcctgctgatgcggaccacctgggccctctgcgagagcatcaccctggccacgggccccctgaccaccctctgggaggggtccccgggcaagttctggaacaccacgatcgccgtgagcatggccaacatcttccgcgggtcctacctggcgggcgccggcctggccttcagcctcatgaagtccctcgggggcgggcggcgcgggaccggggcccagggcgagaccctgggcgagaagtggaagcggcagctcaaccagctgtccaagagcgagttcaacacctacaagcgctccgggatcatggaggtcgaccggagcgaggcgaaggagggcctgaagcgcggggagacgaccaagcacgccgtgtcccggggcaccgccaagctccgctggttcgtggagcggaacctggtcaagcccgaggggaaggtgatcgacctgggctgcggccgcgggggctggagctactactgcgccgggctgaagaaggtgaccgaggtcaagggctacacgaagggcggccccggccacgaggagcccatcccgatggccacctacgggtggaacctcgtgaagctgcactccggcaaggacgtgttcttcatcccgcccgagaagtgcgacaccctgctctgcgacatcggggagagctcccccaacccgaccatcgaggagggccggacgctgcgcgtcctgaagatggtggagccctggctccgggggaaccagttctgcatcaagatcctgaacccctacatgcccagcgtggtcgagaccctggagcagatgcagcgcaagcacggcggcatgctcgtgcggaacccgctgtcccgcaacagcacccacgagatgtactgggtgtcctgcgggaccggcaacatcgtcagcgcggtgaacatgacctcccgcatgctgctcaaccggttcacgatggcccaccgcaagcccacctacgagcgggacgtggacctgggggccggcacccgccacgtcgccgtggagcccgaggtggccaacctggacatcatcggccagcggatcgagaacatcaagcacgagcacaagagcacctggcactacgacgaggacaacccctacaagacgtgggcgtaccacgggtcctacgaggtcaagccgagcggctccgccagcagcatggtgaacggggtcgtgaagctcctgaccaagccctgggacgtgatccccatggtcacccagatcgccatgaccgacacgacccccttcggccagcagcgcgtgttcaaggagaaggtggacacccggaccccgaaggccaagcgcgggacggcccagatcatggaggtcaccgcgaagtggctgtggggcttcctctcccggaacaagaagccccgcatctgcacccgggaggagttcacccgcaaggtgcggagcaacgccgccatcggcgccgtgttcgtcgacgagaaccagtggaactccgcgaaggaggccgtggaggacgagcgcttctgggacctggtgcaccgggagcgcgagctgcacaagcaggggaagtgcgccacgtgcgtctacaacatgatgggcaagcgggagaagaagctcggggagttcggcaaggccaaggggagccgcgccatctggtacatgtggctgggcgcgcggttcctggagttcgaggccctcggcttcatgaacgaggaccactggttctcccgcgagaacagcctgtccggggtggagggcgaggggctgcacaagctcggctacatcctgcgggacatcagcaagatccccgggggcaacatgtacgccgacgacaccgccggctgggacacccgcatcaccgaggacgacctgcagaacgaggcccgcatcacggacatcatggagccggagcacgcgctcctggccaagtccatcttcaagctgacctaccagaacaaggtggtccgggtgcagcgccccgccaagaacgggaccgtgatggacgtcatcagccggcgcgaccagcggggctccggccaggtggggacctacggcctcaacacgttcaccaacatggaggcccagctgatccgccagatggagagcgaggggatcttctcccccagcgagctggagacccccaacctcgccgagcgggtgctggactggctggagaagtacggcgtcgagcgcctcaagcggatggcgatctccggggacgactgcgtggtgaagccgatcgacgaccgcttcgccaccgccctgacggccctgaacgacatgggcaaggtccggaaggacatcccccagtgggagcccagcaaggggtggaacgactggcagcaggtccccttctgctcccaccacttccaccagctcatcatgaaggacggccgcgagatcgtggtcccgtgccggaaccaggacgagctggtgggccgcgcccgggtgagccagggggcgggctggagcctgcgcgagaccgcctgcctcgggaagtcctacgcccagatgtggcagctgatgtacttccaccggcgcgacctgcggctcgccgcgaacgccatctgcagcgccgtccccgtggactggatccccacctcccgcaccacgtggagcatccacgcccaccaccagtggatgaccaccgaggacatgctgtccgtgtggaaccgcgtctggatcgaggagaacccctggatggaggacaagacccacatcagctcctggggcgacgtgccgtacctggggaagcgggaggaccagtggtgcggcagcctcatcggcctgacggcccgcgcgacctgggccaccaacatccaggtggccatcaaccaggtccggcgcctgatcgggaacgagaactacctcgactacatgacctccatgaagcggttcaagaacgagagcgaccccgagggcgccctgtggtga

SEQ ID NO: 8405 - RNA, 9879 nt, synthetic construct
  misc_feature 1..9879: note = derived and/or modified CDS sequence (opt1) from DENV-1__FJ461328__SS-prME
  source 1..9879: mol_type = other RNA
agcgtgaccatgctgctgatgctgatgcccaccgccctggccttccacctcaccacccggggcggggagccccacatgatcgtcagcaagcaggagcggggcaagagcctgctgttcaagaccagcgccggggtgaacatgtgcaccctcatcgccatggacctgggcgagctgtgcgaggacaccatgacctacaagtgcccccggatcaccgaggccgagcccgacgacgtggactgctggtgcaacgccaccgacacgtgggtcacctacgggacctgcagccagaccggcgagcaccggcgggagaagcggtccgtggccctcgcgccccacgtgggcctggggctggagacgcggaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcctgacgtgcgccaagttcaagtgcgtgaccaagctggagggcaagatcgtccagtacgagaacctcaagtacagcgtgatcgtgaccgtccacaccggcgaccagcaccaggtggggaacgagtccacggagcacggcaccaccgcgaccatcacgccccaggcccccacgaccgagatccagctgaccgactacggggccctgaccctcgactgcagcccccgcacgggcctggacttcaacgagatggtcctgctcaccatgaaggagaagtcctggctggtgcacaagcagtggttcctggacctccccctgccctggaccagcggggccagcacctcccaggagacgtggaaccggcaggacctgctcgtgaccttcaagaccgcccacgcgaagaagcaggaggtcgtggtgctgggcagccaggagggcgccatgcacaccgccctgacgggggccaccgagatccagacctccggcaccacgaccatcttcgccgggcacctcaagtgccgcctgaagatggacaagctgaccctcaagggcatgagctacgtcatgtgcaccgggtccttcaagctggagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctcaagctgagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctcgtgcaccagatcttcggcaccgcctacggggtgctgttctccggcgtcagctggaccatgaagatcgggatcggcgtgctgctcacgtggctgggcctgaactcccgcagcacctccctcagcatgacctgcatcgccgtggggctggtcaccctgtacctcggcgtgatggtgcaggccgactccgggtgcgtcatcaactggaagggccgggagctgaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctcgagaacatcatgtggaagcagatctccaacgagctgaaccacatcctgctcgagaacgacatgaagttcaccgtggtggtcggggacgtggcgggcatcctggtgcaggggaagaagatgatccggccccagcccatggagtacaagtacagctggaagtcctggggcaaggccaagatcatcggcgccgacgtccagaacagcacgttcatcatcgacgggcccaacaccccggagtgccccgacgaccagcgcgcctggaacatctgggaggtggaggactacggcttcgggatcttcaccaccaacatctggctgaagctccgggactcctacacccaggtgtgcgaccaccgcctgatgagcgcggccatcaaggactccaaggccgtccacgccgacatgggctactggatcgagagcgagaagaacgagacctggaagctggcccgggcgtccttcatcgaggtgaagacctgcatctggcccaagagccacaccctctggtccaacggcgtgctggagagcgagatgatcatccccaagatccacgggggcccgatctcccagcacaactaccgccccgggtacttcacgcagaccgccggcccctggcacctggggaagctcgagctggacttcgacctgtgcgagggcaccaccgtcgtggtggacgagcactgcggcaaccgggggccgagcctccgcacgaccaccgtcaccggcaagatcatccacgagtggtgctgccggtcctgcacgctgccgcccctgcgcttccgcggggaggacggctgctggtacgggatggagatccgccccgtgaaggagaaggaggagaacctcgtgaagtccatggtcagcgccggctccggcgaggtggacagcttctccctggggctgctctgcatcagcatcatgatcgaggaggtgatgcggtcccgctggagccggaagatgctgatgaccggcaccctggccgtcttcttcctcctgatcatggggcagctgacctggaacgacctcatccgcctgtgcatcatggtgggcgccaacgcgtccgaccgcatggggatgggcacgacctacctggccctcatggccaccttcaagatgcggccgatgttcgccgtgggcctgctgttccgccggctcaccagccgcgaggtcctgctgctcacgatcgggctgtccctggtggccagcgtcgagctccccaactccctggaggagctgggcgacgggctcgcgatgggcatcatgatcctgaagctgctcaccgacttccagagctaccagctgtgggccaccctgctctccctgaccttcatcaagacgaccttcagcctgcactacgcctggaagaccatggccatggtgctctccatcgtgagcctgttccccctgtgcctctccaccacgagccagaagaccacctggctgcccgtcctgctcggctccctggggtgcaagccgctgaccatgttcctcatcgcggagaacaagatctggggccgcaagagctggcccctgaacgaggggatcatggccgtgggcatcgtgagcatcctgctctccagcctgctgaagaacgacgtccccctcgccgggcccctgatcgccggcggcatgctgatcgcctgctacgtgatctccgggagctccgcggacctcagcctggagaaggccgccgaggtgtcctgggaggaggaggccgagcacagcggcgcctcccacaacatcctggtcgaggtgcaggacgacgggacgatgaagatcaaggacgaggagcgcgacgacaccctcaccatcctgctgaaggcgaccctcctggccgtgagcggcgtctacccgctgtccatccccgccaccctcttcgtgtggcacttctggcagaagaagaagcagcggagcggggtgctgtgggacacgcccagcccgcccgaggtcgagcgcgccgtgctggacgacggcatctaccggatcatgcagcgcggcctgctcgggcggagccaggtgggcgtcggggtgttccaggagaacgtgttccacaccatgtggcacgtcacccgcggcgccgtgctgatgtaccaggggaagcggctggagccctcctgggcgagcgtgaagaaggacctcatctcctacggcggcgggtggcgcttccagggcagctggaacaccggggaggaggtccaggtgatcgccgtggagcccggcaagaaccccaagaacgtccagacggcccccgggaccttcaagacccccgagggcgaggtgggcgccatcgccctggacttcaagcccgggacctccggcagccccatcgtgaaccgggaggggaagatcgtcggcctgtacggcaacggggtggtgacgaccagcggcacctacgtctccgcgatcgcccaggccaaggccagccaggaggggccgctccccgagatcgaggacgaggtgttccgcaagcggaacctgaccatcatggacctgcaccccggctccgggaagacgcgccggtacctcccggcgatcgtgcgcgaggccatcaagcggaagctgcgcaccctgatcctcgcccccacccgcgtcgtggccagcgagatggccgaggcgctgaagggcatgcccatccggtaccagaccacggccgtgaagtccgagcacaccggcaaggagatcgtcgacctgatgtgccacgccaccttcaccatgcgcctcctgagccccgtgcgggtgccgaactacaacatgatcatcatggacgaggcccacttcacggacccctccagcatcgccgcgcgcgggtacatctccacccgggtcggcatgggggaggccgccgccatcttcatgaccgccacgccgcccggcagcatggaggcgttcccgcagtccaacgccgtgatccaggacgaggagcgcgacatccccgagcggagctggaactccgggtacgagtggatcacggacttccccggcaagaccgtgtggttcgtccccagcatcaaggccggcaacgacatcgccaactgcctgcgcaagaacgggaagcgggtgatccagctctcccgcaagaccttcgacaccgagtaccagaagacgaagaacaacgactgggactacgtggtcaccaccgacatcagcgagatgggcgcgaacttccgggccgaccgcgtgatcgacccgcggcgctgcctgaagcccgtgatcctgaaggacgggcccgagcgggtcatcctcgccggccccatgccggtgaccgtcgcctccgccgcgcagcgccgggggcgcatcggccggaaccacaacaaggagggcgaccagtacatctacatggggcagcccctgaacaacgacgaggaccacgcccactggacggaggccaagatgctgctcgacaacatcaacacccccgagggcatcatccccgccctgttcgagccggagcgcgagaagtccgccgcgatcgacggggagtaccgcctgcggggcgaggcccgcaagaccttcgtggagctcatgcggcgcggggacctgcccgtgtggctgtcctacaaggtcgccagcgagggcttccagtacagcgaccggcgctggtgcttcgacggcgagcggaacaaccaggtgctcgaggagaacatggacgtggagatctggaccaaggagggggagcgcaagaagctgcggccccgctggctggacgcccggacgtactccgaccccctcgccctgcgcgagttcaaggagttcgcggccggccggcgcagcgtctccggggacctgatcctcgagatcggcaagctgccgcagcacctgacccagcgggcccagaacgccctcgacaacctggtgatgctgcacaacagcgagcagggcgggcgcgcgtaccggcacgccatggaggagctccccgacaccatcgagaccctgatgctgctcgccctgatcgccgtgctgacgggcggggtcaccctcttcttcctgtccggcaaggggctgggcaagaccagcatcggcctcctgtgcgtgatggcctccagcgtgctgctctggatggcgtccgtcgagccccactggatcgccgccagcatcatcctggagttcttcctgatggtgctcctgatccccgagccggaccgccagcggacgccccaggacaaccagctggcctacgtggtcatcgggctcctgttcatgatcctgaccgtggccgcgaacgagatgggcctcctggagacgaccaagaaggacctggggatcggccacgtggccgtcgagaaccaccaccacgccgccatgctcgacgtggacctgcaccccgcctccgcgtggaccctgtacgccgtggccaccacgatcatcaccccgatgatgcgccacaccatcgagaacaccacggccaacatcagcctcaccgccatcgcgaaccaggccgccatcctgatggggctggacaagggctggcccatctccaagatggacatcggcgtccccctcctggccctggggtgctacagccaggtgaaccccctcaccctgaccgcggccgtgctgatgctcgtcgcccactacgccatcatcggcccggggctgcaggccaaggcgacgcgggaggcccagaagcgcaccgccgccggcatcatgaagaaccccaccatcgacgggatcgtggccatcgacctggaccccgtggtctacgacgcgaagttcgagaagcagctcggccagatcatgctgctgatcctctgcacctcccagatcctgctgatgcgcacgacctgggccctctgcgagagcatcaccctggccaccggccccctgacgaccctctgggaggggtccccgggcaagttctggaacaccaccatcgccgtgagcatggccaacatcttccgggggtcctacctggcgggcgccggcctggccttcagcctcatgaagtccctcgggggcgggcgccgggggacgggggcccagggcgagaccctgggcgagaagtggaagcgccagctcaaccagctgtccaagagcgagttcaacacctacaagcggtccgggatcatggaggtggaccgcagcgaggcgaaggagggcctgaagcgcggggagaccacgaagcacgccgtctcccgcggcaccgccaagctccggtggttcgtggagcgcaacctggtgaagcccgaggggaaggtcatcgacctgggctgcggccgcgggggctggagctactactgcgccgggctgaagaaggtgaccgaggtgaagggctacaccaagggcggccccggccacgaggagcccatcccgatggccacgtacgggtggaacctcgtcaagctgcactccggcaaggacgtgttcttcatcccgcccgagaagtgcgacaccctgctctgcgacatcggggagagctcccccaacccgaccatcgaggagggccgcaccctgcgggtgctgaagatggtcgagccctggctccgcgggaaccagttctgcatcaagatcctgaacccctacatgcccagcgtggtggagacgctggagcagatgcagcggaagcacggcggcatgctcgtccgcaacccgctgtcccggaacagcacccacgagatgtactgggtgtcctgcgggaccggcaacatcgtgagcgcggtcaacatgacctcccgcatgctgctcaaccggttcaccatggcccaccgcaagcccacgtacgagcgcgacgtggacctgggggccggcacccggcacgtggccgtcgagcccgaggtggccaacctggacatcatcggccagcgcatcgagaacatcaagcacgagcacaagagcacctggcactacgacgaggacaacccctacaagacctgggcgtaccacgggtcctacgaggtgaagccgagcggctccgccagcagcatggtcaacggggtggtcaagctcctgacgaagccctgggacgtgatccccatggtgacccagatcgccatgaccgacaccacgcccttcggccagcagcgggtcttcaaggagaaggtggacacccgcaccccgaaggccaagcgggggaccgcccagatcatggaggtgacggcgcgctggctgtggggcttcctctcccggaacaagaagccccgcatctgcacccgggaggagttcacccgcaaggtccggagcaacgccgccatcggcgccgtgttcgtggacgagaaccagtggaactccgcgaaggaggccgtcgaggacgaccgcttctgggacctggtgcaccgggagcgcgagctgcacaagcaggggaagtgcgcgacctgcgtgtacaacatgatgggcaagcgggagaagaagctcggggagttcggcaaggccaaggggagccgcgccatctggtacatgtggctgggcgcgcggttcctggagttcgaggccctcggcttcatgaacgaggaccactggttctcccgcgagaacagcctgtccggggtcgagggcgaggggctgcacaagctcggctacatcctgcgggacatcagcaagatccccgggggcaacatgtacgccgacgacacggccggctgggacacccgcatcaccgaggacgacctgcagaacgaggccaagatcaccgacatcatggagccggagcacgcgctcctggccaagtccatcttcaagctgacgtaccagaacaaggtggtgcgggtccagcgccccgccaagaacgggaccgtgatggacgtgatcagccgccgggaccagcgcggctccgggcaggtcggcacctacggcctcaacaccttcacgaacatggaggcccagctgatccggcagatggagagcgaggggatcttcctgcccaacgagctcgagacccccaacctggccggccgcgtgctggactggctcgagaagtacggggtggagcggctgaagcgcatggcgatctccggcgacgactgcgtcgtgaagccgatcgacgaccggttcgccaccgccctgaccgccctcaacgacatggggaaggtgcgcaaggacatcccccagtgggagcccagcaagggctggaacgactggcagcaggtccccttctgctcccaccacttccaccagctgatcatgaaggacggccgggagatcgtggtgccgtgccgcaaccaggacgagctggtcgggcgggcccgcgtgagccagggcgcggggtggtccctccgggagacggcctgcctgggcaagagctacgcccagatgtggcagctgatgtacttccaccgccgggacctccgcctggccgcgaacgccatctgcagcgccgtgcccgtcgactgggtgcccacctcccggaccacctggagcatccacgcccaccaccagtggatgacgaccgaggacatgctgtccgtgtggaaccgcgtctggatcgaggagaacccctggatggaggacaagacccggatcagctcctgggaggacgtgccgtacctcgggaagcgcgaggaccagtggtgcggcagcctgatcggcctgaccgcccgcgcgacgtgggccaccaacatccaggtggccatcaaccaggtccggcgcctcatcgggaacgagaactactccgactacatgaccagcatgaagcggttcaagaacgagtccgagcccgagggcgccctgtggtga

SEQ ID NO: 8406 - RNA, 9879 nt, synthetic construct
  misc_feature 1..9879: note = derived and/or modified CDS sequence (opt1) from DENV-1__FJ410234__SS-prME
  source 1..9879: mol_type = other RNA
agcgtgaccatgctgctcatgctgatgcccaccgccctggccttccacctcaccacccgcggcggggagccccacatgatcgtgtccaagcaggagcggggcaagagcctgctgttcaagacctccgcgggggtgaacatgtgcaccctcatcgccatggacctgggcgagctgtgcgaggacaccatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtcctcttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggccgactccgggtgcgtcatcaactggaagggccgggagctcaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctggagaacatcatgtggaagcagatctccaacgagctcaaccacatcctgctggagaacgacatgaagctcaccgtggtggtcggggacgtggcgggcatcctggggcagggcaagaagatgatccggccccagcccatggagtacaagtacagctggaagtcctggggcaaggccaagatcatcggggccgacgcccagaacacgaccttcatcatcgacggccccaacaccccggagtgccccgacgaccagcgcgcgtggaacatctgggaggtggaggactacgggttcggcatcttcaccacgaacatctggctgaagctccgggacagctacacccaggtctgcgaccaccgcctgatgtccgccgccatcaaggacagcaaggccgtgcacgccgacatgggctactggatcgagtccgagaagaacgagacctggaagctggcgcgggccagcttcatcgaggtgaagacctgcatctggcccaagtcccacacgctctggagcaacggggtcctggagtccgagatgatcatccccaagatctacggcgggccgatcagccagcacaactaccgccccggctacttcacccagaccgccgggccctggcacctgggcaagctcgagctggacttcgacctgtgcgagggcaccacggtggtggtcgacgagcactgcgggaaccggggcccgtccctccgcaccaccaccgtgacggggaagatcatccacgagtggtgctgccggagctgcaccctgccgcccctgcgcttccggggcgaggacgggtgctggtacggcatggagatccgccccgtgaaggagaaggaggagaacctcgtcaagtccatggtgagcgccggcagcggggaggtggactccttcagcctgggcctgctctgcatctccatcatgatcgaggaggtcatgcggagccgctggtcccggaagatgctgatgaccgggaccctggccgtgttcttcctcctgatcatgggccagctgacgtggaacgacctcatccgcctgtgcatcatggtgggggcgaacgccagcgaccgcatgggcatgggcaccacctacctggccctcatggccaccttcaagatgcggccgatgttcgccgtcgggctgctgttccgccggctcacgtcccgcgaggtgctgctgctcaccatcggcctgagcctggtggcgtccgtcgagctccccagctccctggaggagctgggggacggcctcgccatgggcatcatgatcctgaagctgctcaccgacttccagagccaccagctgtgggccaccctgctctccctgacgttcatcaagaccgccttcagcctgcactacgcgtggaagaccatggccatggtgctctccatcgtcagcctgttccccctgtgcctctccaccacgagccagaagaccacctggctgcccgtgctgctcgggtccctgggctgcaagccgctgaccatgttcctcatcgccgagaacaagatctgggggcggaagtcctggcccctgaacgagggcatcatggccgtggggatcgtcagcatcctgctctccagcctgctgaagaacgacgtgcccctcgccggccccctgatcgcgggcgggatgctgatcgcctgctacgtgatctccggcagctccgccgacctcagcctggagaaggccgccgaggtctcctgggaggaggaggcggagcacagcggggcctcccacaacatcctggtggaggtgcaggacgacggcacgatgaagatcaaggacgaggagcgcgacgacaccctcaccatcctgctgaaggccaccctcctggccgtcagcggggtgtacccgctgtccatccccgccaccctcttcgtgtggtacttctggcagaagaagaagcagcggagcggcgtcctgtgggacacgcccagcccgcccgaggtggagcgcgcggtgctggacgacggcatctaccggatcatgcagcgcgggctgctcggccggagccaggtcggggtgggcgtgttccaggagaacgtcttccacaccatgtggcacgtgacccgcggggccgtgctgatgtaccagggcaagcggctggagccctcctgggccagcgtcaagaaggacctcatctcctacggcgggggctggcgcctgcgggggagctggaacaccggcgaggaggtccaggtgatcgccgtcgagcccgggaagaaccccaagaacgtgcagacggcccccggcaccttcaagacccccgagggcgaggtgggggcgatcgccctggacttcaagcccggcacctccgggagccccatcgtcaaccgcgagggcaagatcgtgggcctctacgggaacggcgtggtcacgaccagcgggacctacgtgtccgccatcgcccaggcgaaggccagccaggagggcccgctgcccgagatcgaggacgaggtgttccggaagcgcaacctgaccatcatggacctccaccccgggtccggcaagacgcggcgctacctgccggccatcgtccgggaggccatcaagcgcaagctgcgcaccctcatcctggcccccacccgggtggtggcgagcgagatggccgaggccctgaagggcatgcccatccgctaccagaccacggccgtcaagtccgagcacaccgggaaggagatcgtggacctcatgtgccacgccaccttcaccatgcggctgctgagccccgtgcgcgtcccgaactacaacatgatcatcatggacgaggcgcacttcacggacccctccagcatcgccgcccggggctacatctccacccgcgtggggatgggcgaggccgccgcgatcttcatgaccgccacgccgcccgggagcgtggaggccttcccgcagtccaacgccgtcatccaggacgaggagcgggacatccccgagcgcagctggaactccggctacgagtggatcacggacttccccggcaagaccgtgtggttcgtgcccagcatcaagtccgggaacgacatcgcgaactgcctccggaagaacggcaagcgcgtcatccagctgagccggaagaccttcgacaccgagtaccagaagacgaagaacaacgactgggactacgtggtgaccaccgacatctccgagatgggggccaacttccgcgccgaccgggtcatcgacccgcgccggtgcctgaagcccgtgatcctcaaggacggccccgagcgcgtgatcctggccgggcccatgccggtcaccgtggccagcgcggcccagcggcgcggccggatcggccgcaaccacaacaaggagggggaccagtacatctacatgggccagcccctgaacaacgacgaggaccacgcccactggacggaggccaagatgctcctggacaacatcaacacccccgaggggatcatccccgccctgttcgagccggagcgcgagaagtccgcggccgtcgacggcgagtaccggctccgcggggaggcccggaagaccttcgtggagctgatgcgccggggcgacctgcccgtgtggctcagctacaaggtcgccagcgagggcttccagtactccgaccgccggtggtgcttcgacggggagcgcaacaaccaggtgctggaggagaacatggacgtggagatctggaccaaggagggcgagcggaagaagctgcgcccccggtggctcgacgcccgcacgtacagcgaccccctggcgctgcgggagttcaaggagttcgccgccgggcgccggtccgtcagcggcgacctcatcctggagatcggcaagctgccgcagcacctcacccagcgcgcccagaacgcgctggacaacctggtgatgctccacaactccgagcagggcgggcgggcctaccgccacgccatggaggagctgcccgacaccatcgagaccctgatgctcctggccctgatcgccgtgctcaccgggggcgtcaccctgttcttcctgagcgggcggggcctcggcaagacctccatcgggctgctgtgcgtgatggcgagctccgtgctcctgtggatggccagcgtcgagccccactggatcgccgcctccatcatcctggagttcttcctcatggtgctgctgatccccgagccggaccgccagcggacgccccaggacaaccagctcgcctacgtggtcatcggcctgctgttcatgatcctcaccgtggcggccaacgagatggggctgctggagacgaccaagaaggacctcggcatcgggcacgtggccgtcgagaaccaccaccacgccgccatgctggacgtggacctgcaccccgcgagcgcctggaccctctacgccgtggccaccacgatcatcaccccgatgatgcgccacaccatcgagaacaccacggccaacatctccctgaccgcgatcgccaaccaggccgccatcctgatgggcctcgacaagggctggcccatcagcaagatggacatcggggtccccctgctggcgctcggctgctactcccaggtgaaccccctgaccctgaccgccgccgtgctcatgctggtcgcccactacgccatcatcgggccgggcctgcaggcgaaggccacgcgcgaggcccagaagcggaccgccgccgggatcatgaagaaccccaccgtggacggcatcgtggcgatcgacctcgaccccgtcgtgtacgacgccaagttcgagaagcagctgggccagatcatgctgctcatcctgtgcaccagccagatcctgctcatgcgcacgacctgggccctgtgcgagtccatcaccctggccaccgggcccctcacgaccctgtgggagggcagcccggggaagttctggaacaccaccatcgccgtgtccatggcgaacatcttccggggcagctacctggccggcgccgggctcgccttcagcctgatgaagtccctgggcgggggccgccgggggacgggcgcgcagggcgagaccctcggggagaagtggaagcgccagctgaaccagctgagcaagtccgagttcaacacctacaagcggagcggcatcatggaggtcgaccgctccgaggccaaggaggggctcaagcggggcgagaccacgaagcacgccgtgagccgcgggaccgccaagctgcggtggttcgtggagcgcaacctggtcaagcccgagggcaaggtgatcgacctgggctgcgggcggggcgggtggtcctactactgcgccggcctcaagaaggtgaccgaggtcaaggggtacaccaagggcggccccgggcacgaggagcccatcccgatggcgacgtacggctggaacctggtgaagctgcacagcgggaaggacgtgttcttcatcccgcccgagaagtgcgacaccctcctgtgcgacatcggcgagtccagccccaacccgaccatcgaggaggggcgcaccctgcgggtcctcaagatggtggagccctggctgcgcggcaaccagttctgcatcaagatcctgaacccctacatgccctccgtggtcgagacgctcgagcagatgcagcggaagcacggcgggatgctggtgcgcaacccgctgagccggaactccacccacgagatgtactgggtgagctgcggcaccgggaacatcgtctccgccgtgaacatgaccagccgcatgctcctgaaccgcttcaccatggcccaccggaagcccacgtacgagcgcgacgtggacctgggcaccggcacccggcacgtcgccgtggagcccgaggtggccaacctcgacatcatcgggcagcgcatcgagaacatcaagcacgagcacaagtccacctggcactacgacgaggacaacccctacaagacgtgggcgtaccacggcagctacgaggtcaagccgtccgggagcgccagctccatggtgaacggcgtcgtgaagctgctgaccaagccctgggacgtgatccccatggtcacccagatcgccatgaccgacacgacccccttcgggcagcagcgggtgttcaaggagaaggtggacacccgcaccccgaaggccaagcggggcacggcccagatcatggaggtcaccgcgcgctggctctggggcttcctgagccggaacaagaagccccgcatctgcacccgggaggagttcacccgcaaggtgcggtccaacgccgccatcggggccgtgttcgtcgacgagaaccagtggaacagcgcgaaggaggccgtggaggacgagcgcttctgggacctggtgcaccgggagcgcgagctccacaagcagggcaagtgcgccacgtgcgtctacaacatgatggggaagcgggagaagaagctgggcgagttcgggaaggccaagggctcccgcgccatctggtacatgtggctgggcgcgcggttcctcgagttcgaggccctggggttcatgaacgaggaccactggttcagccgcgagaactccctgagcggcgtggagggggagggcctccacaagctggggtacatcctgcgggacatctccaagatccccggcggcaacatgtacgccgacgacaccgccgggtgggacacccgcatcaccgaggacgacctccagaacgaggccaagatcacggacatcatggagccggagcacgcgctgctggccaaggccatcttcaagctcacctaccagaacaaggtggtccgcgtgcagcggcccgccaagaacggcaccgtgatggacgtcatcagccgccgggaccagcgcgggtccggccaggtgggcacctacgggctgaacacgttcaccaacatggaggcccagctgatccggcagatggagagcgagggcatcttctcccccagcgagctcgagacccccaacctggcggagcgcgccctggactggctcgagaagtacggggtggagcggctgaagcgcatggccatctccggcgacgactgcgtcgtgaagccgatcgacgaccggttcgccaccgccctgacggcgctcaacgacatggggaaggtgcgcaaggacatcccccagtgggagcccagcaagggctggaacgactggcagcaggtccccttctgctcccaccacttccaccagctgatcatgaaggacggccgggagatcgtggtgccgtgccgcaaccaggacgagctggtcgggcgggcccgcgtgagccagggcgccgggtggagcctccgggagaccgcctgcctgggcaagtcctacgcgcagatgtggcagctgatgtacttccaccgccgggacctccgcctggccgccaacgccatctgcagcgccgtgcccgtcgactgggtgcccacctcccggaccacgtggagcatccacgcgcaccaccagtggatgaccaccgaggacatgctgtccgtgtggaaccgcgtctggatcgaggagaacccctggatggaggacaagacccacatcagctcctgggaggacgtgccgtacctcgggaagcgcgaggaccagtggtgcggcagcctgatcggcctgacggcccgggccacctgggccaccaacatccaggtggccatcaaccaggtccgccggctcatcgggaacgagaactacctggactacatgacctccatgaagcgcttcaagaacgagagcgaccccgagggcgcgctgtggtga

SEQ ID NO: 8407 - RNA, 9879 nt, synthetic construct
  misc_feature 1..9879: note = derived and/or modified CDS sequence (opt1) from DENV-1__FJ410235__SS-prME
  source 1..9879: mol_type = other RNA
agcgtgaccatgctgctcatgctgatgcccaccgccctggccttccacctcacgacccgcggcggggagccccacatgatcgtgagcaagcaggagcggggcaagagcctgctgttcaagaccagcgcgggggtgaacatgtgcaccctcatcgccatggacctgggcgagttctgcgaggacaccatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagaccgtccagtacgagaacctgaagtacagcgtgatcgtgaccgtccacacgggcgaccagcaccaggtggggaacgagtccaccgagcacggcaccaccgcgaccatcacgccccaggcccccagcaccgagatccagctgaccgactacggggccctcaccctggactgcagcccccggacgggcctggacttcaacgagatggtcctcctgaccatgaaggagaagtcctggctggtgcacaagcagtggttcctcgacctgccgctgccctggaccagcggggcctccaccagccaggagacgtggaaccggaaggacctcctggtgaccttcaagaccgcccacgcgaagaagcaggaggtcgtggtgctgggctcccaggagggcgccatgcacaccgccctcacgggggccaccgagatccagaccagcggcaccacgaccatcttcgccgggcacctgaagtgccgcctgaagatggacaagctcaccctgaagggcatgtcctacgtcatgtgcaccgggagcttcaagctggagaaggaggtggcggagacgcagcacggcaccgtgctcgtccagatcaagtacgagggcaccgacgccccctgcaagatccccttctccacccaggacgagaagggggtgacgcagaacggccggctgatcaccaccaacccgatcgtgaccgacaaggagaagcccgtcaacatcgaggccgagccgcccttcggggagagctacatcgtgatcggcgccggcgagaaggcgctgaagctgtcctggttcaagaaggggagctccatcggcaagatgttcgaggccacggcccgcggggcccggcgcatggccatcctcggcgacaccgcgtgggacttcgggagcatcggcggcgtgttcacctccgtcgggaagctggtgcaccagatcttcggcaccgcctacggggtgctgttcagcggcgtctcctggacgatgaagatcgggatcggcgtgctcctgacctggctgggcctcaacagccgctccaccagcctgtccatgacctgcatcgccgtggggctggtcacgctctacctgggcgtgatggtgcaggccgacagcgggtgcgtcatcaactggaagggccgggagctgaagtgcgggagcggcatcttcgtgaccaacgaggtgcacacctggaccgagcagtacaagttccaggccgactccccgaagcgcctcagcgcggccatcggcaaggcctgggaggagggggtctgcggcatccggtccgccacccgcctggagaacatcatgtggaagcagatcagcaacgagctgaaccacatcctcctggagaacgacatgaagttcacggtggtggtcggggacgtggccggcatcctggcgcaggggaagaagatgatccggccccagcccatggagtacaagtactcctggaagtcctggggcaaggccaagatcatcggcgccgacgtgcagaacaccaccttcatcatcgacgggcccaacaccccggagtgccccgacgaccagcgcgcctggaacatctgggaggtcgaggactacggcttcgggatcttcacgaccaacatctggctcaagctgcgggactcctacacccaggtgtgcgaccaccgcctgatgagcgcggccatcaaggactccaaggccgtgcacgccgacatgggctactggatcgagagcgagaagaacgagacctggaagctcgcccgggcgtccttcatcgaggtcaagacgtgcatctggcccaagagccacaccctgtggtccaacggcgtgctggagagcgagatgatcgtgcccaagatctacgggggcccgatctcccagcacaactaccgccccgggtacttcacccagaccgccggcccctggcacctcgggaagctggagctggacttcgacctctgcgagggcacgaccgtcgtggtggacgagcactgcggcaaccgggggccgagcctgcgcaccaccacggtcaccggcaagatcatccacgagtggtgctgccggtcctgcaccctgccgcccctgcgcttcaagggggaggacggctgctggtacgggatggagatccggcccgtgaaggagaaggaggagaacctggtcaagagcatggtcagcgccggctccggcgaggtggacagcttctccctggggctcctgtgcatcagcatcatgatcgaggaggtgatgcgctcccggtggagccgcaagatgctgatgaccggcacgctcgccgtcttcttcctgctgatcatggggcagctcacctggaacgacctgatccggctgtgcatcatggtgggcgccaacgcgtccgaccgcatggggatgggcaccacctacctcgccctgatggccacgttcaagatgcgcccgatgttcgccgtggggctcctgttccggcgcctgaccagccgggaggtcctgctcctgaccatcgggctgtccctcgtggccagcgtcgagctgcccaactccctggaggagctcggcgacgggctggcgatgggcatcatgatcctgaagctcctgaccgacttccagagccaccagctgtgggccacgctcctgtccctgaccttcatcaagaccaccttcagcctccactacgcctggaagacgatggccatggtgctgtccatcgtgagcctgttccccctctgcctgtccaccaccagccagaagaccacgtggctgcccgtcctcctgggctccctggggtgcaagccgctcaccatgttcctgatcgcggagaacaagatctggggccgcaagagctggcccctgaacgaggggatcatggccgtgggcatcgtgagcatcctcctgtccagcctgctcaagaacgacgtccccctggccgggcccctgatcgccggcggcatgctcatcgcctgctacgtgatctccgggagctccgcggacctgagcctggagaaggccgccgaggtgtcctgggaggaggaggccgagcacagcggcgcctcccacaacatcctcgtcgaggtgcaggacgacgggaccatgaagatcaaggacgaggagcgggacgacaccctgaccatcctgctcaaggcgacgctgctggccgtgagcggcgtctacccgctctccatccccgccaccctgttcgtgtggtacttctggcagaagaagaagcagcgcagcggggtgctgtgggacacccccagcccgcccgaggtcgagcgggccgtgctcgacgacggcatctaccgcatcatgcagcggggcctgctggggcgcagccaggtgggcgtcggggtgttccaggagaacgtgttccacaccatgtggcacgtcacgcggggcgccgtgctgatgtaccaggggaagcgcctcgagccctcctgggcgagcgtgaagaaggacctgatctcctacggcggcgggtggcggctgcagggcagctggaacaccggggaggaggtccaggtgatcgccgtggagcccggcaagaaccccaagaacgtccagaccgcccccgggaccttcaagacgtccgagggcgaggtgggcgccatcgccctcgacttcaagcccgggaccagcggcagccccatcgtgaaccgcgaggggaagatcgtcggcctgtacggcaacggggtggtgaccacctccggcacgtacgtcagcgcgatcgcccaggccaaggcctcccaggaggggcccctgccggagatcgaggacgaggtgttccggaagcgcaacctcaccatcatggacctgcaccccggcagcgggaagacccggcgctacctgcccgcgatcgtgcgggaggccatcaagcgcaagctccggaccctgatcctggccccgacgcgcgtcgtggcctccgagatggccgaggcgctcaagggcatgcccatccgctaccagaccaccgccgtcaagagcgagcacaccggcaaggagatcgtcgacctgatgtgccacgccacgttcaccatgcggctgctctcccccgtgcgcgtgcccaactacaacatgatcatcatggacgaggcccacttcaccgacccgagctccatcgccgcgcgggggtacatcagcacccgcgtcggcatgggggaggccgccgccatcttcatgacggccacgccgcccggctccgtggaggcgttcccccagagcaacgccatcatccaggacgaggagcgggacatcccggagcgctcctggaacagcgggtacgagtggatcaccgacttccccggcaagaccgtgtggttcgtcccctccatcaagagcggcaacgacatcgccaactgcctgcggaagaacgggaagcgcgtgatccagctgtcccggaagacgttcgacaccgagtaccagaagaccaagaacaacgactgggactacgtggtcaccacggacatcagcgagatgggcgccaacttccgcgcggaccgggtgatcgacccccgccggtgcctcaagccggtgatcctgaaggacgggcccgagcgcgtcatcctggccggccccatgcccgtgaccgtcgcctccgccgcccagcggcgcgggcggatcggccgcaaccacaacaaggagggcgaccagtacatctacatggggcagccgctcaacaacgacgaggaccacgcgcactggaccgaggccaagatgctgctggacaacatcaacacccccgagggcatcatccccgccctcttcgagcccgagcgggagaagtccgccgccatcgacggggagtaccgcctgcgcggcgaggcgcggaagacgttcgtggagctgatgcgccgcggggacctcccggtgtggctgagctacaaggtcgcctccgagggcttccagtacagcgaccgccggtggtgcttcgacggcgagcgcaacaaccaggtgctggaggagaacatggacgtggagatctggaccaaggagggggagcggaagaagctccgcccccggtggctggacgcccgcacctactccgaccccctggccctccgggagttcaaggagttcgccgcgggccgccggagcgtctccggggacctgatcctggagatcggcaagctcccccagcacctgacccagcgcgcccagaacgccctggacaacctcgtgatgctgcacaacagcgagcagggcgggcgggcctaccgccacgcgatggaggagctgccggacacgatcgagaccctcatgctgctggccctcatcgccgtgctgaccggcggggtcaccctgttcttcctctccggccgggggctgggcaagaccagcatcggcctgctctgcgtgatggcctccagcgtgctgctgtggatggcctccgtcgagccccactggatcgcggccagcatcatcctcgagttcttcctgatggtgctgctcatccccgagcccgaccgccagcggacgccgcaggacaaccagctggcctacgtggtcatcgggctcctcttcatgatcctgaccgtggccgccaacgagatgggcctgctcgagaccaccaagaaggacctggggatcggccacgtggcggtcgagaaccaccaccacgccgccatgctggacgtggacctccaccccgcctccgcctggacgctgtacgcggtggccaccaccatcatcacccccatgatgcgccacacgatcgagaacaccaccgccaacatcagcctgaccgccatcgccaaccaggcggccatcctcatggggctggacaagggctggccgatctccaagatggacatcggcgtccccctgctcgccctggggtgctacagccaggtgaaccccctgacgctcaccgccgcggtgctgatgctggtcgcccactacgccatcatcggccccgggctccaggccaaggccacccgggaggcgcagaagcgcaccgccgccggcatcatgaagaacccgacggtggacgggatcgtggccatcgacctggaccccgtcgtgtacgacgccaagttcgagaagcagctgggccagatcatgctcctgatcctgtgcacctcccagatcctcctgatgcgcaccacctgggcgctgtgcgagagcatcacgctcgccaccggccccctgaccaccctgtgggaggggtcccccggcaagttctggaacacgaccatcgccgtgagcatggccaacatcttccgggggagctacctcgccggcgcgggcctggccttctccctgatgaagtccctcgggggcgggcgccggggcaccggggcccagggcgagaccctgggcgagaagtggaagcgccagctgaaccagctcgggaagtccgagttcaacacgtacaagcggagcggcatcatggaggtcgaccgctccgaggccaaggaggggctgaagcggggcgagaccaccaagcacgcggtgagccgcgggaccgccaagctgcggtggttcgtggagcgcaacctcgtcaagccggagggcaaggtgatcgacctgggctgcgggcggggcgggtggtcctactactgcgccggcctgaagaaggtgacggaggtcaaggggtacaccaagggcggccccgggcacgaggagcccatccccatggccacctacggctggaacctggtgaagctccacagcgggaaggacgtgttcttcatcccgcccgagaagtgcgacaccctgctgtgcgacatcggcgagtccagccccaaccccacgatcgaggaggggcgcaccctccgggtcctgaagatggtggagccgtggctgcgcggcaaccagttctgcatcaagatcctcaacccctacatgccctccgtggtcgagaccctggagcagatgcagcggaagcacggcgggatgctggtgcgcaaccccctcagccggaactccacccacgagatgtactgggtgagctgcggcaccgggaacatcgtctccgccgtgaacatgacgagccgcatgctgctgaaccggttcaccatggcgcaccgcaagccgacctacgagcgcgacgtggacctcggcgccggcacccggcacgtcgccgtggagcccgaggtggccaacctggacatcatcgggcagcgcatcgagaacatcaagcacgagcacaagtccacgtggcactacgacgaggacaacccctacaagacctgggcctaccacggcagctacgaggtcaagccctccgggagcgcgagctccatggtgaacggcgtcgtgaagctgctcaccaagccgtgggacgtgatccccatggtcacccagatcgccatgacggacaccacccccttcgggcagcagcgggtgttcaaggagaaggtggacacccgcacgcccaaggccaagcggggcaccgcccagatcatggaggtcaccgccaagtggctgtggggcttcctgagccgcaacaagaagccgcggatctgcacccgcgaggagttcacgcggaaggtgcgctccaacgcggccatcggggccgtgttcgtcgacgagaaccagtggaacagcgccaaggaggcggtggaggacgagcggttctgggacctcgtgcaccgcgagcgggagctgcacaagcagggcaagtgcgcgacctgcgtctacaacatgatggggaagcgcgagaagaagctgggcgagttcgggaaggccaagggctcccgggccatctggtacatgtggctcggcgcccgcttcctggagttcgaggcgctggggttcatgaacgaggaccactggttcagccgggagaactccctcagcggcgtggagggggagggcctgcacaagctggggtacatcctccgcgacatctccaagatccccggcggcaacatgtacgccgacgacaccgccgggtgggacacccggatcacggaggacgacctgcagaacgaggccaagatcaccgacatcatggagcccgagcacgccctgctcgccaagagcatcttcaagctgacctaccagaacaaggtggtccgcgtgcagcggccggccaagaacggcaccgtgatggacgtcatctcccgccgcgaccagcgggggagcggccaggtgggcacgtacgggctgaacaccttcaccaacatggaggcccagctcatccgccagatggagtccgagggcatcttcagcccctccgagctggagacccccaacctggccgggcgggtgctcgactggctggagaagcacggcgtcgagcgcctgaagcggatggccatcagcggggacgactgcgtggtgaagcccatcgacgaccgcttcgcgacggccctcaccgccctgaacgacatgggcaaggtccggaaggacatcccgcagtgggagccctccaagggctggaacgactggcagcaggtccccttctgcagccaccacttccaccagctgatcatgaaggacgggcgcgagatcgtggtcccctgccggaaccaggacgagctcgtgggccgcgcccgggtgagccagggggccggctggtccctgcgcgagaccgcgtgcctgggcaagagctacgcccagatgtggcagctcatgtacttccaccggcgcgacctgcggctggccgccaacgcgatctgctccgccgtcccggtggactgggtgcccaccagccgcacgacctggtccatccacgcccaccaccagtggatgaccaccgaggacatgctcagcgtctggaaccgggtgtggatcgaggagaacccctggatggaggacaagacgcacatctccagctggggcgacgtgccctacctgggcaagcgcgaggaccagtggtgcgggtccctgatcggcctcaccgcccgggccacctgggcgaccaacatccaggtcgccatcaaccaggtgcgccgcctgatcgggaacgagaactacctggactacatgaccagcatgaagcggttcaagaacgagtccgacccggagggcgccctctggtga

SEQ ID NO: 8408 - RNA, 9879 nt, synthetic construct
  misc_feature 1..9879: note = derived and/or modified CDS sequence (opt1) from DENV-1__FJ410236__SS-prME
  source 1..9879: mol_type = other RNA
agcgtgaccatgctgctcatgctggtgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgggacaagcggtccgtggccctcgcgccccacgtcggcctggggctggagacccgcaccgagacctggatgagctccgagggcgcctggaagcagatccagcgggtggagacgtgggccctccggcaccccgggttcaccgtgatcgccctgttcctggcccacgcgatcggcaccagcatcacccagaaggggatcatcttcatcctcctgatgctggtcacgccctccatggccatgcggtgcgtgggcatcggcagccgcgacttcgtggaggggctctccggcgccacctgggtcgacgtggtgctggagcacgggagctgcgtcaccaccatggccaaggacaagcccacgctggacatcgagctcctgaagaccgaggtgaccaaccccgccgtgctgcggaagctctgcatcgaggcgaagatctccaacaccacgaccgacagccgctgcccgacccagggcgaggccaccctggtcgaggagcaggacgccaacttcgtgtgccggcgcacgttcgtggaccggggctgggggaacggctgcgggctgttcggcaaggggtccctcatcacgtgcgccaagttcaagtgcgtcaccaagctggagggcaagatcgtgcagtacgagaacctgaagtacagcgtgatcgtcaccgtgcacacgggcgaccagcaccaggtcgggaacgagtccaccgagcacggcaccaccgccaccatcacgccccaggcgcccaccaccgagatccagctcaccgactacggggccctgacgctggactgcagcccccgcaccggcctcgacttcaacgagatggtgctgctgaccatgaaggagaagtcctggctcgtgcacaagcagtggttcctggacctgcccctcccctggaccagcggggccagcacgtcccaggagacctggaaccggcaggacctgctggtcaccttcaagaccgcccacgccaagaagcaggaggtggtggtcctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtgatgtgcacggggtccttcaagctcgagaaggaggtggccgagacccagcacggcaccgtcctggtgcagatcaagtacgagggcaccgacgcgccctgcaagatccccttcagcacgcaggacgagaagggggtgacccagaacggccggctgatcaccgccaacccgatcgtcaccgacaaggagaagcccgtgaacatcgaggccgagccgcccttcggggagtcctacatcgtgatcggcgccggcgagaaggcgatgaagctgagctggttcaagaaggggtccagcatcggcaagatgttcgaggccacggcccgcggggcccggcgcatggccatcctcggcgacaccgcgtgggacttcgggtccatcggcggcgtcttcaccagcgtggggaagctggtgcaccagatcttcggcaccgcctacggggtcctgttctccggcgtgagctggacgatgaagatcgggatcggcgtgctcctgacctggctgggcctcaactcccgcagcacctccctgagcatgacctgcatcgccgtcgggctggtgacgctctacctgggcgtgatggtccaggccgactccgggtgcgtgatcaactggaagggccgggagctgaagtgcgggagcggcatcttcgtgaccaacgaggtccacacctggaccgagcagtacaagttccaggccgacagcccgaagcgcctctccgcggccatcggcaaggcctgggaggagggggtgtgcggcatccggagcgccacccgcctggagaacatcatgtggaagcagatctccaacgagctgaaccacatcctcctggagaacgacatgaagttcacggtggtcgtgggggacgtggccggcatcctggcgcaggggaagaagatgatccggccccagcccatggagtacaagtacagctggaagtcctggggcaaggccaagatcatcggcgccgacgtccagaacaccaccttcatcatcgacgggcccaacaccccggagtgccccgacgaccagcgcgcctggaacatctgggaggtggaggactacggcttcgggatcttcacgaccaacatctggctcaagctgcgggacagctacacccaggtgtgcgaccaccgcctgatgtccgcggccatcaaggacagcaaggccgtccacgccgacatgggctactggatcgagtccgagaagaacgagacctggaagctcgcccgggcgagcttcatcgaggtgaagacgtgcatctggcccaagtcccacaccctgtggagcaacggcgtgctggagtccgagatgatcatccccaagatctacgggggcccgatcagccagcacaactaccgccccgggtacttcacccagaccgccggcccctggcacctcgggaagctggagctggacttcgacctctgcgagggcacgaccgtcgtggtggacgagcactgcggcaaccgggggccgtccctgcgcaccaccacggtcaccggcaagatcatccacgagtggtgctgccggagctgcaccctgccgcccctgcgcttccgcggggaggacggctgctggtacgggatggagatccgccccgtgaaggagaaggaggagaacctggtgaagtccatggtcagcgccggcagcggcgaggtggactccttcagcctggggctcctgtgcatctccatcatgatcgaggaggtgatgcggagccgctggtcccggaagatgctgatgaccggcacgctcgccgtcttcttcctgctgatcatggggcagctcacctggaacgacctgatccgcctgtgcatcatggtgggcgccaacgcgagcgaccgcatggggatgggcaccacctacctcgccctgatggccacgttcaagatgcggccgatgttcgccgtgggcctcctgttccgccggctgacctcccgcgaggtcctgctcctgaccatcgggctgagcctcgtggcctccgtcgagctgcccaacagcctggaggagctcggcgacgggctggcgatgggcatcatgatcctgaagctcctgaccgacttccagtcccaccagctgtgggccacgctcctgagcctgaccttcatcaagaccaccttctccctccactacgcctggaagacgatggccatggtgctgagcatcgtgtccctgttccccctctgcctgagcaccacctcccagaagaccacgtggctgcccgtcctcctgggcagcctggggtgcaagccgctcaccatgttcctgatcgcggagaacaagatctggggccggcgctcctggcccctgaacgaggggatcatggccgtgggcatcgtgagcatcctcctgagctccctgctcaagaacgacgtccccctggccgggcccctgatcgccggcggcatgctcatcgcctgctacgtgatcagcgggtccagcgcggacctgtccctggagaaggccgccgaggtgagctgggaggaggaggccgagcactccggcgccagccacaacatcctcgtcgaggtgcaggacgacgggaccatgaagatcaaggacgaggagcgggacgacaccctgaccatcctgctcaaggcgacgctgctggccgtgtccggcgtctacccgctcagcatccccgccaccctgttcgtgtggtacttctggcagaagaagaagcagcgctccggggtgctgtgggacacccccagcccgcccgaggtcgagcgggccgtgctcgacgacggcatctaccgcatcatgcagcggggcctgctggggcgctcccaggtgggcgtcggggtgttccaggagaacgtgttccacaccatgtggcacgtcacgcggggcgccgtgctgatgtaccaggggaagcgcctcgagcccagctgggcgtccgtgaagaaggacctgatcagctacggcggcgggtggcggctgcagggctcctggaacaccggggaggaggtccaggtgatcgccgtggagcccggcaagaaccccaagaacgtccagaccgcccccgggaccttcaagacgcccgagggcgaggtgggcgccatcgccctcgacttcaagcccgggaccagcggctcccccatcgtgaaccgcgaggggaagatcgtcggcctgtacggcaacggggtggtgaccaccagcggcacgtacgtcagcgcgatcgcccaggccaaggcctcccaggaggggccgctgcccgagatcgaggacgaggtgttccggaagcgcaacctcaccatcatggacctgcaccccggcagcgggaagacccggcgctacctgccggcgatcgtgcgggaggccatcaagcgcaagctccgcaccctgatcctggcccccacgcgggtcgtggcctccgagatggccgaggcgctcaagggcatgcccatccgctaccagaccaccgccgtcaagagcgagcacaccggcaaggagatcgtcgacctgatgtgccacgccacgttcaccatgcggctgctctcccccgtgcgcgtgccgaactacaacatgatcatcatggacgaggcccacttcaccgaccccagctccatcgccgcgcgggggtacatcagcacccgcgtcggcatgggggaggccgccgccatcttcatgacggccacgccgcccggctccgtggaggcgttcccgcagagcaacgccgtgatccaggacgaggagcgggacatccccgagcgctcctggaacagcgggtacgagtggatcaccgacttccccggcaagaccgtctggttcgtgccctccatcaagagcggcaacgacatcgccaactgcctgcggaagaacgggaagcgcgtgatccagctgtcccggaagacgttcgacaccgagtaccagaagaccaagaacaacgactgggactacgtcgtgaccacggacatcagcgagatgggcgccaacttccgcgcggaccgggtgatcgacccgcgccggtgcctcaagcccgtcatcctgaaggacgggcccgagcgcgtgatcctggccggccccatgccggtcaccgtggcctccgccgcccagcggcgcgggcggatcggccgcaaccacaacaaggagggcgaccagtacatctacatggggcagcccctcaacaacgacgaggaccacgcgcactggaccgaggccaagatgctgctggacaacatcaacacccccgagggcatcatccccgccctcttcgagccggagcgcgagaagtccgccgccatcgacggggagtaccggctgcgcggcgaggcgcggaagacgttcgtggagctgatgcgccgcggggacctccccgtctggctgtcctacaaggtggccagcgagggcttccagtacagcgaccgccggtggtgcttcgacggcgagcgcaacaaccaggtgctggaggagaacatggacgtcgagatctggaccaaggagggggagcggaagaagctccgcccccggtggctggacgcccgcacctactccgaccccctggccctccgggagttcaaggagttcgccgcgggccgccggagcgtgtccggggacctgatcctggagatcggcaagctcccgcagcacctgacccagcgcgcccagaacgccctggacaacctcgtgatgctgcacaacagcgagcagggcgggcgggcctaccgccacgcgatggaggagctgcccgacacgatcgagaccctcatgctgctggccctcatcgccgtcctgaccggcggggtgaccctgttcttcctctccggccgggggctgggcaagaccagcatcggcctgctctgcgtgatggcctccagcgtcctgctgtggatggcctccgtggagccccactggatcgcggccagcatcatcctcgagttcttcctgatggtgctgctcatccccgagccggaccgccagcggacgccccaggacaaccagctggcctacgtcgtgatcgggctcctcttcatgatcctgaccgtggccgccaacgagatgggcctgctcgagaccaccaagaaggacctggggatcggccacgtcgcggtggagaaccaccaccacgccgccatgctggacgtggacctccaccccgcctccgcctggacgctgtacgcggtcgccaccaccatcatcaccccgatgatgcgccacacgatcgagaacaccaccgccaacatcagcctgaccgccatcgccaaccaggcggccatcctcatggggctggacaagggctggcccatctccaagatggacatcggcgtgcccctgctcgccctggggtgctacagccaggtgaaccccctgacgctcaccgccgcggtcctgatgctggtggcccactacgccatcatcggcccggggctccaggccaaggccacccgcgaggcgcagaagcggaccgccgccggcatcatgaagaaccccacggtggacgggatcgtcgccatcgacctggaccccgtggtgtacgacgccaagttcgagaagcagctgggccagatcatgctcctgatcctgtgcacctcccagatcctcctgatgcgcaccacctgggcgctgtgcgagagcatcacgctcgccaccggccccctgaccaccctgtgggaggggtccccgggcaagttctggaacacgaccatcgccgtcagcatggccaacatcttccgggggtcctacctcgccggcgcgggcctggccttcagcctgatgaagtccctcgggggcgggcgccggggcaccggggcccagggcgagaccctgggcgagaagtggaagcgccagctgaaccagctctccaagagcgagttcaacacgtacaagcggtccgggatcatggaggtggaccgcagcgaggccaaggagggcctgaagcgcggggagaccaccaagcacgcggtgtcccgcggcaccgccaagctgcggtggttcgtcgagcgcaacctcgtgaagcccgaggggaaggtgatcgacctgggctgcggccgcggcgggtggagctactactgcgccgggctgaagaaggtcacggaggtgaaggggtacaccaagggcggccccggccacgaggagcccatcccgatggccacctacgggtggaacctggtgaagctccactccggcaaggacgtcttcttcatcccgcccgagaagtgcgacaccctgctgtgcgacatcggggagagctcccccaacccgacgatcgaggagggccgcaccctccgggtgctgaagatggtggagccctggctgcgcgggaaccagttctgcatcaagatcctcaacccctacatgcccagcgtcgtggagaccctggagcagatgcagcggaagcacggcggcatgctggtgcgcaacccgctctcccggaacagcacccacgagatgtactgggtctcctgcgggaccggcaacatcgtgagcgccgtgaacatgacgtcccgcatgctgctgaaccgcttcaccatggcgcaccggaagcccacctacgagcgcgacgtcgacctcggggccggcacccggcacgtggccgtggagcccgaggtcgccaacctggacatcatcggccagcgcatcgagaacatcaagcacgagcacaagagcacgtggcactacgacgaggacaacccctacaagacctgggcctaccacgggtcctacgaggtgaagccgagcggctccgcgagcagcatggtcaacggggtggtgaagctgctcaccaagccctgggacgtcatccccatggtgacccagatcgccatgacggacaccacccccttcggccagcagcgggtgttcaaggagaaggtcgacacccgcacgccgaaggccaagcgggggaccgcccagatcatggaggtgaccgccaagtggctgtggggcttcctgtcccgcaacaagaagccccggatctgcacccgcgaggagttcacgcggaaggtgcgcagcaacgcggccatcggcgccgtcttcgtggacgagaaccagtggaactccgccaaggaggcggtggaggacgagcggttctgggacctcgtccaccgcgagcgggagctgcacaagcaggggaagtgcgcgacctgcgtgtacaacatgatgggcaagcgcgagaagaagctgggggagttcggcaaggccaaggggagccgggccatctggtacatgtggctcggcgcccgcttcctggagttcgaggcgctgggcttcatgaacgaggaccactggttctcccgggagaacagcctctccggggtggagggcgaggggctgcacaagctgggctacatcctccgcgacatcagcaagatccccgggggcaacatgtacgccgacgacaccgccggctgggacacccggatcacggaggacgacctgcagaacgaggcccgcatcaccgacatcatggagccggagcacgccctgctcgcgaagtccatcttcaagctgacctaccagaacaaggtcgtgcgcgtgcagcggcccgccaagaacgggaccgtcatggacgtgatcagccgccgggaccagcgcggctccggccaggtggggacgtacggcctgaacaccttcaccaacatggaggcccagctcatccggcagatggagagcgaggggatcttctcccccagcgagctggagacccccaacctggccgagcgcgtcctcgactggctggagaagtacggcgtgaagcggctgaagcgcatggccatctccggggacgactgcgtggtcaagccgatcgacgaccggttcgcgacggccctcaccgccctgaacgacatgggcaaggtgcgcaaggacatcccccagtgggagcccagcaaggggtggaacgactggcagcaggtccccttctgctcccaccacttccaccagctgatcatgaaggacggccgggagatcgtcgtgccgtgccgcaaccaggacgagctcgtgggccgggcccgcgtcagccagggggccggctggagcctgcgggagaccgcgtgcctggggaagtcctacgcccagatgtggcagctcatgtacttccaccgccgggacctgcgcctggccgccaacgcgatctgcagcgccgtgcccgtggactggatccccacctcccggacgacctggagcatccacgcccaccaccagtggatgaccaccgaggacatgctctccgtctggaaccgcgtgtggatcgaggagaacccctggatggaggacaagacgcacatcagctcctggggcgacgtgccgtacctggggaagcgcgaggaccagtggtgcggcagcctgatcggcctcaccgcccgggccacctgggcgaccaacatccaggtcgccatcaaccaggtgcgccggctgatcgggaacgagaactacctggactacatgacctccatgaagcgcttcaagaacgagagcgaccccgagggcgccctctggtga

SEQ ID NO: 8409 - RNA, 9879 nt, synthetic construct
  misc_feature 1..9879: note = derived and/or modified CDS sequence (opt1) from DENV-1__FJ410238__SS-prME
  source 1..9879: mol_type = other RNA
agcgtgaccatgctgctgatgctgatgcccaccgccctggccttccacctcacgacccggggcggggagccccacatgatcgtgagcaagcaggagcggggcaagagcctgctgttcaagaccagcgcgggggtgaacatgtgcaccctcatcgccatggacctgggcgagttctgcgaggacacgatgacctacaagtgcccccggatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggaccagcggggcctccaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctcgtccagatcaagtacgagggcaccgacgccccctgcaagatccccttctccacccaggacgagaagggggtgacccagaacggccggctgatcacggccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacaccgcctgggacttcgggagcatcggcggcgtgttcacgtccgtcgggaagctggtgcaccagatcttcggcaccgcctacggggtgctgttcagcggcgtctcctggaccatgaagatcgggatcggcgtgctcctgacctggctgggcctcaacagccgctccacgagcctgtccatgacctgcatcgccgtggggctggtcaccctctacctgggcgtgatggtgcaggccgacagcgggtgcgtcatcaactggaagggccgggagctgaagtgcgggagcggcatcttcgtgaccaacgaggtgcacacgtggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagctgaccgtggtggtcggggacgtggcgggcatcctcgcccaggggaagaagatgatccggccccagcccatggagtacaagtactcctggaagtcctggggcaaggccaagatcatcggcgccgacgtgcagaacaccacgttcatcatcgacgggcccaacaccccggagtgccccgacgaccagcgcgcgtggaacatctgggaggtcgaggactacggcttcgggatcttcaccaccaacatctggctgaagctgcgggactcctacacccaggtgtgcgaccaccgcctcatgagcgccgccatcaaggactccaaggccgtgcacgccgacatgggctactggatcgagagcgagaagaacgagacctggaagctggcgcgggcctccttcatcgaggtcaagacctgcatctggcccaagagccacaccctgtggtccaacggcgtgctcgagagcgagatgatcatccccaagatctacgggggcccgatctcccagcacaactaccgccccgggtacttcacgcagaccgccggcccctggcacctggggaagctggagctcgacttcgacctgtgcgagggcaccaccgtggtcgtggacgagcactgcggcaaccgggggccgagcctgcgcacgaccaccgtgaccggcaagatcatccacgagtggtgctgccggtcctgcacgctgccgcccctccgcttcaagggggaggacggctgctggtacgggatggagatccggcccgtcaaggagaaggaggagaacctggtcaagagcatggtgagcgccggctccggcgaggtcgacagcttctccctcgggctgctgtgcatcagcatcatgatcgaggaggtgatgcgctcccggtggagccgcaagatgctcatgaccggcaccctggccgtgttcttcctgctcatcatggggcagctgacctggaacgacctgatccggctctgcatcatggtcggcgcgaacacgtccgaccgcatggggatgggcaccacctacctggccctgatggccaccttcaagatgcgcccgatgttcgccgtgggcctcctgttccggcgcctgacgagccgggaggtgctcctgctgaccatcgggctctccctggtcgccagcgcggagctgcccaactccctcgaggagctgggcgacgggctggccatgggcatcatgatcctcaagctgctgaccgacttccagagccaccagctctgggccaccctgctgtccctcacgttcatccgcaccaccttcagcctgcactacgcctggaagaccatggcgatggtgctgtccatcgtcagcctcttccccctgtgcctgtccacgaccagccagaagaccacctggctccccgtgctgctgggctccctcgggtgcaagccgctgacgatgttcctgatcgccgagaacaagatctggggccgcaagagctggcccctcaacgaggggatcatggccgtgggcatcgtcagcatcctgctgtccagcctcctgaagaacgacgtgcccctggccgggcccctcatcgccggcggcatgctgatcgcgtgctacgtgatctccgggagctccgccgacctgagcctcgagaaggccgccgaggtctcctgggaggaggaggccgagcacagcggcgcgtcccacaacatcctggtggaggtgcaggacgacgggaccatgaagatcaaggacgaggagcgcgacgacaccctgaccatcctcctgaaggccaccctgctcgccgtcagcggcgtgtacccgctgtccatccccgccacgctgttcgtgtggtacttctggcagaagaagaagcagcggagcggggtcctctgggacacccccagcccgcccgaggtggagcgcgccgtgctggacgacggcatctaccggatcatgcagcgcggcctgctggggcggagccaggtcggcgtgggggtgttccaggagaacgtcttccacaccatgtggcacgtgacccgcggcgcggtgctcatgtaccaggggaagcggctggagccctcctgggccagcgtcaagaaggacctgatctcctacggcggcgggtggcgcctccagggcagctggaacacgggggaggaggtccaggtgatcgccgtcgagcccggcaagaaccccaagaacgtgcagaccgcccccgggaccttcaagacctccgagggcgaggtgggcgccatcgcgctggacttcaagcccgggacgagcggcagccccatcgtcaaccgggaggggaagatcgtgggcctgtacggcaacggggtggtcaccacctccggcacctacgtgagcgccatcgcccaggccaaggcgtcccaggaggggcccctcccggagatcgaggacgaggtgttccgcaagcggaacctgacgatcatggacctgcaccccggcagcgggaagacccgccggtacctccccgccatcgtccgcgaggccatcaagcggcgcctgcgcaccctgatcctcgccccgacccgggtggtggcctccgagatggcggaggccctgaagggcatgcccatccgctaccagacgaccgccgtcaagagcgagcacaccggcaaggagatcgtggacctgatgtgccacgccaccttcacgatgcggctcctgtcccccgtgcgcgtccccaactacaacatgatcatcatggacgaggcccacttcaccgacccgagctccatcgcggcccgggggtacatcagcacccgcgtgggcatgggggaggccgccgccatcttcatgaccgcgacgccgcccggctccgtggaggccttcccccagagcaacgccgtcatccaggacgaggagcgggacatcccggagcgctcctggaacagcgggtacgagtggatcaccgacttccccggcaagaccgtgtggttcgtgccctccatcaagagcggcaacgacatcgccaactgcctgcggaagaacgggaagcgcgtcatccagctctcccggaagaccttcgacacggagtaccagaagaccaagaacaacgactgggactacgtggtgaccaccgacatcagcgagatgggcgcgaacttccgcgccgaccgggtcatcgacccccgccggtgcctgaagccggtgatcctgaaggacgggcccgagcgcgtgatcctcgccggccccatgcccgtcacggtggcctccgccgcgcagcggcgcgggcggatcggccgcaaccacaacaaggagggcgaccagtacatctacatggggcagccgctgaacaacgacgaggaccacgcccactggaccgaggccaagatgctgctcgacaacatcaacacccccgagggcatcatccccgccctgttcgagcccgagcgcgagaagtccgccgcgatcgacggggagtaccggctgcgcggcgaggcccggaagaccttcgtcgagctcatgcgccgcggggacctgccggtgtggctgagctacaaggtggcctccgagggcttccagtacagcgaccgccggtggtgcttcgacggcgagcgcaacaaccaggtcctcgaggagaacatggacgtggagatctggacgaaggagggggagcggaagaagctgcgcccccggtggctggacgcccgcacctactccgaccccctcgccctgcgggagttcaaggagttcgcggccggccgccggagcgtgtccggggacctgatcctcgagatcggcaagctgccccagcacctgacccagcgcgcccagaacgccctcgacaacctggtcatgctgcacaacagcgagcagggcgggcgggtgtaccgccacgcgatggaggagctcccggacaccatcgagacgctgatgctgctcgccctgatcgccgtgctgaccggcggggtcaccctcttcttcctgtccggccgggggctgggcaagaccagcatcggcctcctgtgcgtgatggcctccagcgtgctgctctggatggcctccgtcgagccccactggatcgcggccagcatcatcctggagttcttcctgatggtgctcctgatccccgagcccgaccgccagcggaccccgcaggacaaccagctggcctacgtggtcatcgggctcctgttcatgatcctgacggtggccgccaacgagatgggcctcctggagaccaccaagaaggacctggggatcggccacgtggcggtcgagaaccaccaccacgccgccatgctcgacgtggacctgcaccccgcctccgcctggaccctgtacgcggtggccacgaccatcatcacccccatgatgcgccacaccatcgagaacacgaccgccaacatcagcctcaccgccatcgccaaccaggcggccatcctgatggggctggacaagggctggccgatctccaagatggacatcggcgtccccctcctggccctggggtgctacagccaggtgaaccccctcaccctgacggccgcggtgctgatgctcgtcgcccactacgccatcatcggccccgggctgcaggccaaggccacccgcgaggcgcagaagcggaccgccgccggcatcatgaagaacccgaccgtggacgggatcgtggccatcgacctggaccccgtcgtgtacgacgccaagttcgagaagcagctcggccagatcatgctgctgatcctctgcacgtcccagatcctgctgatgcgcaccacctgggcgctctgcgagagcatcaccctggccacgggccccctgaccaccctctgggaggggtcccccggcaagttctggaacaccacgatcgccgtgagcatggccaacatcttccgggggagctacctggccggcgcgggcctggccttctccctcatgaagtccctcgggggcgggcgccgggggaccggggcccagggcgagaccctgggcgagaagtggaagcgccagctcaaccagctgtccaagagcgagttcaacacctacaagcggtccgggatcatggaggtcgaccgcagcgaggccaaggagggcctgaagcgcggggagacgaccaagcacgcggtgtcccgcggcaccgccaagctccggtggttcgtggagcgcaacctggtcaagccggaggggaaggtgatcgacctgggctgcggccgcggcgggtggagctactactgcgccgggctgaagaaggtgaccgaggtcaaggggtacacgaagggcgggcccggccacgaggagcccatccccatggccacctacgggtggaacctcgtgaagctgcactccggcaaggacgtgttcttcatcccgcccgagaagtgcgacaccctgctctgcgacatcggggagagctcccccaaccccaccatcgaggagggccgcacgctgcgggtcctgaagatggtggagccgtggctccgcgggaaccagttctgcatcaagatcctgaacccctacatgcccagcgtggtcgagaccctggagcagatgcagcggaagcacggcggcatgctcgtgcgcaaccccctgtcccggaacagcacccacgagatgtactgggtgtcctgcgggaccggcaacatcgtcagcgccgtgaacatgacctcccgcatgctgctcaaccgcttcacgatggcgcaccggaagccgacctacgagcgcgacgtggacctgggggccggcacccggcacgtcgccgtggagcccgaggtggccaacctggacatcatcggccagcgcatcgagaacatcaagcacgagcacaagagcacctggcactacgacgaggacaacccctacaagacgtgggcctaccacgggtcctacgaggtcaagcccagcggcagcgcgtccagcatggtgaacggggtcgtgaagctcctgaccaagccgtgggacgtgatccccatggtcacccagatcgccatgaccgacacgacccccttcggccagcagcgggtgttcaaggagaaggtggacacccgcacccccaaggccaagcgggggacggcccagatcatggaggtcaccgccaagtggctgtggggcttcctctcccgcaacaagaagccgcggatctgcacccgcgaggagttcacccggaaggtgcgcagcaacgcggccatcggcgccgtgttcgtcgacgagaaccagtggaactccgccaaggaggcggtggaggacgagcggttctgggacctggtgcaccgcgagcgggagctgcacaagcaggggaagtgcgccacgtgcgtctacaacatgatgggcaagcgcgagaagaagctcggggagttcggcaaggccaaggggagccgggccatctggtacatgtggctgggcgcccgcttcctggagttcgaggcgctcggcttcatgaacgaggaccactggttctcccgggagaacagcctgtccggggtggagggcgaggggctgcacaagctcggctacatcctgcgcgacatcagcaagatccccgggggcaacatgtacgccgacgacaccgccggctgggacacccggatcaccgaggacgacctgcagaacgaggccaagatcacggacatcatggagcccgagcacgccctcctggcgaagtccatcttcaagctgacctaccagaacaaggtggtccgcgtgcagcgcccggccaagaacgggaccgtgatggacgtcatcagccggcgcgaccagcggggctccggccaggtgggcacctacggcctcaacacgttcaccaacatggaggcccagctgatccgccagatggagagcgaggggatcttctcccccagcgagctggagacccccaacctcgccggccgggtgctggactggctggagaagcacggggtcgagcgcctcaagcggatggccatctccggcgacgactgcgtggtgaagcccatcgacgaccgcttcgcgaccgccctgacggccctgaacgacatggggaaggtccggaaggacatcccgcagtgggagcccagcaagggctggaacgactggcagcaggtccccttctgcagccaccacttccaccagctcatcatgaaggacggccgcgagatcgtggtcccctgccggaaccaggacgagctggtggggcgcgcccgggtgtcccagggcgccgggtggagcctgcgcgagaccgcgtgcctcggcaagtcctacgcccagatgtggcagctgatgtacttccaccggcgcgacctgcggctcgccgccaacgcgatctgcagcgccgtcccggtggactgggtgcccacctcccgcaccacgtggagcatccacgcccaccaccagtggatgaccaccgaggacatgctgtccgtctggaaccgggtgtggatcgaggagaacccctggatggaggacaagacccacgtgagctcctggggcgacgtcccctacctgggcaagcgcgaggaccagtggtgcggcagcctcatcgggctgacggcccgcgccacctgggcgaccaacatccaggtggccatcaaccaggtgcggcgcctgctcggcaacgagaactacctggactacatgacctccatgaagcggttcaagaacgagagcgacccggagggggccctgtggtga

SEQ ID NO: 8410 - RNA, 9879 nt, synthetic construct
  misc_feature 1..9879: note = derived and/or modified CDS sequence (opt1) from DENV-1__FJ410239__SS-prME
  source 1..9879: mol_type = other RNA
agcgtgaccatgctgctgatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgggacaagcggtccgtggccctcgcgccccacgtgggcctggggctggagacccgcaccgagacctggatgagctccgagggcgcctggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggagctggccgagacccagcacggcaccgtgctggtgcagatcaagtacgagggcaccgacgcgccctgcaagatccccttcagcacgcaggacgagaagggggtcacccagaacggccggctgatcaccgccaacccgatcgtgaccgacaaggagaagcccgtgaacatcgaggccgagccgcccttcggggagtcctacatcgtcatcggcgccggcgagaaggcgctcaagctgagctggttcaagaaggggtccagcatcggcaagatgttcgaggccacggcccgcggggcccggcgcatggccatcctgggcgacaccgcgtgggacttcgggtccatcggcggcgtgttcaccagcgccgggaagctcgtgcaccagatcttcggcaccgcctacggggtcctgttctccggcgtgagctggacgatgaagatcgggatcggcgtgctgctcacctggctgggcctgaactcccgcagcacctccctcagcatgacctgcatcgccgtcgggctggtgacgctgtacctcggcgtgatggtccaggccgactccgggtgcgtgatcaactggaagggccgggagctgaagtgcgggagcggcatcttcgtgaccaacgaggtccacacctggaccgagcagtacaagttccaggcggacagcccgaagcgcctgtccgccgccatcggcaaggcctgggaggagggggtgtgcggcatccggagcgccacccgcctcgagaacatcatgtggaagcagatctccaacgagctgaaccacatcctgctcgagaacgacatgaagttcacggtggtcgtgggggacgtggcgggcatcctggcccaggggaagaagatgatccggccccagcccatggagtacaagtacagctggaagtcctggggcaaggccaagatcatcggcgccgacgtccagaacaccaccttcatcatcgacgggcccaacaccccggagtgccccgacgaccagcgcgcgtggaacatctgggaggtggaggactacggcttcgggatcttcacgaccaacatctggctgaagctccgggacagctacacccaggtgtgcgaccaccgcctgatgtccgccgccatcaaggacagcaaggccgtccacgccgacatgggctactggatcgagtccgagaagaacgagacctggaagctggcgcgggccagcttcatcgaggtgaagacgtgcatctggcccaagtcccacaccctctggagcaacggcgtgctggagtccgagatgatcatccccaagatctacgggggcccgatcagccagcacaactaccgccccgggtacttcacccagaccgccggcccctggcacctggggaagctcgagctggacttcgacctgtgcgagggcacgaccgtcgtggtggacgagcactgcggcaaccgggggccgtccctccgcaccaccacggtcaccggcaagatcatccacgagtggtgctgccggagctgcaccctgccgcccctgcgcttccgcggggaggacggctgctggtacgggatggagatccgccccgtgaaggagaaggaggagaacctcgtgaagtccatggtcagcgccggcagcggcgaggtggactccttcagcctggggctgctctgcatctccatcatgatcgaggaggtgatgcggagccgctggtcccggaagatgctgatgaccggcacgctggccgtcttcttcctcctgatcatggggcagctgacctggaacgacctcatccgcctgtgcatcatggtgggcgcgaacgccagcgaccgcatggggatgggcaccacctacctggccctcatggccacgttcaagatgcggccgatgttcgccgtgggcctgctgttccgccggctcacctcccgcgaggtcctgctgctcaccatcgggctgagcctggtggcgtccgtggagctccccaacagcctggaggagctgggcgacgggctcgccatgggcatcatgatcctgaagctgctcaccgacttccagtcccaccagctgtgggccacgctgctcagcctgaccttcatcaagaccaccttctccctgcactacgcctggaagacgatggcgatggtcctcagcatcgtgtccctgttccccctgtgcctcagcaccacctcccagaagaccacgtggctgcccgtcttcctgggcagcctcgggtgcaagccgctgaccatgttcctgatcgccgagaacaagatctggggccggcgctcctggcccctcaacgaggggatcatggccgtgggcatcgtgagcatcctgctgagctccctcctgaagaacgacgtccccctggccgggcccctcatcgccggcggcatgctgatcgcgtgctacgtgatcagcgggtccagcgccgacctgtccctcgagaaggccgccgaggtgagctgggaggaggaggccgagcactccggcgcgagccacaacatcctggtcgaggtgcaggacgacgggaccatgaagatcaaggacgaggagcgggacgacaccctgaccatcctcctgaaggccacgctgctcgccgtgtccggcgtctacccgctgagcatccccgccaccctgttcgtgtggtacttctggcagaagaagaagcagcgctccggggtgctctgggacacccccagcccgcccgaggtcgagcgggccgtgctggacgacggcatctaccgcatcatgcagcggggcctgctggggcgctcccaggtgggcgtcggggtgttccaggagaacgtgttccacaccatgtggcacgtcacgcggggcgcggtgctcatgtaccaggggaagcgcctggagcccagctgggcctccgtgaagaaggacctgatcagctacggcggcgggtggcggctccagggctcctggaacaccggggaggaggtccaggtgatcgccgtggagcccggcaagaaccccaagaacgtccagaccgcccccgggaccttcaagacgcccgagggcgaggtgggcgccatcgcgctggacttcaagcccgggaccagcggctcccccatcgtgaaccgcgaggggaagatcgtcggcctgtacggcaacggggtggtgaccaccagcggcacgtacgtcagcgccatcgcccaggccaaggcgtcccaggaggggccgctccccgagatcgaggacgaggtgttccggaagcgcaacctgaccatcatggacctgcaccccggcagcgggaagacccggcgctacctcccggccatcgtgcgggaggccatcaagcgcaagctgcgcaccctgatcctcgcccccacgcgggtcgtggcctccgagatggcggaggccctgaagggcatgcccatccgctaccagaccaccgccgtcaagagcgagcacaccggcaaggagatcgtcgacctgatgtgccacgccacgttcaccatgcggctcctgtcccccgtgcgcgtgccgaactacaacatgatcatcatggacgaggcccacttcaccgaccccagctccatcgcggcccgggggtacatcagcacccgcgtcggcatgggggaggccgccgccatcttcatgacggcgacgccgcccggctccgtggaggccttcccgcagagcaacgccgtgatccaggacgaggagcgggacatccccgagcgctcctggaacagcgggtacgagtggatcaccgacttccccggcaagaccgtctggttcgtgccctccatcaagagcggcaacgacatcgccaactgcctgcggaagaacgggaagcgcgtgatccagctctcccggaagacgttcgacaccgagtaccagaagaccaagaacaacgactgggactacgtcgtgaccacggacatcagcgagatgggcgcgaacttccgcgccgaccgggtgatcgacccgcgccggtgcctgaagcccgtcatcctgaaggacgggcccgagcgcgtgatcctcgccggccccatgccggtgaccgtcgcctccgccgcgcagcggcgcgggcggatcggccgcaaccacaacaaggagggcgaccagtacatctacatggggcagcccctgaacaacgacgaggaccacgcccactggaccgaggccaagatgctgctcgacaacatcaacacccccgagggcatcatccccgccctgttcgagccggagcgcgagaagtccgccgcgatcgacggggagtaccggctgcgcggcgaggcccggaagacgttcgtggagctcatgcgccgcggggacctgcccgtctggctgtcctacaaggtggccagcgagggcttccagtacagcgaccgccggtggtgcttcgacggcgagcgcaacaaccaggtgctcgaggagaacatggacgtcgagatctggaccaaggagggggagcggaagaagctgcgcccccggtggctggacgcccgcacctactccgaccccctcgccctgcgggagttcaaggagttcgcggccggccgccggagcgtgtccggggacctgatcctcgagatcggcaagctgccgcagcacctgacccagcgcgcccagaacgccctcgacaacctggtgatgctgcacaacagcgagcagggcgggcgggcgtaccgccacgccatggaggagctccccgacacgatcgagaccctgatgctgctcgccctgatcgccgtcctgaccggcggggtgaccctcttcttcctgtccggccgggggctgggcaagaccagcatcggcctcctgtgcgtgatggcctccagcgtcctgctctggatggcgtccgtggagccccactggatcgccgccagcatcatcctggagttcttcctgatggtgctcctgatccccgagccggaccgccagcggacgccccaggacaaccagctggcctacgtcgtgatcgggctcctgttcatgatcctgaccgtggccgcgaacgagatgggcctcctggagaccaccaagaaggacctggggatcggccacgtcgccgtggagaaccaccaccacgccgccatgctcgacgtggacctgcaccccgcctccgcgtggacgctgtacgccgtcgccaccaccatcatcaccccgatgatgcgccacacgatcgagaacaccaccgccaacatcagcctcaccgccatcgcgaaccaggccgccatcctgatggggctggacaagggctggcccatctccaagatggacatcggcgtgcccctcctggccctggggtgctacagccaggtgaaccccctcacgctgaccgcggccgtcctgatgctcgtggcccactacgccatcatcggcccggggctgcaggccaaggcgacccgcgaggcccagaagcggaccgccgccggcatcatgaagaaccccacggtggacgggatcgtcgccatcgacctggaccccgtggtgtacgacgcgaagttcgagaagcagctcggccagatcatgctgctgatcctctgcacctcccagatcctgctgatgcgcaccacctgggccctctgcgagagcatcacgctggccaccggccccctgaccaccctctgggaggggtccccgggcaagttctggaacacgaccatcgccgtcagcatggccaacatcttccgggggtcctacctggcgggcgccggcctggccttcagcctcatgaagtccctcgggggcgggcgccgggggaccggggcccagggcgagaccctgggcgagaagtggaagcgccagctcaaccagctgtccaagagcgagttcaacacgtacaagcggtccgggatcatggaggtggaccgcagcgaggcgaaggagggcctgaagcgcggggagaccaccaagcacgccgtgtcccgcggcaccgccaagctccggtggttcgtcgagcgcaacctggtgaagcccgaggggaaggtgatcgacctgggctgcggccgcgggggctggagctactactgcgccgggctgaagaaggtcacggaggtgaagggctacaccaagggcggccccggccacgaggagcccatcccgatggccacctacgggtggaacctcgtgaagctgcactccggcaaggacgtcttcttcatcccgcccgagaagtgcgacaccctgctctgcgacatcggggagagctcccccaacccgacgatcgaggagggccgcaccctgcgggtgctgaagatggtggagccctggctccgcgggaaccagttctgcatcaagatcctgaacccctacatgcccagcgtcgtggagaccctggagcagatgcagcggaagcacggcggcatgctcgtgcgcaacccgctgtcccggaacagcacccacgagatgtactgggtctcctgcgggaccggcaacatcgtgagcgcggtgaacatgacgtcccgcatgctgctcaaccgcttcaccatggcccaccggaagcccacctacgagcgcgacgtcgacctgggggccggcacccggcacgtggccgtggagcccgaggtcgccaacctggacatcatcggccagcgcatcgagaacatcaagcacgagcacaagagcacgtggcactacgacgaggacaacccctacaagacctgggcgtaccacgggtcctacgaggtgaagccgagcggctccgccagcagcatggtgaacggggtcgtgaagctcctgaccaagccctgggacgtcatccccatggtgacccagatcgccatgacggacaccacccccttcggccagcagcgggtgttcaaggagaaggtcgacacccgcacgccgaaggccaagcgggggaccgcccagatcatggaggtgaccgcgaagtggctgtggggcttcctctcccgcaacaagaagccccggatctgcacccgcgaggagttcacgcggaaggtgcgcagcaacgccgccatcggcgccgtcttcgtggacgagaaccagtggaactccgcgaaggaggccgtggaggacgagcggttctgggacctggtccaccgcgagcgggagctgcacaagcaggggaagtgcgcgacctgcgtgtacaacatgatgggcaagcgcgagaagaagctcggggagttcggcaaggccaaggggagccgggccatctggtacatgtggctgggcgcgcgcttcctggagttcgaggccctcggcttcatgaacgaggaccactggttctcccgggagaacagcctgtccggggtggagggcgaggggctgcacaagctcggctacatcctgcgcgacatcagcaagatccccgggggcaacatgtacgccgacgacaccgccggctgggacacccggatcacggaggacgacctgcagaacgaggcccgcatcaccgacatcatggagccggagcacgcgctcctggccaagtccatcttcaagctgacctaccagaacaaggtcgtgcgcgtgcagcggcccgccaagaacgggaccgtcatggacgtgatcagccgccgggaccagcgcggctccggccaggtggggacgtacggcctcaacaccttcaccaacatggaggcccagctgatccggcagatggagagcgaggggatcttctcccccagcgagctggagacccccaacctcgccgagcgcgtcctggactggctggagaagtacggcgtggagcggctcaagcgcatggcgatctccggggacgactgcgtggtcaagccgatcgacgaccggttcgccacggccctgaccgccctgaacgacatgggcaaggtgcgcaaggacatcccccagtgggagcccagcaaggggtggaacgactggcagcaggtccccttctgctcccaccacttccaccagctcatcatgaaggacggccgggagatcgtcgtgccgtgccgcaaccaggacgagctggtgggccgggcccgcgtcagccagggggcgggctggagcctgcgggagaccgcctgcctcgggaagtcctacgcccagatgtggcagctgatgtacttccaccgccgggacctgcgcctcgccgcgaacgccatctgcagcgccgtgcccgtggactggatccccacctcccggacgacctggagcatccacgcccaccaccagtggatgaccaccgaggacatgctgtccgtctggaaccgcgtgtggatcgaggagaacccctggatggaggacaagacgcacatcagctcctggggcgacgtgccgtacctggggaagcgcgaggaccagtggtgcggcagcctcatcggcctgaccgcccgggcgacctgggccaccaacatccaggtcgccatcaaccaggtgcgccggctgatcgggaacgagaactacctcgactacatgacctccatgaagcgcttcaagaacgagagcgaccccgagggcgccctgtggtga

SEQ ID NO: 8411 - RNA, 9879 nt, synthetic construct
  misc_feature 1..9879: note = derived and/or modified CDS sequence (opt1) from DENV-1__FJ410240__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagaccagcgcgggggtgaacatgtgcaccctcatcgccatggacctgggcgagttctgcgaggacacgatgacctacaagtgcccccgcatcaccgaggccgagcccgacgacgtggactgctggtgcaacgccaccgacacgtgggtcacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtcgagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagaccgtccagtacgagaacctgaagtacagcgtgatcgtgaccgcgcacacgggcgaccagcaccaggtcgggaacgagtccaccgagcacggcaccaccgccaccatcacgccccaggcccccagcaccgagatccagctgaccgactacggggccctcaccctggactgcagcccccggacgggcctggacttcaacgagatggtgctcctgaccatgaaggagaagtcctggctggtccacaagcagtggttcctcgacctgccgctgccctggaccagcggggcctccaccagccaggagacgtggaaccggaaggacctcctggtgaccttcaagaccgcgcacgccaagaagcaggaggtggtcgtgctgggctcccaggagggcgccatgcacaccgccctcacgggggccaccgagatccagaccagcggcaccacgaccatcttcgcggggcacctgaagtgccgcctgaagatggacaagctcaccctgaagggcatgtcctacgtgatgtgcaccgggagcttcaagctggagaaggaggtcgccgagacgcagcacggcaccgtgctcgtgcagatcaagtacgagggcaccgacgccccctgcaagatccccttctccacccaggacgagaagggggtcacgcagaacggccggctgatcaccgccaacccgatcgtgaccgacaaggagaagcccgtgaacatcgaggcggagccgcccttcggggagagctacatcgtcatcggcgccggcgagaaggccctgaagctgtcctggttcaagaaggggagctccatcggcaagatgttcgaggccaccgcccgcggggcgcggcgcatggccatcctcggcgacacggcctgggacttcgggagcatcggcggcgtgttcacctccgtggggaagctggtccaccagatcttcggcaccgcctacggggtgctgttcagcggcgtgtcctggaccatgaagatcgggatcggcgtcctcctgacgtggctgggcctcaacagccgctccaccagcctgtccatgacctgcatcgccgtggggctggtgaccctctacctgggcgtcatggtgcaggcggacagcgggtgcgtgatcaactggaagggccgggagctgaagtgcgggagcggcatcttcgtcacgaacgaggtgcacacctggaccgagcagtacaagttccaggccgactccccgaagcgcctcagcgccgccatcggcaaggcctgggaggagggggtgtgcggcatccggtccgcgacccgcctggagaacatcatgtggaagcagatcagcaacgagctgaaccacatcctcctggagaacgacatgaagttcaccgtcgtggtgggggacgtcgccggcatcctggcccaggggaagaagatgatccggccccagcccatggagtacaagtactcctggaagtcctggggcaaggccaagatcatcggcgcggacgtgcagaacacgaccttcatcatcgacgggcccaacaccccggagtgccccgacgaccagcgcgcctggaacatctgggaggtggaggactacggcttcgggatcttcaccacgaacatctggctcaagctgcgggactcctacacccaggtctgcgaccaccgcctgatgagcgccgccatcaaggactccaaggccgtgcacgcggacatgggctactggatcgagagcgagaagaacgagacctggaagctcgcccgggcctccttcatcgaggtgaagacctgcatctggcccaagagccacacgctgtggtccaacggcgtcctggagagcgagatgatcatccccaagatctacgggggcccgatctcccagcacaactaccgccccgggtacttcacccagaccgccggcccctggcacctcgggaagctggagctggacttcgacctctgcgagggcaccacggtggtggtcgacgagcactgcggcaaccgggggccgagcctgcgcaccaccaccgtgacgggcaagatcatccacgagtggtgctgccggtcctgcaccctgccgcccctgcgcttcaagggggaggacggctgctggtacgggatggagatccggcccgtgaaggagaaggaggagaacctggtcaagagcatggtgagcgccggctccggcgaggtggacagcttctccctggggctcctgtgcatcagcatcatgatcgaggaggtcatgcgctcccggtggagccgcaagatgctgatgaccggcaccctcgcggtgttcttcctgctgatcatggggcagctcacgtggaacgacctgatccggctgtgcatcatggtgggcgccaacgcctccgaccgcatggggatgggcaccacctacctcgccctgatggccaccttcaagatgcgcccgatgttcgcggtcggcctcctgttccggcgcctgacgagccgggaggtgctgctcctgaccatcgggctgtccctcgtggccagcgtcgagctgcccaactccctggaggagctcggcgacgggctggccatgggcatcatgatcctgaagctcctgaccgacttccagagccaccagctgtgggccaccctcctgtccctgacgttcatcaagaccaccttcagcctccactacgcgtggaagaccatggccatggtgctgtccatcgtcagcctgttccccctctgcctgtccacgaccagccagaagaccacctggctgcccgtgctcctgggctccctggggtgcaagccgctcacgatgttcctgatcgccgagaacaagatctggggccgcaagagctggcccctgaacgaggggatcatggccgtgggcatcgtcagcatcctcctgtccagcctgctcaagaacgacgtgcccctggccgggcccctgatcgcgggcggcatgctcatcgcctgctacgtgatctccgggagctccgccgacctgagcctggagaaggccgccgaggtctcctgggaggaggaggcggagcacagcggcgcctcccacaacatcctcgtggaggtgcaggacgacgggaccatgaagatcaaggacgaggagcgggacgacaccctgaccatcctgctcaaggccaccctgctggccgtcagcggcgtgtacccgctctccatccccgccacgctgttcgtgtggtacttctggcagaagaagaagcagcgcagcggggtcctgtgggacacccccagcccgcccgaggtggagcgggcggtgctcgacgacggcatctaccgcatcatgcagcggggcctgctggggcgcagccaggtcggcgtgggggtgttccaggagaacgtcttccacaccatgtggcacgtgacccggggcgccgtgctgatgtaccaggggaagcgcctcgagccctcctgggccagcgtcaagaaggacctgatctcctacggcggcgggtggcggctgcagggcagctggaacacgggggaggaggtccaggtgatcgccgtcgagcccggcaagaaccccaagaacgtgcagaccgcccccgggaccttcaagacctccgagggcgaggtgggcgcgatcgccctcgacttcaagcccgggacgagcggcagccccatcgtcaaccgcgaggggaagatcgtgggcctgtacggcaacggggtggtcaccacctccggcacctacgtgagcgccatcgcccaggcgaaggcctcccaggaggggcccctgccggagatcgaggacgaggtgttccggaagcgcaacctcacgatcatggacctgcaccccggcagcgggaagacccggcgctacctgcccgccatcgtccgggaggccatcaagcgcaagctccggaccctgatcctggccccgacccgcgtggtggcgtccgagatggccgaggccctcaagggcatgcccatccgctaccagacgaccgccgtcaagagcgagcacaccggcaaggagatcgtggacctgatgtgccacgccaccttcacgatgcggctgctctcccccgtgcgcgtccccaactacaacatgatcatcatggacgaggcgcacttcaccgacccgagctccatcgccgcccgggggtacatcagcacccgcgtgggcatgggggaggccgccgcgatcttcatgaccgccacgccgcccggctccgtggaggccttcccccagagcaacgccgtcatccaggacgaggagcgggacatcccggagcgctcctggaacagcgggtacgagtggatcaccgacttccccggcaagaccgtgtggttcgtgccctccatcaagagcggcaacgacatcgcgaactgcctgcggaagaacgggaagcgcgtcatccagctgtcccggaagaccttcgacacggagtaccagaagaccaagaacaacgactgggactacgtggtgaccaccgacatcagcgagatgggcgccaacttccgcgccgaccgggtcatcgacccccgccggtgcctcaagccggtgatcctgaaggacgggcccgagcgcgtgatcctggccggccccatgcccgtcacggtggcctccgcggcccagcggcgcgggcggatcggccgcaaccacaacaaggagggcgaccagtacatctacatggggcagccgctcaacaacgacgaggaccacgcccactggaccgaggccaagatgctgctggacaacatcaacacccccgagggcatcatccccgccctcttcgagcccgagcgggagaagtccgcggccatcgacggggagtaccgcctgcgcggcgaggcccggaagaccttcgtcgagctgatgcgccgcggggacctcccggtgtggctgagctacaaggtggcctccgagggcttccagtacagcgaccgccggtggtgcttcgacggcgagcgcaacaaccaggtcctggaggagaacatggacgtggagatctggacgaaggagggggagcggaagaagctccgcccccggtggctggacgcccgcacctactccgaccccctggcgctccgggagttcaaggagttcgccgccggccgccggagcgtgtccggggacctgatcctggagatcggcaagctcccccagcacctgacccagcgcgcccagaacgcgctggacaacctcgtcatgctgcacaacagcgagcagggcgggcgggcctaccgccacgccatggaggagctgccggacaccatcgagacgctcatgctgctggccctcatcgccgtgctgaccggcggggtgaccctgttcttcctctccggccgggggctgggcaagaccagcatcggcctgctctgcgtcatggcgtccagcgtgctgctgtggatggcctccgtggagccccactggatcgccgccagcatcatcctcgagttcttcctgatggtcctgctcatccccgagcccgaccgccagcggaccccgcaggacaaccagctggcctacgtggtgatcgggctcctcttcatgatcctgacggtcgcggccaacgagatgggcctgctcgagaccaccaagaaggacctggggatcggccacgtggccgtggagaaccaccaccacgccgccatgctggacgtcgacctccaccccgcgtccgcctggaccctgtacgccgtggccacgaccatcatcacccccatgatgcgccacaccatcgagaacacgaccgccaacatcagcctgaccgcgatcgccaaccaggccgccatcctcatggggctggacaagggctggccgatctccaagatggacatcggcgtgcccctgctcgcgctggggtgctacagccaggtcaaccccctgaccctcacggccgccgtgctgatgctggtggcccactacgccatcatcggccccgggctccaggcgaaggccacccgggaggcccagaagcgcaccgccgccggcatcatgaagaacccgaccgtcgacgggatcgtggcgatcgacctggaccccgtggtctacgacgccaagttcgagaagcagctgggccagatcatgctcctgatcctgtgcacgtcccagatcctcctgatgcgcaccacctgggccctgtgcgagagcatcaccctcgccacgggccccctgaccaccctgtgggaggggtcccccggcaagttctggaacaccacgatcgccgtgagcatggcgaacatcttccgggggagctacctcgccggcgccggcctggccttctccctgatgaagtccctcgggggcgggcgccggggcaccggggcgcagggcgagaccctgggcgagaagtggaagcgccagctgaaccagctctccaagagcgagttcaacacctacaagcggtccgggatcatggaggtggaccgcagcgaggccaaggagggcctgaagcgcggggagacgaccaagcacgccgtctcccgcggcaccgccaagctgcggtggttcgtggagcgcaacctcgtgaagccggaggggaaggtcatcgacctgggctgcggccgcggcgggtggagctactactgcgccgggctgaagaaggtgaccgaggtgaaggggtacacgaagggcgggcccggccacgaggagcccatccccatggcgacctacgggtggaacctggtcaagctccactccggcaaggacgtgttcttcatcccgcccgagaagtgcgacaccctgctgtgcgacatcggggagagctcccccaaccccaccatcgaggagggccgcacgctccgggtgctgaagatggtcgagccgtggctgcgcgggaaccagttctgcatcaagatcctcaacccctacatgcccagcgtggtggagaccctggagcagatgcagcggaagcacggcggcatgctggtccgcaaccccctctcccggaacagcacccacgagatgtactgggtgtcctgcgggaccggcaacatcgtgagcgccgtcaacatgacctcccgcatgctgctgaaccggttcacgatggcccaccgcaagccgacctacgagcgcgacgtggacctcggggccggcacccggcacgtggccgtcgagcccgaggtggcgaacctggacatcatcggccagcgcatcgagaacatcaagcacgagcacaagagcacctggcactacgacgaggacaacccctacaagacgtgggcctaccacgggtcctacgaggtgaagcccagcggcagcgcctccagcatggtcaacggggtggtcaagctgctcaccaagccgtgggacgtgatccccatggtgacccagatcgccatgaccgacacgacccccttcggccagcagcgggtcttcaaggagaaggtggacacccgcacccccaaggccaagcgggggacggcgcagatcatggaggtgaccgccaagtggctgtggggcttcctgtcccgcaacaagaagccgcggatctgcacccgcgaggagttcacccggaaggtccgcagcaacgccgccatcggcgcggtgttcgtggacgagaaccagtggaactccgccaaggaggccgtcgaggacgagcggttctgggacctcgtgcaccgcgagcgggagctgcacaagcaggggaagtgcgccacgtgcgtgtacaacatgatgggcaagcgcgagaagaagctgggggagttcggcaaggccaaggggagccgggcgatctggtacatgtggctcggcgcccgcttcctggagttcgaggccctgggcttcatgaacgaggaccactggttctcccgggagaacagcctctccggggtcgagggcgaggggctgcacaagctgggctacatcctccgcgacatcagcaagatccccgggggcaacatgtacgccgacgacaccgccggctgggacacccggatcaccgaggacgacctgcagaacgaggcgaagatcacggacatcatggagcccgagcacgccctgctcgccaagtccatcttcaagctgacctaccagaacaaggtggtgcgcgtccagcggccggccaagaacgggaccgtgatggacgtgatcagccgccgcgaccagcggggctccgggcaggtcggcacctacggcctgaacacgttcaccaacatggaggcccagctcatccgccagatggagagcgaggggatcttctcccccagcgagctggagacccccaacctggcgggccgggtgctcgactggctggagaagcacggggtggagcgcctgaagcggatggccatctccggcgacgactgcgtcgtgaagcccatcgacgaccgcttcgccaccgccctcacggccctgaacgacatggggaaggtgcggaaggacatcccgcagtgggagcccagcaagggctggaacgactggcagcaggtccccttctgcagccaccacttccaccagctgatcatgaaggacggccgcgagatcgtggtgccctgccggaaccaggacgagctcgtcgggcgcgcgcgggtgtcccagggcgccgggtggagcctgcgcgagaccgcctgcctgggcaagtcctacgcccagatgtggcagctcatgtacttccaccggcgcgacctgcggctggcggccaacgccatctgcagcgccgtgccggtcgactgggtgcccacctcccgcaccacgtggagcatccacgcccaccaccagtggatgaccaccgaggacatgctctccgtgtggaaccgggtctggatcgaggagaacccctggatggaggacaagacccacatcagctcctggggcgacgtgccctacctgggcaagcgcgaggaccagtggtgcggcagcctgatcgggctcacggcgcgggccacctgggccaccaacatccaggtggccatcaaccaggtccgccgcctgatcggcaacgagaactacctggactacatgacctccatgaagcggttcaagaacgagagcgacccggagggggccctctggtga

SEQ ID NO: 8412 - RNA, 9879 nt, synthetic construct
  misc_feature 1..9879: note = derived and/or modified CDS sequence (opt1) from DENV-1__FJ410242__SS-prME
  source 1..9879: mol_type = other RNA
agcgtgaccatgctgctcatgctgatgcccaccgccctggccttccacctcaccacccggggcggggagccgcacatgatcgtgagcaagcaggagcggggcaagagcctgctgttcaagaccagcgcgggggtgaacatgtgcaccctcatcgccatggacctgggcgagttctgcgaggacaccatgacctacaagtgcccccgcatcaccgaggccgagcccgacgacgtggactgctggtgcaacgccaccgacacgtgggtcacctacgggacctgcagccagaccggcgagcaccggcgggacaagcggagcgtggccctggcgccccacgtgggcctcgggctggagacgcgcaccgagacctggatgagctccgagggcgcctggaagcagatccagcgggtcgagacctgggccctgcgccacccggggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggaccagcggggcctccaccagccaggagacctggaaccggaaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctcgtccagatcaagtacgagggcaccgacgccccctgcaagatccccttctccacccaggacgagaagggggtgacccagaacggccggctgatcacggccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacaccgcctgggacttcgggagcatcggcggcgtgttcacgtccgtcgggaagctggtgcaccagatcttcggcaccgcctacggggtgctgttcagcggcgtctcctggaccatgaagatcgggatcggcgtgctcctgacctggctgggcctcaacagccgctccacgagcctgtccatgacctgcatcgccgtggggctggtcaccctctacctgggcgtgatggtgcaggccgacagcgggtgcgtcatcaactggaagggccgggagctgaagtgcgggagcggcatcttcgtgaccaacgaggtgcacacgtggaccgagcagtacaagttccaggcggactccccgaagcgcctcagcgccgccatcggcaaggcctgggaggagggggtctgcggcatccggtccaccacccgcctggagaacatcatgtggaagcagatcagcaacgagctgaaccacatcctcctggagaacgacatgaagttcaccgtggtggtcggggacgtggccggcatcctggcgcaggggaagaagatgatccggccccagcccatggagtacaagtactcctggaagtcctggggcaaggccaagatcatcggcgccgacgtgcagaacacgaccttcatcatcgacgggcccaacaccccggagtgctccgacgaccagcgcgcctggaacatctgggaggtcgaggactacggcttcgggatcttcaccacgaacatctggctcaagctgcgggacagctacacccaggtgtgcgaccaccgcctgatgtccgcggccatcaaggacagcaaggccgtgcacgccgacatgggctactggatcgagtccgagaagaacgagacctggaagctcgcccgggcgagcttcatcgaggtcaagacctgcatctggcccaagtcccacacgctgtggagcaacggcgtgctggagtccgagatgatcatccccaagatctacgggggccccatcagccagcacaactaccgcccggggtacttcacccagaccgccggcccctggcacctcgggaagctggagctggacttcgacctctgcgagggcaccacggtggtcgtggacgagcactgcggcaaccgggggccctccctgcgcaccaccaccgtgacgggcaagatcatccacgagtggtgctgccggagctgcaccctgccgcccctccgcttcaagggggaggacggctgctggtacgggatggagatccggcccgtcaaggagaaggaggagaacctggtcaagagcatggtgtccgccggcagcggcgaggtcgactccttcagcctggggctcctgtgcatctccatcatgatcgaggaggtgatgcgcagccggtggtcccgcaagatgctgatgaccggcaccctcgccgtgttcttcctgctgatcatggggcagctcacgtggaacgacctgatccggctgtgcatcatggtcggcgccaacgcgagcgaccgcatggggatgggcaccacctacctcgccctgatggccaccttcaagatgcgccccatgttcgccgtgggcctcctgttccggcgcctgacgtcccgggaggtgctgctcctgaccatcgggctgagcctcgtcgcctccgtggagctgccgaacagcctggaggagctcggcgacgggctggcgatgggcatcatgatcctgaagctcctgaccgacttccagtcccaccagctgtgggccaccctcctgagcctgacgttcatcaagaccaccttctccctccactacgcctggaagaccatggccatggtcctgagcatcgtgtccctgttccccctctgcctgagcacgacctcccagaagaccacctggctgcccgtgctcctgggcagcctggggtgcaagcccctcacgatgttcctgatcgcggagaacaagatctggggccgcaagagctggccgctgaacgaggggatcatggccgtcggcatcgtgtccatcctcctgagctccctgctcaagaacgacgtgcccctggccgggcccctgatcgccggcggcatgctcatcgcctgctacgtcatcagcgggtccagcgcggacctgtccctggagaaggccgccgaggtgagctgggaggaggaggccgagcactccggcgccagccacaacatcctcgtggaggtccaggacgacgggaccatgaagatcaaggacgaggagcgggacgacaccctgaccatcctgctcaaggcgaccctgctggccgtgtccggcgtgtaccccctcagcatcccggccacgctgttcgtctggtacttctggcagaagaagaagcagcgctccggggtgctgtgggacaccccctccccgcccgaggtggagcgggccgtcctcgacgacggcatctaccgcatcatgcagcggggcctgctggggcgctcccaggtgggcgtgggggtcttccaggagaacgtgttccacaccatgtggcacgtgacccggggcgccgtcctgatgtaccaggggaagcgcctcgagccgagctgggcgtccgtgaagaaggacctgatcagctacggcggcgggtggcggctgcagggctcctggaacacgggggaggaggtgcaggtcatcgccgtggagcccggcaagaaccccaagaacgtgcagaccgcccccgggaccttcaagaccagcgagggcgaggtcggcgccatcgccctcgacttcaagccggggacgagcggctcccccatcgtgaaccgcgaggggaagatcgtgggcctgtacggcaacggggtcgtgaccaccagcggcacctacgtgtccgcgatcgcccaggccaaggccagccaggaggggcccctgcccgagatcgaggacgaggtcttccggaagcgcaacctcacgatcatggacctgcacccgggctccgggaagacccggcgctacctgcccgcgatcgtgcgggaggccatcaagcgcaagctccggaccctgatcctggcccccacccgcgtggtcgccagcgagatggccgaggcgctcaagggcatgccgatccgctaccagacgaccgccgtgaagtccgagcacaccggcaaggagatcgtggacctgatgtgccacgccaccttcacgatgcggctgctcagccccgtccgcgtgcccaactacaacatgatcatcatggacgaggcccacttcaccgacccctccagcatcgccgcgcgggggtacatctccacccgcgtgggcatgggggaggccgccgccatcttcatgaccgccacgccgcccggcagcgtcgaggcgttcccccagtccaacgccgtgatccaggacgaggagcgggacatccccgagcgcagctggaactccgggtacgagtggatcaccgacttcccgggcaagaccgtgtggttcgtccccagcatcaagtccggcaacgacatcgccaactgcctgcggaagaacgggaagcgcgtgatccagctgagccggaagaccttcgacacggagtaccagaagaccaagaacaacgactgggactacgtggtcaccaccgacatctccgagatgggcgccaacttccgcgcggaccgggtgatcgacccccgccggtgcctcaagcccgtgatcctgaaggacgggccggagcgcgtcatcctggccggccccatgcccgtgacggtcgccagcgccgcccagcggcgcgggcggatcggccgcaaccacaacaaggagggcgaccagtacatctacatggggcagcccctcaacaacgacgaggaccacgcgcactggaccgaggccaagatgctgctggacaacatcaacaccccggagggcatcatccccgccctcttcgagcccgagcgggagaagtccgccgccatcgacggggagtaccgcctgcgcggcgaggcgcggaagaccttcgtggagctgatgcgccgcggggacctccccgtgtggctgtcctacaaggtcgccagcgagggcttccagtactccgaccgccggtggtgcttcgacggcgagcgcaacaaccaggtgctggaggagaacatggacgtggagatctggacgaaggagggggagcggaagaagctccgcccgcggtggctggacgcccgcacctacagcgaccccctggccctccgggagttcaaggagttcgccgcgggccgccggtccgtcagcggggacctgatcctggagatcggcaagctcccccagcacctgacccagcgcgcccagaacgccctggacaacctcgtgatgctgcacaactccgagcagggcgggcgggcctaccgccacgcgatggaggagctgcccgacaccatcgagacgctcatgctgctggccctcatcgccgtgctgaccggcggggtcaccctgttcttcctcagcggccgggggctgggcaagacctccatcggcctgctctgcgtgatggccagctccgtgctgctgtggatggccagcgtcgagccgcactggatcgcggcctccatcatcctcgagttcttcctgatggtgctgctcatccccgagcccgaccgccagcggacgccccaggacaaccagctggcctacgtggtcatcgggctcctgttcatgatcctgacggtggccgccaacgagatgggcctgctcgagaccaccaagaaggacctggggatcggccacgtggcggccgagaaccaccaccacgccgccatgctggacgtcgacctccacccggccagcgcgtggaccctgtacgccgtggccacgaccatcatcacccccatgatgcgccacaccatcgagaacacgaccgccaacatctccctgaccgccatcgcgaaccaggccgccatcctcatggggctggacaagggctggcccatcagcaagatggacatcggcgtgccgctgctcgccctggggtgctactcccaggtcaaccccctgaccctcacggcggccgtgctgatgctggtggcccactacgccatcatcggccccgggctccaggccaaggcgacccgggaggcccagaagcgcaccgccgccggcatcatgaagaaccccaccgtcgacgggatcgtggccatcgacctggacccggtggtctacgacgcgaagttcgagaagcagctgggccagatcatgctcctgatcctgtgcacgagccagatcctcctgatgcgcaccacctgggccctgtgcgagtccatcaccctcgccacgggccccctgaccaccctgtgggaggggagccccggcaagttctggaacaccacgatcgccgtgagcatggccaacatcttccgggggtcctacctcgcgggcgccggcctggccttcagcctgatgaagtccctcgggggcgggcgccggggcaccggggcccagggcgagaccctgggcgagaagtggaagcgccagctgaaccagctcagcaagtccgagttcaacacctacaagcggagcgggatcatggaggtggaccgctccgaggcgaaggagggcctgaagcgcggggagacgaccaagcacgccgtcagccgcggcaccgccaagctgcggtggttcgtggagcgcaacctcgtgaagcccgaggggaaggtcatcgacctgggctgcggccgcggcgggtggtcctactactgcgccgggctgaagaaggtgaccgaggtgaaggggtacacgaagggcgggccgggccacgaggagcccatccccatggccacctacgggtggaacctggtcaagctccacagcggcaaggacgtgttcttcatcccgcccgagaagtgcgacaccctgctgtgcgacatcggggagtccagccccaaccccaccatcgaggagggccgcacgctccgggtgctgaagatggtcgagccctggctgcgcgggaaccagttctgcatcaagatcctcaacccctacatgccctccgtggtggagaccctggagcagatgcagcggaagcacggcggcatgctggtccgcaaccccctcagccggaactccacccacgagatgtactgggtgagctgcgggaccggcaacatcgtgtccgcggtcaacatgaccagccgcatgctgctgaaccggttcacgatggcccaccgcaagcccacctacgagcgcgacgtggacctcggggccggcacccggcacgtggccgtcgagccggaggtggccaacctggacatcatcggccagcgcatcgagaacatcaagcacgagcacaagtccacctggcactacgacgaggacaacccctacaagacgtgggcgtaccacgggagctacgaggtgaagcccagcggctccgccagctccatggtcaacggggtggtcaagctgctcaccaagccctgggacgtgatcccgatggtgacccagatcgccatgaccgacacgacccccttcggccagcagcgggtcttcaaggagaaggtggacacccgcacccccaaggccaagcgggggacggcccagatcatggaggtgaccgcgaagtggctgtggggcttcctgagccgcaacaagaagccccggatctgcacccgcgaggagttcacccggaaggtccgctccaacgccgccatcggcgccgtgttcgtggacgagaaccagtggaacagcgcgaaggaggccgtcgaggacgagcggttctgggacctcgtgcaccgcgagcgggagctgcacaagcaggggaagtgcgccacgtgcgtgtacaacatgatgggcaagcgcgagaagaagctgggggagttcggcaaggccaaggggtcccgggccatctggtacatgtggctcggcgcgcgcttcctggagttcgaggccctgggcttcatgaacgaggaccactggttcagccgggagaactccctcagcggggtcgagggcgaggggctgcacaagctgggctacatcctccgcgacatctccaagatccccgggggcaacatgtacgccgacgacaccgccggctgggacacccggatcaccgaggacgacctgcagaacgaggccaagatcacggacatcatggagcccgagcacgcgctgctcgccaagagcatcttcaagctgacctaccagaacaaggtggtgcgcgtccagcggcccgccaagaacgggaccgtgatggacgtgatctcccgccgcgaccagcggggcagcgggcaggtcggcacctacggcctgaacacgttcaccaacatggaggcccagctcatccgccagatggagtccgaggggatcttcagcccgtccgagctggagacccccaacctggccggccgggtgctcgactggctggagaagcacggggtggagcgcctgaagcggatggcgatcagcggcgacgactgcgtcgtgaagcccatcgacgaccgcttcgccaccgccctcacggccctgaacgacatggggaaggtgcggaaggacatcccccagtgggagccgagcaagggctggaacgactggcagcaggtccccttctgctcccaccacttccaccagctgatcatgaaggacggccgcgagatcgtggtgccctgccggaaccaggacgagctcgtcgggcgcgcccgggtgagccagggcgcggggtggtccctgcgcgagaccgcctgcctgggcaagagctacgcccagatgtggcagctcatgtacttccaccggcgcgacctgcggctggccgcgaacgccatctgctccgccgtgcccgtcgactgggtgccgaccagccgcaccacgtggtccatccacgcccaccaccagtggatgaccaccgaggacatgctcagcgtgtggaaccgggtctggatcgaggagaacccctggatggaggacaagacccacatctccagctggggcgacgtgccctacctgggcaagcgcgaggaccagtggtgcggctccctgatcgggctcacggcccgggcgacctgggccaccaacatccaggtggccatcaaccaggtccgccgcctgatcggcaacgagaactacctggactacatgaccagcatgaagcggttcaagaacgagtccgaccccgagggggccctctggtga

SEQ ID NO: 8413 - RNA, 9879 nt, synthetic construct
  misc_feature 1..9879: note = derived and/or modified CDS sequence (opt1) from DENV-1__FJ410243__SS-prME
  source 1..9879: mol_type = other RNA
tccgtgaccatgctgctcatgctgatgcccaccgccctggccttccacctcaccacccgcggcggggagccccacatgatcgtctccaagcaggagcggggcaagagcctgctgttcaagacctccgcgggggtgaacatgtgcaccctcatcgccatggacctgggcgagttctgcgaggacacgatgacctacaagtgcccccgcatcaccgaggccgagcccgacgacgtggactgctggtgcaacgccaccgacacgtgggtcacctacgggacctgcagccagaccggcgagcaccggcgcgacaagcggtccgtggccctggcgccccacgtgggcctcgggctggagacgcgcaccgagacctggatgagctccgagggcgcctggaagcagatccagcgggtcgagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgccccacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagaccgtccagtacgagaacctgaagtacagcgtgatcgtgaccgtccacacgggcgaccagcaccaggtggggaacgagtccaccgagcacggcaccaccgcgaccatcacgccccaggcccccagcaccgagatccagctgaccgactacggggccctcaccctggactgcagcccccggacgggcctggacttcaacgagatggtcctcctgaccatgaaggagaaggcctggctggtgcacaagcagtggttcctcgacctgccgctgccctggaccagcggggccagcacctcccaggagacgtggaaccggaaggacctcctggtgaccttcaagaccgcgcacgccaagaagcaggaggtcgtggtgctgggcagccaggagggcgccatgcacaccgccctcacgggggccaccgagatccagacctccggcaccacgaccatcttcgcggggcacctgaagtgccgcctgaagatggacaagctcaccctgcggggcatgagctacgtcatgtgcaccgggtccttcaagctggagaaggaggtggccgagacgcagcacggcaccgtgctcgtccagatcaagtacgagggcaccgacgccccctgcaagatccccttcagcacccaggacgagaagggggtgacgcagaacggccgcctgatcaccgccaaccccatcgtgaccgacaaggagaagcccgtcaacatcgaggcggagccgcccttcggggagtcctacatcgtgatcggcgccggcgagaaggccctgaagctgagctggttcaagaaggggtccagcatcggcaagatgttcgaggccaccgcccgcggggcgcgccgcatggccatcctcggcgacacggcctgggacttcgggtccatcggcggcgtgttcaccagcgtcgggaagctggtgcaccagatcttcggcaccgcctacggggtgctgttctccggcgtcagctggaccatgaagatcgggatcggcgtgctcctgacgtggctgggcctcaactcccggagcacctccctgagcatgacctgcatcgccgtggggctggtcaccctctacctgggcgtgatggtgcaggcggactccgggtgcgtcatcaactggaagggccgcgagctgaagtgcgggagcggcatcttcgtgacgaacgaggtgcacacctggaccgagcagtacaagttccaggccgacagcccgaagcggctctccgccgccatcggcaaggcctgggaggagggggtctgcggcatccgcagcgcgacccggctggagaacatcatgtggaagcagatctccaacgagctgaaccacatcctcctggagaacgacatgaagttcaccgtggtggtcggggacgtggccggcatcctggcccaggggaagaagatgatccgcccccagcccatggagtacaagtacagctggaagtcctggggcaaggccaagatcatcggcgcggacgtgcagaacgccacgttcatcatcgacgggcccaacaccccggagtgccccgacgaccagcgggcctggaacatctgggaggtcgaggactacggcttcgggatcttcaccaccaacatctggctcaagctgcgcgacagctacacccaggtgtgcgaccaccggctgatgtccgccgccatcaaggacagcaaggcggtgcacgccgacatgggctactggatcgagtccgagaagaacgagacctggaagctcgcccgcgccagcttcatcgaggtcaagacctgcatctggcccaagtcccacaccctgtggagcaacggcgtgctggagtccgagatgatcatccccaagatctacgggggcccgatcagccagcacaactaccggcccgggtacttcacgcagaccgccggcccctggcacctcgggaagctggagctggacttcgacctctgcgagggcaccaccgtggtcgtggacgagcactgcggcaaccgcgggccgtccctgcggacgaccaccgtgaccggcaagatcatccacgagtggtgctgccgcagctgcacgctgccgcccctgcggttcaagggggaggacggctgctggtacgggatggagatccgccccgtcaaggagaaggaggagaacctggtgaagtccatggtgagcgcgggcagcggcgaggtcgactccttcagcctggggctcctgtgcatctccatcatgatcgaggaggtgatgcggagccgctggtcccggaagatgctgatgaccggcaccctcgccgtgttcttcctgctgatcatggggcagctcacctggaacgacctgatccgcctgtgcatcatggtcggcgccaacgccagcgaccgcatggggatgggcacgacctacctcgccctgatggcgaccttcaagatgcggccgatgttcgccgtggggctcctgttccgccggctgacctcccgcgaggtgctgctcctgacgatcgggctgagcctcgtcgcctccgtggagctgcccaacagcctggaggagctcggcgacgggctggccatgggcatcatgatcctgaagctcctgaccgacttccagtcccaccagctgtgggcgaccctcctgagcctgaccttcatcaagacgaccttctccctccactacgcctggaagaccatggccatggtcctgagcatcgtgtccctgttccccctctgcctgagcaccacgtcccagaagaccacctggctgcccgtgctcctgggcagcctggggtgcaagccgctcaccatgttcctgatcgccgagaacaagatctggggccggaagtcctggcccctgaacgaggggatcatggccgtcggcatcgtgagcatcctcctgagctccctgctcaagaacgacgtgcccctggcggggcccctgatcgccggcggcatgctcatcgcctgctacgtcatcagcgggtccagcgccgacctgtccctggagaaggccgcggaggtgagctgggaggaggaggccgagcactccggcgccagccacaacatcctcgtggaggtccaggacgacgggccgatgaagatcaaggacgaggagcgcgacgacatgctgacgatcctgctcaaggccaccctgctggccgtgtccggcgtgtaccccctcagcatccccgcgaccctgttcgtctggtacttctggcagaagaagaagcagcggtccggggtgctgtgggacacccccagcccgcccgaggtggagcgcgccgtcctcgacgacggcatctaccggatcatgcagcgcggcctgctggggcggtcccaggtgggcgtgggggtcttccaggagaacgtgttccacaccatgtggcacgtgacgcgcggcgccgtcctgatgtaccaggggaagcggctcgagcccagctgggcctccgtgaagaaggacctgatcagctacggcggcgggtggcgcctgcagggctcctggaacaccggggaggaggtgcaggtcatcgccgtggagcccggcaagaacccgaagaacgtgcagaccgcgcccgggaccttcaagacgagcgagggcgaggtcggcgccatcgccctcgacttcaagcccgggacctccggcagccccatcgtgaaccgggaggggaagatcgtgggcctgtacggcaacggggtcgtgaccaccagcggcacgtacgtgtccgccatcgcgcaggccaaggccagccaggaggggccgctgcccgagatcgaggacgaggtcttccgcaagcggaacctcaccatcatggacctgcaccccggctccgggaagacccgccggtacctgccggccatcgtgcgcgaggccatcaagcggaagctccgcaccctgatcctggcgcccacgcgcgtggtcgccagcgagatggccgaggccctcaagggcatgcccatccggtaccagaccaccgccgtgaagtccgagcacaccggcaaggagatcgtggacctgatgtgccacgcgacgttcaccatgcgcctgctcagccccgtccgggtgccgaactacaacatgatcatcatggacgaggcccacttcaccgacccctccagcatcgccgcccgcgggtacatctccacccgggtgggcatgggggaggccgcggccatcttcatgacggccacgccgcccggcagcatggaggccttcccgcagtccaacgcggtcatccaggacgaggagcgcgacatccccgagcggagctggaactccgggtacgagtggatcaccgacttccccggcaagaccgtgtggttcgtgcccagcatcaagtccggcaacgacatcgccaactgcctgcgcaagaacgggaagcgggtcatccagctgagccgcaagacgttcgacaccgagtaccagaagaccaagaacaacgactgggactacgtggtgaccacggacatctccgagatgggcgccaacttccgggccgaccgcgtcatcgacccgcggcgctgcctcaagcccgtgatcctgaaggacgggcccgagcgggtgatcctggccggccccatgccggtcaccgtggcgagcgccgcccagcgccgggggcgcatcggccggaaccacaacaaggagggcgaccagtacatctacatggggcagcccctcaacaacgacgaggaccacgcccactggaccgaggccaagatgctgctggacaacatcaacacccccgagggcatcatccccgccctcttcgagccggagcgcgagaagtccgccgccatcgacggggagtaccgcctgcggggcgaggcccgcaagacgttcgtcgagctgatgcggcgcggggacctccccgtgtggctgagctacaaggtggccagcgagggcttccagtactccgaccggcgctggtgcttcgacggcgagcggaacaaccaggtcctggaggagaacatggacgtggagatctggaccaaggagggggagcgcaagaagctccggccccgctggctggacgcgcggacctacagcgaccccctggccctccgcgagttcaaggagttcgccgccggccggcgctccgtgagcggggacctgatcctggagatcggcaagctcccgcagcacctgacccagcgggcgcagaacgccctggacaacctcgtcatcctgcacaactccgagcagggcgggcgcgcctaccggcacgccatggaggagctgcccgacacgatcgagaccctcatgctgctggccctcatcgcggtgctgaccggcggggtgaccctgttcttcctcagcggccgcgggctgggcaagacgtccatcggcctgctctgcgtcatggccagctccgtgctgctgtggatggccagcgtggagccccactggatcgccgcctccatcatcctcgagttcttcctgatggtcctgctcatccccgagccggaccggcagcgcacgccccaggacaaccagctggcgtacgtggtgatcgggctcctcttcatgatcctgaccgtcgccgccaacgagatgggcctgctcgagaccaccaagaaggacctggggatcggccacgtggccgtggagaaccaccaccacgccgcgatgctggacgtcgacctccaccccgccagcgcctggacgctgtacgccgtggccaccaccatcatcaccccgatgatgcggcacacgatcgagaacaccaccgcgaacatctccctgaccgccatcgccaaccaggccgcgatcctcatggggctggacaagggctggcccatcagcaagatggacatcggcgtgcccctgctcgccctggggtgctactcccaggtcaaccccctgacgctcaccgccgccgtgctgatgctggtggcccactacgcgatcatcggcccggggctccaggccaaggccacccgcgaggcccagaagcgcaccgccgcgggcatcatgaagaaccccacggtcgacgggatcgtggccatcgacctggaccccgtggtctacgacaccaagttcgagaagcagctgggccagatcatgctcctgatcctgtgcaccagccagatcctcctgatgcggaccacgtgggccctgtgcgagtccatcaccctcgccaccggccccctgaccacgctgtgggaggggagcccgggcaagttctggaacaccaccatcgccgtgtccatggcgaacatcttccgcgggagctacctcgccggcgccggcctggccttcagcctgatgaagtccctcgggggcgggcggcgcggcaccggggcgcagggcgagacgctgggcgagaagtggaagcggcagctgaaccagctcagcaagtccgagttcaacacctacaagcgcagcgggatcatggaggtggaccggtccgaggccaaggagggcctgaagcgcggggagaccaccaagcacgccgtcagccggggcacggccaagctgcgctggttcgtggagcggaacctcgtgaagcccgaggggaaggtcatcgacctgggctgcggccgcgggggctggtcctactactgcgccgggctgaagaaggtgaccgaggtgaagggctacaccaagggcgggcccggccacgaggagcccatcccgatggcgacctacgggtggaacctggtcaagctccacagcggcaaggacgtgttcttcatcccgcccgagaagtgcgacacgctgctgtgcgacatcggggagtccagccccaacccgaccatcgaggagggccggaccctccgcgtgctgaagatggtcgagccctggctgcgggggaaccagttctgcatcaagatcctcaacccctacatgccctccgtggtggagaccctggagcagatgcagcgcaagcacggcggcatgctggtccggaacccgctcagccgcaactccacgcacgagatgtactgggtgagctgcgggaccggcaacatcgtgtccgccgtcaacatgaccagccggatgctgctgaaccgcttcaccatggcccaccgcaagcccacctacgagcgggacgtggacctcggggccggcacgcgccacgtggccgtcgagcccgaggtggcgaacctggacatcatcggccagcggatcgagaacatcaagcacgagcacaagtccacctggcactacgacgaggacaacccctacaagacctgggcctaccacgggagctacgaggtgaagccgtccggcagcgccagctccatggtcaacggggtggtcaagctgctcaccaagccctgggacgtgatccccatggtgacgcagatcgccatgaccgacaccacccccttcggccagcagcgcgtcttcaaggagaaggtggacacgcggaccccgaaggccaagcgcgggaccgcgcagatcatggaggtgaccgccaagtggctgtggggcttcctgagccggaacaagaagccccgcatctgcacgcgggaggagttcacccgcaaggtccggtccaacgccgccatcggcgcggtgttcgtggacgagaaccagtggaacagcgccaaggaggccgtcgaggacgagcgcttctgggacctcgtgcaccgggagcgcgagctgcacaagcaggggaagtgcgcgacctgcgtgtacaacatgatgggcaagcgggagaagaagctgggggagttcggcaaggccaaggggtcccgcgcgatctggtacatgtggctcggcgcccggttcctggagttcgaggccctgggcttcatgaacgaggaccactggttcagccgcgagaactccctcagcggggtcgagggcgaggggctgcacaagctgggctacatcctccgggacatctccaagatccccgggggcaacatgtacgccgacgacaccgccggctgggacacgcgcatcaccgaggacgacctgcagaacgaggcgaagatcaccgacatcatggagccggagcacgccctgctcgccaagagcatcttcaagctgacctaccagaacaaggtggtgcgggtccagcgccccgccaagaacgggacggtgatggacgtgatctcccgccgggaccagcgcggcagcgggcaggtcggcacctacggcctgaacaccttcaccaacatggaggcccagctcatccggcagatggagtccgaggggatcttcagcccctccgagctggagacgcccaacctggcgggccgcgtgctcgactggctggagaagcacggggtggagcggctgaagcgcatggccatcagcggcgacgactgcgtcgtgaagccgatcgacgaccggttcgccaccgccctcaccgccctgaacgacatggggaaggtgcgcaaggacatcccccagtgggagccctccaagggctggaacgactggcagcaggtccccttctgcagccaccacttccaccagctgatcatgaaggacggccgggagatcgtggtgccgtgccgcaaccaggacgagctcgtcgggcgggcgcgcgtgagccagggcgccgggtggtccctgcgggagaccgcctgcctgggcaagagctacgcccagatgtggcagctcatgtacttccaccgccgggacctgcgcctggcggccaacgccatctgctccgccgtgcccgtcgactgggtgcccacgagccggaccacctggtccatccacgcccaccaccagtggatgaccacggaggacatgctcagcgtgtggaaccgcgtctggatcgaggagaacccctggatggaggacaagacccacatctccagctggggcgacgtgccgtacctgggcaagcgggaggaccagtggtgcggctccctgatcgggctcaccgcgcgcgccacctgggccacgaacatccaggtggccatcaaccaggtccgccggctgatcggcaacgagaactacctggactacatgaccagcatgaagcgcttcaagaacgagatcgaccccgagggggccctctggtga

SEQ ID NO: 8414 - RNA, 9879 nt, synthetic construct
  misc_feature 1..9879: note = derived and/or modified CDS sequence (opt1) from DENV-1__FJ410244__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagaccagcgcgggggtgaacatgtgcaccctcatcgccatggacctgggcgagttctgcgaggacacgatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagaccgtccagtacgagaacctgaagtacagcgtgatcgtgaccgtccacacgggcgaccagcaccaggtggggaacgagtccaccgagcacggcaccaccgcgaccatcacgccccaggcccccagcaccgagatccagctgaccgactacggggccctcaccctggactgcagcccccggacgggcctggacttcaacgagatggtcctcctgaccatgaaggagaagtcctggctggtgcacaagcagtggttcctcgacctgccgctgccctggaccagcggggcctccaccagccaggagacgtggaaccggaaggacctcctggtgaccttcaagaccgcccacgcgaagaagcaggaggtcgtggtgctgggctcccaggagggcgccatgcacaccgccctcacgggggccaccgagatccagaccagcggcaccacgaccatcttcgccgggcacctgaagtgccgcctgaagatgaacaagctcaccctgaagggcatgtcctacgtcatgtgcaccgggagcttcaagctggagaaggaggtggcggagacgcagcacggcaccgtgctcgtccagatcaagtacgagggcaccgacgccccctgcaagatccccttctccacccaggacgagaagggggtgacgcagaacggccggctgatcaccgccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacacggcctgggacttcgggagcatcggcggcgtgttcacctccgtcgggaagctggtgcaccagatcttcggcaccgcctacggggtgctgttcagcggcgtctcctggaccatgaagatcgggatcggcgtgctcctgacgtggctgggcctcaacagccgctccaccagcctgtccatgacctgcatcgccgtggggctggtcaccctctacctgggcgtgatggtgcaggccgacagcgggtgcgtcatcaactggaagggccgggagctgaagtgcgggagcggcatcttcgtgacgaacgaggtgcacacctggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagttcaccgtggtggtcggggacgtggcgggcatcctggcccaggggaagaagatgatccggccccagcccatggagtacaagtactcctggaagtcctggggcaaggccaagatcatcggcgccgacgtgcagaacacgaccttcatcatcgacgggcccaacaccccggagtgccccgacgaccagcgcgcgtggaacatctgggaggtcgaggactacggcttcgggatcttcaccacgaacatctggctcaacctgcgggactcctacacccaggtgtgcgaccaccgcctgatgagcgccgccatcaaggactccaaggccgtgcacgccgacatgggctactggatcgagagcgagaagaacgagacctggaagctcgcgcgggcctccttcatcgaggtcaagacctgcatctggcccaagagccacacgctgtggtccaacggcgtgctggagagcgagatgatcatccccaagatctacgggggcccgatctcccagcacaactaccgccccgggtacttcacccagaccgccggcccctggcacctcgggaagctggagctggacttcgacctctgcgagggcaccacggtggtcgtggacgagcactgcggcaaccgggggccgagcctgcgcaccaccaccgtgacgggcaagatcatccacgagtggtgctgccggtcctgcaccctgccgcccctgcgcttcaagggggaggacggctgctggtacgggatggagatccggcccgtcaaggagaaggaggagaacctggtcaagagcatggtgagcgccggctccggcgaggtcgacagcttctccctggggctcctgtgcatcagcatcatgatcgaggaggtgatgcgctcccggtggagccgcaagatgctgatgaccggcaccctcgccgtgttcttcctgctgatcatggggcagctcacgtggaacgacctgatccggctgtgcatcatggtcggcgcgaacgcctccgaccgcatggggatgggcaccacctacctcgccctgatggccaccttcaagatgcgcccgatgttcgccgtgggcctcctgttccggcgcctgacgagccgggaggtgctgctcctgaccatcgggctgtccctcgtcgcgagcgtggagctgcccaactccctggaggagctcggcgacgggctggccatgggcatcatgatcctgaagctcctgaccgacttccagagccaccagctgtgggccaccctcctgtccctgacgttcatcaagaccaccttcagcctccactacgcctggaagaccatggcgatggtcctgtccatcgtgagcctgttccccctctgcctgtccacgaccagccagaagaccacctggctgcccgtgctcctgggctccctggggtgcaagccgctcacgatgttcctgatcgccgagaacaagatctggggccgcaagagctggcccctgaacgaggggatcatggccgtcggcatcgtgagcatcctcctgtccagcctgctcaagaacgacgtgcccctggccgggcccctgatcgccggcggcatgctcatcgcgtgctacgtcatctccgggagctccgccgacctgagcctggagaaggccgccgaggtgtcctgggaggaggaggccgagcacagcggcgcgtcccacaacatcctcgtggaggtccaggacgacgggaccatgaagatcaaggacgaggagcgggacgacaccctgaccatcctgctcaaggccaccctgctggccgtgagcggcgtgtacccgctctccatccccgccacgctgttcgtctggtacttctggcagaagaagaagcagcgcagcggggtgctgtgggacacccccagcccgcccgaggtggagcgggccgtcctcgacgacggcatctaccgcatcatgcagcggggcctgctggggcgcagccaggtgggcgtgggggtcttccaggagaacgtgttccacaccatgtggcacgtgacccggggcgcggtcctgatgtaccaggggaagcgcctcgagccctcctgggccagcgtgaagaaggacctgatctcctacggcggcgggtggcggctgcagggcagctggaacacgggggaggaggtgcaggtcatcgccgtggagcccggcaagaaccccaagaacgtgcagaccgcccccgggaccttcaagacctccgagggcgaggtcggcgccatcgcgctcgacttcaagcccgggacgagcggcagccccatcgtgaaccgcgaggggaagatcgtgggcctgtacggcaacggggtcgtgaccacctccggcacctacgtgagcgccatcgcccaggccaaggcgtcccaggaggggcccctgccggagatcgaggacgaggtcttccggaagcgcaacctcacgatcatggacctgcaccccggcagcgggaagacccggcgctacctgcccgccatcgtgcgggaggccatcaagcgcaagctccggaccctgatcctggccccgacccgcgtggtcgcctccgagatggcggaggccctcaagggcatgcccatccgctaccagacgaccgccgtcaagagcgagcacaccggcaaggagatcgtggacctgatgtgccacgccaccttcacgatgcggctgctctcccccgtccgcgtgcccaactacaacatgatcatcatggacgaggcccacttcaccgacccgagctccatcgcggcccgggggtacatcagcacccgcgtgggcatgggggaggccgccgccatcttcatgaccgcgacgccgcccggctccgtcgaggccttcccccagagcaacgccatcatccaggacgaggagcgggacatcccggagcgctcctggaacagcgggtacgagtggatcaccgacttccccggcaagaccgtgtggttcgtgccctccatcaagagcggcaacgacatcgccaactgcctgcggaagaacgggaagcgcgtcatccagctgtcccggaagaccttcgacacggagtaccagaagaccaagaacaacgactgggactacgtggtgaccaccgacatcagcgagatgggcgcgaacttccgcgccgaccgggtcatcgacccccgccggtgcctcaagccggtgatcctgaaggacgggcccgagcgcgtgatcctggccggccccatgcccgtcacggtggcctccgccgcgcagcggcgcgggcggatcggccgcaaccacaacaaggagggcgaccagtacatctacatggggcagccgctcaacaacgacgaggaccacgcccactggaccgaggccaagatgctgctggacaacatcaacacccccgagggcatcatccccgccctcttcgagcccgagcgggagaagtccgccgcgatcgacggggagtaccgcctgcgcggcgaggcccggaagaccttcgtcgagctgatgcgccgcggggacctcccggtgtggctgagctacaaggtggcctccgagggcttccagtacagcgaccgccggtggtgcttcgacggcgagcgcaacaaccaggtcctggaggagaacatggacgtggagatctggacgaaggagggggagcggaagaagctccgcccccggtggctggacgcccgcacctactccgaccccctggccctccgggagttcaaggagttcgcggccggccgccggagcgtgtccggggacctgatcctggagatcggcaagctcccccagcacctgacccagcgcgcccagaacgccctggacaacctcgtcatgctgcacaacagcgagcagggcgggcgggcgtaccgccacgccatggaggagctgccggacaccatcgagacgctcatgctgctggccctcatcgccgtgctgaccggcggggtgaccctgttcttcctctccggccgggggctgggcaagaccagcatcggcctgctctgcgtcatggcctccagcgtgctgctgtggatggcgtccgtggagccccactggatcgccgccagcatcatcctcgagttcttcctgatggtcctgctcatccccgagcccgaccgccagcggaccccgcaggacaaccagctggcctacgtggtgatcgggctcctcttcatgatcctgacggtcgccgcgaacgagatgggcctgctcgagaccaccaagaaggacctggggatcggccacgtggccgtggagaaccaccaccacgccgccatgctggacgtcgacctccaccccgcctccgcgtggaccctgtacgccgtggccacgaccatcatcacccccatgatgcgccacaccatcgagaacacgaccgccaacatcagcctgaccgccatcgcgaaccaggccgccatcctcatggggctggacaagggctggccgatctccaagatggacatcggcgtgcccctgctcgccctggggtgctacagccaggtcaaccccctgaccctcacggcggccgtgctgatgctggtggcccactacgccatcatcggccccgggctccaggccaaggcgacccgggaggcccagaagcgcaccgccgccggcatcatgaagaacccgaccgtcgacgggatcgtggccatcgacctggaccccgtggtctacgacgcgaagttcgagaagcagctgggccagatcatgctcctgatcctgtgcacgtcccagatcctcctgatgcgcaccacctgggccctgtgcgagagcatcaccctcgccacgggccccctgaccaccctgtgggaggggtcccccggcaagttctggaacaccacgatcgccgtgagcatggccaacatcttccgggggagctacctcgcgggcgccggcctggccttctccctgatgaagtccctcgggggcgggcgccggggcaccggggcccagggcgagaccctgggcgagaagtggaagcgccagctgaaccagctctccaagagcgagttcaacacctacaagcggtccgggatcatggaggtggaccgcagcgaggcgaaggagggcctgaagcgcggggagacgaccaagcacgccgtctcccgcggcaccgccaagctgcggtggttcgtggagcgcaacctcgtgaagccggaggggaaggtcatcgacctgggctgcggccgcggcgggtggagctactactgcgccgggctgaagaaggtgaccgaggtgaaggggtacacgaagggcgggcccggccacgaggagcccatccccatggccacctacgggtggaacctggtcaagctccactccggcaaggacgtgttcttcatcccgcccgagaagtgcgacaccctgctgtgcgacatcggggagagctcccccaaccccaccatcgaggagggccgcacgctccgggtgctgaagatggtcgagccgtggctgcgcgggaaccagttctgcatcaagatcctcaacccctacatgcccagcgtggtggagaccctggagcagatgcagcggaagcacggcggcatgctggtccgcaaccccctctcccggaacagcacccacgagatgtactgggtgtcctgcgggaccggcaacatcgtgagcgcggtcaacatgacctcccgcatgctgctgaaccggttcacgatggcccaccgcaagccgacctacgagcgcgacgtggacctcggggccggcacccggcacgtggccgtcgagcccgaggtgcccaacctggacatcatcggccagcgcatcgagaacatcaagcacgagcacaagagcacctggcactacgacgaggacaacccctacaagacgtgggcctaccacgggtcctacgaggtgaagccgagcggcagcgcgtccagcatggtcaacggggtggtcaagctgctcaccaagccctgggacgtgatccccatggtgacccagatcgccatgaccgacacgacccccttcggccagcagcgggtcttcaaggagaaggtggacacccgcaccccgaaggccaagcgggggacggcccagatcatggaggtgaccgccaagtggctgtggggcttcctgtcccgcaacaagaagccccggatctgcacccgcgaggagttcacccggaaggtccgcagcaacgcggccatcggcgccgtgttcgtggacgagaaccagtggaactccgccaaggaggcggtcgaggacgagcggttctgggacctcgtgcaccgcgagcgggagctgcacaagcaggggaagtgcgccacgtgcgtgtacaacatgatgggcaagcgcgagaagaagctgggggagttcggcaaggccaaggggagccgggccatctggtacatgtggctcggcgcccgcttcctggagttcgaggcgctgggcttcatgaacgaggaccactggttctcccgggagaacagcctctccggggtcgagggcgaggggctgcacaagctgggctacatcctccgcgacatcagcaagatccccgggggcaacatgtacgccgacgacaccgccggctgggacacccggatcaccgaggacgacctgcagaacgaggccaagatcacggacatcatggagccggagcacgccctgctcgcgaagtccatcttcaagctgacctaccagaacaaggtggtgcgcgtccagcggcccgccaagaacgggaccgtgatggacgtgatcagccgccgcgaccagcggggctccgggcaggtcggcacctacggcctgaacacgttcaccaacatggaggcccagctcatccgccagatggagagcgaggggatcttctcccccagcgagctggagacccccaacctggccggccgggtgctcgactggctggagaagcacggggtggagcgcctgaagcggatggccatctccggcgacgactgcgtcgtgaagccgatcgacgaccgcttcgcgaccgccctcacggccctgaacgacatggggaaggtgcggaaggacgtcccccagtgggagcccagcaagggctggaacgactggcagcaggtccccttctgcagccaccacttccaccagctgatcatgaaggacggccgcgagatcgtggtcccgtgccggaaccaggacgagctcgtggggcgcgcccgggtgtcccagggcgccgggtggagcctgcgcgagaccgcgtgcctgggcaagtcctacgcccagatgtggcagctcatgtacttccaccggcgcgacctgcggctggccgccaacgcgatctgcagcgccgtccccgtggactgggtgcccacctcccgcaccacgtggagcatccacgcccaccaccagtggatgaccaccgaggacatgctctccgtctggaaccgggtgtggatcgaggagaacccctggatggaggacaagacccacatcagctcctggggcgacgtgccgtacctgggcaagcgcgaggaccagtggtgcggcagcctgatcgggctcacggcccgggccacctgggcgaccaacatccaggtcgccatcaaccaggtgcgccgcctgatcggcaacgagaactacctggactacatgacctccatgaagcggttcaagaacgagagcgaccccgagggggccctctggtga

SEQ ID NO: 8415 - RNA, 9879 nt, synthetic construct
  misc_feature 1..9879: note = derived and/or modified CDS sequence (opt1) from DENV-1__FJ410245__SS-prME
  source 1..9879: mol_type = other RNA
agcgtgaccatgctgctcatgctgatgcccaccgccctggccttccacctcaccacccgcggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgagaccgagcccgacgacgtggactgctggtgcaacgccaccgacacctgggtgacctacgggacctgcagccagacgggcgagcaccggcgcgacaagcggtccgtggccctcgcgccccacgtgggcctggggctggagacccgcaccgagacctggatgagctccgagggcgcctggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtcgggaagctggtgcaccagatcttcggcaccgcctacggggtgctgttctccggcgtcagctggacgatgaagatcgggatcggcgtgctgctgacctggctcggcctgaactcccgcagcacctccctgagcatgacctgcatcgccgtggggctcgtcacgctgtacctgggcgtgatggtgcaggccgactccgggtgcgtcatcaactggaagggccgggagctcaagtgcgggagcggcatcttcgtgaccaacgaggtgcacacctggaccgagcagtacaagttccaggccgacagcccgaagcgcctgtccgcggccatcggcaaggcctgggaggagggggtctgcggcatccggagcgccacccgcctggagaacatcatgtggaagcagatctccaacgagctcaaccacatcctgctggagaacgacatgaagttcacggtggtggtcggggacgtggccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtcgaggactacggcttcgggatcttcacgaccaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacgtgcatctggcccaagtcccacaccctgtggagcaacggcgtgctcgagtccgagatgatcatccccaagatctacgggggcccgatcagccagcacaactaccgccccgggtacttcacccaggccgccggcccctggcacctggggaagctggagctcgacttcgacctgtgcgagggcaccacggtggtcgtggacgagcactgcggcaaccgggggccgtccctgcgcaccaccaccgtgacgggcaagatcatccacgagtggtgctgccggagctgcaccctgccgcccctccgcttcaagggggaggacggctgctggtacgggatggagatccggcccgtcaaggagaaggaggagaacctggtgaagtccatggtgagcgccggcagcggcgaggtcgactccttcagcctcgggctgctgtgcatctccatcatgatcgaggaggtgatgcgcagccggtggtcccgccggatgctcatgaccggcaccctggccgtgttcttcctgctcatcatggggcagctgacgtggaacgacctgatccgcctctgcatcatggtcggcgcgaacgccagcgaccgcatggggatgggcaccacctacctggccctgatggccaccttcaagatgcggccgatgttcgccgtgggcctcctgttccgccggctgacgtcccgcgaggtgctcctgctgaccatcgggctcagcctggtcgcgtccgtggagctgcccaacagcctcgaggagctgggcgacgggctggccatgggcatcatgatcctcaagctgctgaccgacttccagtcccaccagctctgggccaccctgctgagcctcacgttcatcaagaccaccttctccctgcactacgcctggaagaccatggcgatggtcctgagcatcgtgtccctcttccccctgtgcctgagcacgacctcccagaagaccacctggctccccgtgctgctgggcagcctcgggtgcaagccgctgacgatgttcctgatcgccgagaacaagatctggggccggcgctcctggcccctcaacgaggggatcatggccgtcggcatcgtgagcatcctgctgagctccctcctgaagaacgacgtgcccctggccgggcccctcatcgccggcggcatgctgatcgcgtgctacgtcatcagcgggtccagcgccgacctgtccctcgagaaggccgccgaggtgagctgggaggaggaggccgagcactccggcgcgagccacaacatcctggtggaggtccaggacgacgggaccatgaagatcaaggacgaggagcgggacgacaccctgaccatcctcctgaaggccaccctgctcgccgtgtccggcgtgtacccgctgagcatccccgccacgctgttcgtctggtacttctggcagaagaagaagcagcgctccggggtgctctgggacacccccagcccgcccgaggtggagcgggccgtcctggacgacggcatctaccgcatcatgcagcggggcctgctggggcgctcccaggtgggcgtgggggtcttccaggagaacgtgttccacaccatgtggcacgtgacccggggcgcggtcctcatgtaccaggggaagcgcctggagcccagctgggcctccgtgaagaaggacctgatcagctacggcggcgggtggcggctccagggctcctggaacatcggggaggaggtgcaggtcatcgccgtggagcccggcaagaaccccaagaacgtgcagacggcccccgggaccttcaagacccccgagggcgaggtcggcgccatcgcgctggacttcaagcccgggaccagcggctcccccatcgtgaaccgcgaggggaagatcgtgggcctgtacggcaacggggtcgtgacgaccagcggcacctacgtgagcgccatcgcccaggccaaggcgtcccaggaggggccgctccccgagatcgaggacgaggtcttccggaagcgcaacctgaccatcatggacctgcaccccggcagcgggaagacgcggcgctacctcccggccatcgtgcgggaggccatcaagaagaagctgcgcaccctgatcctcgcccccacccgcgtggtcgcctccgagatggcggaggccctgaagggcatgcccatccggtaccagaccacggccgtcaagagcgagcacaccggcaaggagatcgtggacctgatgtgccacgccaccttcaccatgcgcctcctgtcccccgtccgggtgccgaactacaacatgatcatcatggacgaggcccacttcacggaccccagctccatcgcggcccgcgggtacatcagcacccgggtgggcatgggggaggccgccgccatcttcatgaccgcgacgccgcccggctccgtcgaggccttcccgcagagcaacgccgtgatccaggacgaggagcgcgacatccccgagcggtcctggaacagcgggtacgagtggatcacggacttccccggcaagaccgtgtggttcgtcccctccatcaagagcggcaacgacatcgccaactgcctgcgcaagaacgggaagcgggtgatccagctctcccgcaagaccttcgacaccgagtaccagaagacgaagaacaacgactgggactacgtggtcaccaccgacatcagcgagatgggcgcgaacttccgggccgaccgcgtgatcgacccgcggcgctgcctgaagcccgtgatcctgaaggacgggcccgagcgggtcatcctcgccggccccatgccggtgaccgtcgcctccgccgcgcagcgccgggggcgcatcggccggaaccacaacaaggagggcgaccagtacatctacatggggcagcccctgaacaacgacgaggaccacgcccactggacggaggccaagatgctgctcgacaacatcaacacccccgagggcatcatccccgccctgttcgagccggagcgcgagaagtccgccgcgatcgacggggagtaccgcctgcggggcgaggcccgcaagaccttcgtggagctcatgcggcgcggggacctgcccgtgtggctgtcctacaaggtcgccagcgagggcttccagtacagcgaccggcgctggtgcttcgacggcgagcggaacaaccaggtgctcgaggagaacatggacgtggagatctggaccaaggagggggagcgcaagaagctgcggccccgctggctggacgcccggacgtactccgaccccctcgccctgcgcgagttcaaggagttcgcggccggccggcgcagcgtctccggggacctgatcctcgagatcggcaagctgccgcagcacctgacccagcgggcccagaacgccctcgacaacctggtgatgctgcacaacagcgagcagggcgggcgcgcgtaccggcacgccatggaggagctccccgacaccatcgagaccctgatgctgctcgccctgatcgccgtgctgacgggcggggtcaccctcttcttcctgtccggccgcgggctgggcaagaccagcatcggcctcctgtgcgtgatggcctccagcgtgctgctctggatggcgtccgtcgagccccactggatcgccgccagcatcatcctggagttcttcctgatggtgctcctgatccccgagccggaccggcagcgcacgccccaggacaaccagctggcctacgtggtcatcgggctcctgttcatgatcctgaccgtggccgcgaacgagatgggcctcctggagacgaccaagaaggacctggggatcggccacgtggccgtcgagaaccaccaccacgccgccatgctcgacgtggacctgcaccccgcctccgcgtggaccctgtacgccgtggccaccacgatcatcaccccgatgatgcggcacaccatcgagaacaccacggccaacatcagcctcaccgccatcgcgaaccaggccgccatcctgatggggctggacaagggctggcccatctccaagatggacatcggcgtccccctcctggccctggggtgctacagccaggtgaaccccctcaccctgaccgcggccgtgctgatgctcgtcgcccactacgccatcatcggcccggggctgcaggccaaggcgacgcgcgaggcccagaagcgcaccgccgccggcatcatgaagaaccccaccgtggacgggatcgtggccatcgacctggaccccgtcgtgtacgacgcgaagttcgagaagcagctcggccagatcatgctgctgatcctctgcacctcccagatcctgctgatgcggacgacctgggccctctgcgagagcatcaccctggccaccggccccctgacgaccctctgggaggggtccccgggcaagttctggaacaccaccatcgccgtgagcatggccaacatcttccgcgggtcctacctggcgggcgccggcctggccttcagcctcatgaagtccctcgggggcgggcggcgcgggacgggggcccagggcgagaccctgggcgagaagtggaagcggcagctcaaccagctgtccaagagcgagttcaacacctacaagcgctccgggatcatggaggtcgaccggagcgaggcgaaggagggcctgaagcgcggggagaccacgaagcacgccgtgtcccggggcaccgccaagctccgctggttcgtggagcggaacctggtcaagcccgaggggaaggtgatcgacctgggctgcggccgcgggggctggagctactactgcgccgggctgaagaaggtgaccgaggtcaagggctacaccaagggcgggcccggccacgaggagcccatcccgatggccacgtacgggtggaacctcgtgaagctgcactccggcaaggacgtgttcttcatcccgcccgagaagtgcgacaccctgctctgcgacatcggggagagctcccccaacccgaccatcgaggagggccggaccctgcgcgtcctgaagatggtggagccctggctccgggggaaccagttctgcatcaagatcctgaacccctacatgcccagcgtggtcgagacgctggagcagatgcagcgcaagcacggcggcatgctcgtgcggaacccgctgtcccgcaacagcacccacgagatgtactgggtgtcctgcgggaccggcaacatcgtcagcgcggtgaacatgacctcccggatgctgctcaaccgcttcaccatggcccaccgcaagcccacgtacgagcgggacgtggacctgggggccggcacccgccacgtcgccgtggagcccgaggtggccaacctggacatcatcggccagcggatcgagaacatcaagcacgagcacaagagcacctggcactacgacgaggacaacccctacaagacctgggcgtaccacgggtcctacgaggtcaagccgagcggctccgccagcagcatggtgaacggggtcgtgaagctcctgacgaagccctgggacgtgatccccatggtcacccagatcgccatgaccgacaccacgcccttcggccagcagcgcgtgttcaaggagaaggtggacacccggaccccgaaggccaagcgcgggaccgcccagatcatggaggtcacggcgaagtggctgtggggcttcctctcccggaacaagaagccccgcatctgcacccgggaggagttcacccgcaaggtgcggagcaacgccgccatcggcgccgtgttcgtcgacgagaaccagtggaactccgcgaaggaggccgtggaggacgagcgcttctgggacctggtgcaccgggagcgcgagctgcacaagcaggggaagtgcgcgacctgcgtctacaacatgatgggcaagcgggagaagaagctcggggagttcggcaaggccaaggggagccgcgccatctggtacatgtggctgggcgcgcggttcctggagttcgaggccctcggcttcatgaacgaggaccactggttctcccgcgagaacagcctgtccggggtggagggcgaggggctgcacaagctcggctacatcctgcgggacatcagcaagatccccgggggcaacatgtacgccgacgacacggccggctgggacacccgcatcaccgaggacgacctgcagaacgaggcccggatcaccgacatcatggagccggagcacgcgctcctggccaagtccatcttcaagctgacgtaccagaacaaggtggtccgcgtgcagcgccccgccaagaacgggaccgtgatggacgtcatcagccggcgcgaccagcggggctccggccaggtgggcacctacggcctcaacaccttcacgaacatggaggcccagctgatccgccagatggagagcgaggggatcttctcccccagcgagctggagacccccaacctcgccgagcgggtgctggactggctggagaagtacggcgtcgagcgcctcaagcggatggcgatctccggggacgactgcgtggtgaagccgatcgacgaccgcttcgccaccgccctgaccgccctgaacgacatgggcaaggtccggaaggacatcccccagtgggagcccagcaaggggtggaacgactggcagcaggtccccttctgctcccaccacttccaccagctcatcatgaaggacggccgcgagatcgtggtcccgtgccggaaccaggacgagctggtgggccgcgcccgggtgagccagggggcgggctggagcctgcgcgagacggcctgcctcgggaagtcctacgcccagatgtggcagctgatgtacttccaccggcgcgacctgcggctcgccgcgaacgccatctgcagcgccgtccccgtggactggatccccacctcccgcaccacctggagcatccacgcccaccaccagtggatgacgaccgaggacatgctgtccgtgtggaaccgggtctggatcgaggagaacccctggatggaggacaagacccacatcagctcctggggcgacgtgccgtacctggggaagcgcgaggaccagtggtgcggcagcctcatcggcctgaccgcccgcgcgacgtgggccaccaacatccaggtggccatcaaccaggtccggcgcctgatcgggaacgagaactacctcgactacatgacctccatgaagcggttcaagaacgagagcgaccccgagggcgccctgtggtga

SEQ ID NO: 8416 - RNA, 9879 nt, synthetic construct
  misc_feature 1..9879: note = derived and/or modified CDS sequence (opt1) from DENV-1__FJ410246__SS-prME
  source 1..9879: mol_type = other RNA
agcgtgaccatgctgctcatgctgatgcccaccgccctggccttccacctcacgacccgcggcggggagccccacatgatcgtgagcaagcaggagcggggcaagagcctgctgttcaagaccagcgcgggggtgaacatgtgcaccctcatcgccatggacctgggggagttctgcgaggacacgatgacctacaagtgcccccgcatcaccgaggccgagcccgacgacgtggactgctggtgcaacgccaccgacacgtgggtgacctacgggacctgcagccagaccggggagcaccggcgcgacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccgcaccggcctggacttcaacgagatggtcctcctgacgatgaaggagaagtcctggctggtgcacaagcagtggttcctcgacctgccgctgccctggaccagcggggcctccaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctcgtccagatcaagtacgagggcaccgacgccccctgcaagatccccttctccacccaggacgagaagggggtgacccagaacggccggctgatcacggccaacccgatcgtgaccgacaaggacaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacaccgcctgggacttcgggagcatcggcggcgtgttcacgtccgtcgggaagctggtgcaccagatcttcggcaccgcctacggggtgctgttcagcggcgtctcctggaccatgaagatcgggatcggcgtgctcctgacctggctgggcctcaacagccgctccacgagcctgtccatgacctgcatcgccgtggggctggtcaccctctacctgggcgtgatggtgcaggccgacagcgggtgcgtcatcaactggaagggccgggagctgaagtgcgggagcggcatcttcgtgaccaacgaggtgcacacgtggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagttcaccgtggtggtcggggacgtggcgggcatcctggcccaggggaagaagatgatccggccccagcccatggagtacaagtactcctggaagtcctggggcaaggccaagatcatcggcgccgacgtgcagaacaccacgttcatcatcgacgggcccaacaccccggagtgccccgacgaccagcgcgcgtggaacatctgggaggtcgaggactacggcttcgggatcttcaccaccaacatctggctcaagctgcgggactcctacacccaggtgtgcgaccaccgcctgatgagcgccgccatcaaggactccaaggccgtgcacgccgacatgggctactggatcgagagcgagaagaacgagacctggaagctcgcgcgggcctccttcatcgaggtcaagacctgcatctggcccaagagccacaccctgtggtccaacggcgtgctggagagcgagatgatcatccccaagatctacgggggcccgatctcccagcacaactaccgccccgggtacttcacgcagaccgccggcccctggcacctcgggaagctggagctggacttcgacctctgcgagggcaccaccgtggtcgtggacgagcactgcggcaaccgggggccgagcctgcgcacgaccaccgtgaccggcaagatcatccacgagtggtgctgccggtcctgcacgctgccgcccctgcgcttcaagggggaggacggctgctggtacgggatggagatccggcccgtcaaggagaaggaggagaacctggtcaagagcatggtgagcgccggctccggcgaggtcgacagcttctccctggggctcctgtgcatcagcatcatgaccgaggaggtgatgcgctcccggtggagccgcaagatgctgatgaccggcaccctcgccgtgttcttcctgctgatcatggggcagctcacgtggaacgacctgatccggctgtgcatcatggtcggcgcgaacgcctccgaccgcatggggatgggcaccacctacctcgccctgatggccaccttcaagatgcgcccgatgttcgccgtgggcctcctgttccggcgcctgacgagccgggaggtgctgctcctgaccatcgggctgtccctcgtcgcgagcgtggagctgcccaactccctggaggagctcggcgacgggctggccatgggcatcatgatcctgaagctcctgaccgacttccagagccaccagctgtgggccaccctcctgtccctgacgttcatcaagaccaccttcagcctccactacgcctggaagaccatggcgatggtcctgtccatcgtgagcctgttccccctctgcctgtccacgaccagccagaagaccacctggctgcccgtgctcctgggctccctggggtgcaagccgctcacgatgttcctgatcgccgagaacaagatctggggccgcaagagctggcccctgaacgaggggatcatggccgtcggcatcgtgagcatcctcctgtccagcctgctcaagaacgacgtgcccctggccgggcccctgatcgccggcggcatgctcatcgcgtgctacgtcatctccgggagctccgccgacctgagcctggagaaggccgccgaggtgtcctgggaggaggaggccgagcacagcggcgcgtcccacaacatcctcgtggaggtccaggacgacgggaccatgaagatcaaggacgaggagcgggacgacaccctgaccatcctgctcaaggccaccctgctggccgtgagcggcgtgtacccgctctccatccccgccacgctgttcgtctggtacttctggcagaagaagaagcagcgcagcggggtgctgtgggacacccccagcccgcccgaggtggagcgggccgtcctcgacgacggcatctaccgcatcatgcagcggggcctgctggggcgcagccaggtgggcgtgggggtcttccaggagaacgtgttccacaccatgtggcacgtgacccggggcgcggtcctgatgtaccaggggaagcgcctcgagccctcctgggccagcgtgaagaaggacctgatctcctacggcggcgggtggcggctgcagggcagctggaacacgggggaggaggtgcaggtcatcgccgtggagcccggcaagaaccccaagaacgtgcagaccgcccccgggaccttcaagacctccgagggcgaggtcggcgccatcgcgctcgacttcaagcccgggacgagcggcagccccatcgtgaaccgcgaggggaagatcgtgggcctgtacggcaacggggtcgtgaccacctccggcacctacgtgagcgccatcgcccaggccaaggcgtcccaggaggggcccctgccggagatcgaggacgaggtcttccggaagcgcaacctcacgatcatggacctgcaccccggcagcgggaagacccggcgctacctgcccgccatcgtgcacgaggccatcaagcggaagctccgcaccctgatcctggccccgacccgggtggtcgcctccgagatggcggaggccctcaagggcatgcccatccgctaccagacgaccgccgtcaagagcgagcacaccggcaaggagatcgtggacctgatgtgccacgccaccttcacgatgcgcctgctctcccccgtccgggtgcccaactacaacatgatcatcatggacgaggcccacttcaccgacccgagctccatcgcggcccgcgggtacatcagcacccgggtgggcatgggggaggccgccgccatcttcatgaccgcgacgccgcccggctccgtcgaggccttcccccagagcaacgccgtgatccaggacgaggagcgcgacatcccggagcggtcctggaacagcgggtacgagtggatcaccgacttccccggcaagaccgtgtggttcgtcccctccatcaagagcggcaacgacatcgccaactgcctgcgcaagaacgggaagcgggtgatccagctgtcccgcaagaccttcgacacggagtaccagaagaccaagaacaacgactgggactacgtggtcaccaccgacatcagcgagatgggcgcgaacttccgggccgaccgcgtgatcgacccccggcgctgcctcaagccggtgatcctgaaggacgggcccgagcgggtcatcctggccggccccatgcccgtgacggtcgcctccgccgcgcagcgccgggggcgcatcggccggaaccacaacaaggagggcgaccagtacgtgtacatggggcagccgctcaacaacgacgaggaccacgcccactggaccgaggccaagatgctgctggacaacatcaacacccccgagggcatcatccccgccctcttcgagcccgagcgcgagaagtccgccgcgatcgacggggagtaccggctgcgcggcgaggcccgcaagaccttcgtggagctgatgcggcgcggggacctcccggtctggctgagctacaaggtggcctccgagggcttccagtacagcgaccggcgctggtgcttcgacggcgagcggaacaaccaggtgctggaggagaacatggacgtcgagatctggacgaaggagggggagcgcaagaagctccggccccgctggctggacgcccggacctactccgaccccctggccctccgcgagttcaaggagttcgcggccggccggcgcagcgtgtccggggacctgatcctggagatcggcaagctcccccagcacctgacccagcgggcccagaacgccctggacaacctcgtgatgctgcacaacagcgagcagggcgggcgcgcgtaccggcacgccatggaggagctgccggacaccatcgagacgctcatgctgctggccctcatcgccgtcctgaccggcggggtgaccctgttcttcctctccggccgcgggctgggcaagaccagcatcggcctgctctgcgtgatggcctccagcgtcctgctgtggatggcgtccgtggagccccactggatcgccgccagcatcatcctcgagttcttcctgatggtgctgctcatccccgagcccgaccggcagcgcaccccgcaggacaaccagctggcctacgtcgtgatcgggctcctcttcatgatcctgacggtggccgcgaacgagatgggcctgctcgagaccaccaagaaggacctggggatcggccacgtcgccgtggagaaccaccaccacgccgccatgctggacgtggacctccaccccgcctccgcgtggaccctgtacgccgtcgccacgaccatcatcacccccatgatgcggcacaccatcgagaacacgaccgccaacatcagcctgaccgccatcgcgaaccaggccgccatcctcatggggctggacaagggctggccgatctccaagatggacatcggcgtgcccctgctcgccctggggtgctacagccaggtgaaccccctgaccctcacggcggccgtcctgatgctggtggcccactacgccatcatcggccccgggctccaggccaaggcgacccgcgaggcccagaagcggaccgccgccggcatcatgaagaacccgaccgtggacgggatcgtcgccatcgacctggaccccgtggtgtacgacgcgaagttcgagaagcagctgggccagatcatgctcctgatcctgtgcacgtcccagatcctcctgatgcgcaccacctgggccctgtgcgagagcatcaccctcgccacgggccccctgaccaccctgtgggaggggtcccccggcaagttctggaacaccacgatcgccgtcagcatggccaacatcttccgcgggagctacctcgcgggcgccggcctggccttctccctgatgaagtccctcgggggcgggcggcgcggcaccggggcccagggcgagaccctgggcgagaagtggaagcggcagctgaaccagctctccaagagcgagttcaacacctacaagcgctccgggatcatggaggtggaccggagcgaggcgaaggagggcctgaagcgcggggagacgaccaagcacgccgtgtcccggggcaccgccaagctgcgctggttcgtcgagcggaacctcgtgaagccggaggggaaggtgatcgacctgggctgcggccgcgggggctggagctactactgcgccgggctgaagaaggtcaccgaggtgaagggctacacgaagggcgggcccggccacgaggagcccatccccatggccacctacgggtggaacctggtgaagctccactccggcaaggacgtcttcttcatcccgcccgagaagtgcgacaccctgctgtgcgacatcggggagagctcccccaaccccaccatcgaggagggccggacgctccgcgtgctgaagatggtggagccgtggctgcgggggaaccagttctgcatcaagatcctcaacccctacatgcccagcgtcgtggagaccctggagcagatgcagcgcaagcacggcggcatgctggtgcggaaccccctctcccgcaacagcacccacgagatgtactgggtctcctgcgggaccggcaacatcgtgagcgcggtgaacatgacctcccggatgctgctgaaccgcttcacgatggcccaccggaagccgacctacgagcgcgacgtcgacctcggggccggcacccgccacgtggccgtggagcccgaggtcgccaacctggacatcatcggccagcggatcgagaacatcaagcacgagcacaagagcacctggcactacgacgaggacaacccctacaagacgtgggcgtaccacgggtcctacgaggtgaagcccagcggcagcgcctccagcatggtcaacggggtggtgaagctgctcaccaagccgtgggacgtcatccccatggtgacccagatcgccatgaccgacacgacccccttcggccagcagcgcgtgttcaaggagaaggtcgacacccggacccccaaggccaagcgcgggacggcccagatcatggaggtgaccgcgaagtggctgtggggcttcctgtcccggaacaagaagccgcgcatctgcacccgggaggagttcacccgcaaggtgcggagcaacgccgccatcggcgccgtcttcgtggacgagaaccagtggaactccgcgaaggaggccgtggaggacgagcgcttctgggacctcgtccaccgggagcgcgagctgcacaagcaggggaagtgcgccacgtgcgtgtacaacatgatgggcaagcgggagaagaagctgggggagttcggcaaggccaaggggagccgcgccatctggtacatgtggctcggcgcgcggttcctggagttcgaggccctgggcttcatgaacgaggaccactggttctcccgcgagaacagcctctccggggtggagggcgaggggctgcacaagctgggctacatcctccgggacatcagcaagatccccgggggcaacatgtacgccgacgacaccgccggctgggacacccgcatcaccgaggacgacctgcagaacgaggccaagatcacggacatcatggagcccgagcacgcgctgctcgccaagtccatcttcaagctgacctaccagaacaaggtcgtgcgggtgcagcgcccggccaagaacgggaccgtcatggacgtgatcagccggcgcgaccagcgcggctccggccaggtgggcacctacggcctgaacacgttcaccaacatggaggcccagctcatccggcagatggagagcgaggggatcttctcccccagcgagctggagacccccaacctggccggccgcgtcctcgactggctggagcggcacggggtggagcgcctgaagcggatggcgatctccggcgacgactgcgtggtcaagcccatcgacgaccgcttcgccaccgccctcacggccctgaacgacatggggaaggtgcggaaggacatcccgcagtgggagcccagcaagggctggaacgactggcagcaggtccccttctgcagccaccacttccaccagctgatcatgaaggacggccgcgagatcgtcgtgccctgccggaaccaggacgagctcgtggggcgcgcccgggtctcccagggcgcggggtggagcctgcgcgagaccgcctgcctgggcaagtcctacgcccagatgtggcagctcatgtacttccaccggcgcgacctgcggctggccgcgaacgccatctgcagcgccgtgccggtggactgggtccccacctcccgcaccacgtggagcatccacgcccaccaccagtggatgaccaccgaggacatgctctccgtgtggaaccgggtgtggatcgaggagaacccctggatggaggacaagacccacatcagctcctggggcgacgtcccctacctgggcaagcgcgaggaccagtggtgcggcagcctgatcgggctcacggcccgggcgacctgggccaccaacatccaggtggccatcaaccaggtgcgccgcctgatcggcaacgagaactacctggactacatgacctccatgaagcggttcaagaacgagagcgacccggagggggccctctggtga

SEQ ID NO: 8417 - RNA, 9879 nt, synthetic construct
  misc_feature 1..9879: note = derived and/or modified CDS sequence (opt1) from DENV-1__FJ410247__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgagaccgagcccgacgacgtggactgctggtgcaacgccaccgacacctgggtgacctacgggacctgcagccagacgggcgagcaccggcgcgacaagcggtccgtggccctcgcgccccacgtgggcctggggctggagacccgcaccgagacctggatgagctccgagggcgcgtggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccatcctgcggaagctctgcatcgaggcgaagatctccaacaccacgaccgacagccgctgcccgacccagggcgaggccaccctggtggaggagcaggacgccaacttcgtgtgccggcgcacgttcgtcgaccggggctgggggaacggctgcgggctgttcggcaaggggtccctcatcacgtgcgccaagttcaagtgcgtgaccaagctggagggcaagatcgtgcagtacgagaacctgaagtacagcgtcatcgtgaccgtgcacacgggcgaccagcaccaggtcgggaacgagtccaccgagcacggcaccaccgccaccatcacgccccaggcgcccaccaccgagatccagctcaccgactacggggccctgacgctggactgcagcccccgcaccggcctcgacttcaacgagatggtgctgctgaccatgaaggagaagtcctggctcgtccacaagcagtggttcctggacctgcccctcccctggaccagcggggccagcacgtcccaggagacctggaaccggcaggacctgctggtgaccttcaagaccgcccacgccaagaagcaggaggtggtcgtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtgatgtgcacggggtccttcaagctcgagaaggaggtcgccgagacccagcacggcaccgtgctggtgcagatcaagtacgagggcaccgacgcgccctgcaagatccccttcagcacgcaggacgagaagggggtcacccagaacggccggctgatcaccgccaacccgatcgtgaccgacaaggagaagcccgtgaacatcgaggccgagccgcccttcggggagtcctacatcgtcatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtggggaagctggtccaccagatcttcggcaccgcctacggggtcctcttctccggcgtgagctggacgatgaagatcgggatcggcgtcctgctgacctggctcggcctgaactcccgcagcacctccctgagcatgacctgcatcgccgtggggctcgtgacgctgtacctgggcgtcatggtgcaggccgactccgggtgcgtgatcaactggaagggccgggagctcaagtgcgggagcggcatcttcgtcaccaacgaggtgcacacctggaccgagcagtacaagttccaggccgacagcccgaagcgcctgtccgcggccatcggcaaggcctgggaggagggggtgtgcggcatccggagcgccacccgcctggagaacatcatgtggaagcagatctccaacgagctcaaccacatcctgctggagaacgacatgaagttcacggtcgtggtgggggacgtcgccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctgaagctgcgggacagctacacccaggtctgcgaccaccgcctcatgtccgcggccatcaaggacagcaaggccgtgcacgccgacatgggctactggatcgagtccgagaagaacgagacctggaagctggcccgggcgagcttcatcgaggtgaagacgtgcatctggcccaagtcccacaccctgtggagcaacggcgtcctcgagtccgagatgatcatccccaagatctacgggggcccgatcagccagcacaactaccgccccgggtacttcacccagaccgccggcccctggcacctggggaagctggagctcgacttcgacctgtgcgagggcacgaccgtggtggtcgacgagcactgcggcaaccgggggccgtccctgcgcaccaccacggtgaccggcaagatcatccacgagtggtgctgccggagctgcaccctgccgcccctccgcttccgcggggaggacggctgctggtacgggatggagatccgccccgtgaaggagaaggaggagaacctggtcaagtccatggtgagcgccggcagcggcgaggtggactccttcagcctcgggctgctgtgcatctccatcatgatcgaggaggtcatgcggagccgctggtcccggaagatgctcatgaccggcacgctggccgtgttcctgctcctgatcatggggcagctgacctggaacgacctcatccgcctgtgcatcatggtgggcgccaacgcgagcgaccgcatggggatgggcaccacctacctggccctcatggccacgttcaagatgcggccgatgttcgccgtcgggctgctgttccgccggctcacctcccgcgaggtgctgctgctcaccatcgggctgagcctggtggcctccgtcgagctccccaacagcctggaggagctgggcgacgggctcgcgatgggcatcatgatcctgaagctgctcaccgacttccagtcccaccagctgtgggccacgctgctcagcctgaccttcatcaagaccaccttctccctgcactacgcctggaagacgatggccatggtgctcagcatcgtctccctgttccccctgtgcctcagcaccacctcccagaagaccacgtggctgcccgtgctgctcggcagcctggggtgcaagccgctgaccatgttcctcatcgcggagaaccggatctggggccgccggtcctggcccctgaacgaggggatcatggccgtgggcatcgtcagcatcctgctcagctccctgctgaagaacgacgtgcccctcgccgggcccctgatcgccggcggcatgctgatcgcctgctacgtgatcagcgggtccagcgcggacctctccctggagaaggccgccgaggtcagctgggaggaggaggccgagcactccggcgccagccacaacatcctggtggaggtgcaggacgacgggaccatgaagatcaaggacgaggagcgcgacgacaccctcaccatcctgctgaaggcgacgctcctggccgtctccggcgtgtacccgctgagcatccccgccaccctcttcgtgtggtacttctggcagaagaagaagcagcggtccggggtcctgtgggacacccccagcccgcccgaggtggagcgcgccgtgctggacgacggcatctaccggatcatgcagcgcggcctgctcgggcggtcccaggtcggcgtgggggtgttccaggagaacgtcttccacaccatgtggcacgtgacgcgcggcgccgtgctgatgtaccaggggaagcggctggagcccagctgggcgtccgtcaagaaggacctcatcagctacggcggcgggtggcgcctgcagggctcctggaacaccggggaggaggtccaggtgatcgccgtcgagcccggcaagaaccccaagaacgtgcagaccacccccgggacgttcaagacccccgagggcgaggtgggcgccatcgccctggacttcaagcccgggaccagcggctcccccatcgtcaaccgggaggggaagatcgtgggcctctacggcaacggggtggtcaccacgagcggcacctacgtgagcgccatcgcgcaggccaaggcctcccaggaggggccgctgcccgagatcgaggacgaggtgttccgcaagcggaacctgaccatcatggacctccaccccggcagcgggaagacccgccggtacctgccggccatcgtccgcgaggcgatcaagcgcaagctgcggacgctcatcctggcccccacccgcgtggtggcctccgagatggccgaggccctgaagggcatgcccatccggtaccagaccaccgcggtcaagagcgagcacacgggcaaggagatcgtggacctcatgtgccacgccaccttcaccatgcgcctgctgtcccccgtgcgggtcccgaactacaacatgatcatcatggacgaggcccacttcaccgaccccagctccatcgccgcccgcgggtacatcagcacgcgggtgggcatgggggaggcggccgccatcttcatgaccgccacgccgcccggctccgtggaggccttcccgcagagcaacgcggtcatccaggacgaggagcgcgacatccccgagcggtcctggaacagcgggtacgagtggatcaccgacttccccggcaagacggtgtggttcgtgccctccatcaagagcggcaacgacatcgccaactgcctccgcaagaacgggaagcgggtcatccagctgtcccgcaagaccttcgacaccgagtaccagaagaccaagaacaacgactgggactacgtggtgacgaccgacatcagcgagatgggcgccaacttccgggccgaccgcgtcatcgacccgcggcgctgcctgaagcccgtgatcctcaaggacgggcccgagcgggtgatcctggcgggccccatgccggtcaccgtggcctccgccgcccagcgccgggggcgcatcggccgcaaccacaacaaggagggcgaccagtacatctacatggggcagcccctgaacaacgacgaggaccacgcccactggaccgaggcgaagatgctcctggacaacatcaacacgcccgagggcatcatccccgccctgttcgagccggagcgggagaagtccgccgccatcgacggggagtaccgcctccggggcgaggcccgcaagaccttcgtcgagctgatgcggcgcggggacctgcccgtgtggctctcctacaaggtggcgagcgagggcttccagtacagcgaccggcgctggtgcttcgacggcgagcggaacaaccaggtcctggaggagaacatggacgtggagatctggaccaaggagggggagcgcaagaagctgcggccccgctggctcgacgcccggacctactccgaccccctggccctgcgcgagttcaaggagttcgccgccggccggcgcagcgtgtccggggacctcatcctggagatcggcaagctgccgcagcacctcacgcagcgggcgcagaacgccctggacaacctggtcatgctccacaacagcgagcagggcgggcgcgcctaccggcacgccatggaggagctgcccgacaccatcgagaccctgatgctcctggcgctgatcgccgtgctcaccggcggggtgaccctgttcttcctgtccggccgcgggctcggcaagacgagcatcggcctgctgtgcgtcatggcctccagcgtgctcctgtggatggcctccgtggagccccactggatcgccgcgagcatcatcctggagttcttcctcatggtcctgctgatccccgagccggaccggcagcgcacgccccaggacaaccagctcgcctacgtggtgatcgggctgctgttcatgatcctcaccgtcgccgccaacgagatgggcctgctggagaccacgaagaaggacctcgggatcggccacgtggccgtggggaaccaccaccacgcggccatgctggacgtcgacctgcaccccgcctccgcctggaccctctacgccgtggcgaccaccatcatcacgccgatgatgcgccacaccatcgagaacaccaccgccaacatcagcctgacggccatcgccaaccaggccgcgatcctgatgggcctcgacaagggctggcccatctccaagatggacatcggggtgcccctgctggccctcggctgctacagccaggtcaaccccctgaccctgaccgccgccgtgctcatgctggtggcgcactacgccatcatcgggccgggcctgcaggccaaggccacccgggaggcccagaagcgcacggcggccgggatcatgaagaaccccaccgtcgacggcatcgtggccatcgacctcgaccccgtggtctacgacgccaagttcgagaagcagctgggccagatcatgctgctcatcctgtgcacctcccagatcctgctcatgcggaccacgtgggccctgtgcgagagcatcaccctggcgaccgggcccctcaccacgctgtgggagggctccccggggaagttctggaacaccaccatcgccgtgagcatggccaacatcttccgcggctcctacctggccggcgccgggctcgcgttcagcctgatgaagtccctgggcgggggccggcgcgggaccggcgcccagggcgagacgctcggggagaagtggaagcggcagctgaaccagctgtccaagagcgagttcaacacctacaagcgctccggcatcatggaggtggaccggagcgaggccaaggaggggctcaagcgcggcgagaccaccaagcacgccgtctcccgggggacggcgaagctgcgctggttcgtggagcggaacctggtgaagcccgagggcaaggtcatcgacctgggctgcgggcgcggcgggtggagctactactgcgccggcctcaagaaggtgaccgaggtgaaggggtacaccaagggcggccccgggcacgaggagcccatcccgatggccacctacggctggaacctggtcaagctgcactccgggaaggacgtgttcttcatcccgcccgagaagtgcgacacgctcctgtgcgacatcggcgagagctcccccaacccgaccatcgaggaggggcggaccctgcgcgtgctcaagatggtcgagccctggctgcggggcaaccagttctgcatcaagatcctgaacccctacatgcccagcgtggtggagaccctcgagcagatgcagcgcaagcacggcgggatgctggtccggaacccgctgtcccgcaacagcacccacgagatgtactgggtgtcctgcggcacggggaacatcgtgagcgccgtcaacatgacctcccgcatgctcctgaaccggttcaccatggcccaccgcaagcccacctacgagcgggacgtggacctgggcgcgggcacgcgccacgtggccgtcgagcccgaggtggccaacctcgacatcatcgggcagcggatcgagaacatcaagcacgagcacaagagcacctggcactacgacgaggacaacccctacaagacctgggcctaccacggctcctacgaggtgaagccgagcgggtccgccagcagcatggtcaacggcgtggtcaagctgctgaccaagccctgggacgtgatccccatggtgacgcagatcgcgatgaccgacaccacccccttcgggcagcagcgcgtcttcaaggagaaggtggacacgcggaccccgaaggccaagcagggcaccgcccagatcatggaggtgaccgccaagtggctctggggcttcctgtcccgcaacaagaagccccggatctgcacgcgcgaggagttcacccggaaggtccgcagcaacgccgcgatcggggccgtgttcgtggacgagaaccagtggaactccgccaaggaggccgtcgaggacgagcggttctgggacctggtgcaccgcgagcgggagctccacaagcagggcaagtgcgcgacctgcgtgtacaacatgatggggaagcgcgagaagaagctgggcgagttcgggaaggccaagggcagccgggccatctggtacatgtggctgggcgcccgcttcctcgagttcgaggccctggggttcatgaacgaggaccactggttctcccgggagaacagcctgtccggcgtcgagggggagggcctccacaagctggggtacatcctgcgcgacatcagcaagatccccggcggcaacatgtacgcggacgacaccgccgggtgggacacgcggatcaccgaggacgacctccagaacgaggcccgcatcaccgacatcatggagccggagcacgccctgctggccaagtccatcttcaagctcacctaccagaacaaggtggtgcgcgtccagcggcccgcgaagaacggcacggtgatggacgtgatcagccgccgggaccagcgcgggtccggccaggtcggcacctacgggctgaacaccttcaccaacatggaggcccagctgatccggcagatggagagcgagggcatcttctcccccagcgagctcgagacgcccaacctggccgagcgcgtgctggactggctcgagaagtacggggtggagcggctgaagcgcatggccatctccggcgacgactgcgtcgtgaagccgatcgacgaccggttcgccaccgcgctgaccgccctcaacgacatggggaaggtgcgcaaggacatcccccagtgggagcccagcaagggctggaacgactggcagcaggtccccttctgctcccaccacttccaccagctgatcatgaaggacggccgggagatcgtggtgccgtgccgcaaccaggacgagctggtcgggcgggcccgcgtgagccagggcgccgggtggagcctccgggagaccgcctgcctgggcaagtcctacgcgcagatgtggcagctgatgtacttccaccgccgggacctccgcctggccgccaacgccatctgcagcgcggtgcccgtcgactggatccccacgtcccggaccacctggagcatccacgcccaccaccagtggatgaccacggaggacatgctgtccgtgtggaaccgcgtgtggatcgaggagaacccctggatggaggacaagacccacatcagctcctggggcgacgtcccgtacctcggcaagcgcgaggaccagtggtgcggcagcctgatcgggctgaccgcccgggccacctgggccaccaacatccaggtggcgatcaaccaggtgcgccggctcatcggcaacgagaactacctggactacatgacgtccatgaagcgcttcaagaacgagagcgaccccgagggggccctgtggtga

SEQ ID NO: 8418 - RNA, 9879 nt, synthetic construct
  misc_feature 1..9879: note = derived and/or modified CDS sequence (opt1) from DENV-1__FJ410248__SS-prME
  source 1..9879: mol_type = other RNA
agcgtgaccatgctgctgatgctgatgcccaccgccctggccttccacctcacgacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctcgcgccccacgtgggcctggggctggagacgcgcaccgagacctggatgagctccgagggcgcctggaagcagatccagcgggtggagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctcaccgactacggggccctgaccctggactgcagcccccggaccggcctcgacttcaacgagatggtcctgctgacgatgaaggagaagtcctggctcgtgcacaagcagtggttcctggacctgccgctcccctggaccagcggggcctccaccagccaggagacctggaaccggcaggacctgctggtgacgttcaagaccgcccacgcgaagaagcaggaggtcgtggtgctcggctcccaggagggcgccatgcacaccgccctgaccggggccacggagatccagaccagcggcaccaccacgatcttcgccgggcacctgaagtgccgcctcaagatggacaagctgaccctgaagggcatgtcctacgtcatgtgcaccgggagcttcaagctcgagaaggaggtggcggagacccagcacggcacggtgctggtccagatcaagtacgagggcaccgacgccccctgcaagatccccttctccacccaggacgagaagggggtgacccagaacggccggctgatcacggccaacccgatcgtgaccgacaaggagaagcccgtcaacatcgaggccgagccgcccttcggggagagctacatcgtgatcggcgcgggcgagaaggccctgaagctctcctggttcaagaaggggagctccatcggcaagatgttcgtggccaccgcccgcggggcccggcgcatggcgatcctgggcgacaccgcctgggacttcgggagcatcggcggcgtcttcacgtccgtggggaagctggtgcaccagatcttcggcaccgcctacggggtcctcttcagcggcgtgtcctggaccatgaagatcgggatcggcgtgctgctgacctggctcggcctgaacagccgctccacgagcctgtccatgacctgcatcgccgtcgggctcgtgaccctgtacctgggcgtgatggtccaggccgacagcgggtgcgtgatcaactggaagggccgggagctcaagtgcgggagcggcatcttcgtgaccaacgaggtccacacgtggaccgagcagtacaagttccaggcggactccccgaagcgcctgagcgccgccatcggcaaggcctgggaggagggggtgtgcggcatccggtccgccacccgcctggagaacatcatgtggaagcagatcagcaacgagctcaaccacatcctgctggagaacgacatgaagttcaccgtggtcgtgggggacgtggcgggcatcctcgcccaggggaagaagatgatccggccccagcccatggagtacaagtactcctggaagtcctggggcaaggccaagatcatcggcgccgacgtccagaacaccacgttcatcatcgacgggcccaacaccccggagtgccccgacgaccagcgcgcgtggaacatctgggaggtggaggactacggcttcgggatcttcaccaccaacatctggctgaagctgcgggactcctacacccaggtgtgcgaccaccgcctcatgagcgccgccatcaaggactccaaggccgtccacgccgacatgggctactggatcgagagcgagaagaacgagacctggaagctggcgcgggcctccttcatcgaggtgaagacctgcatctggcccaagagccacaccctgtggtccaacggcgtgctcgagagcgagatgatcatccccaagatctacgggggcccgatctcccagcacaactaccgccccgggtacttcacgcagaccgccggcccctggcacctggggaagctggagctcgacttcaacctgtgcgagggcaccaccgtcgtggtggacgagcactgcggcaaccgggggccgagcctgcgcacgaccaccgtcaccggcaagatcatccacgagtggtgctgccggtcctgcacgctgccgcccctccgcttcaagggggaggacggctgctggtacgggatggagatccggcccgtgaaggagaaggaggagaacctggtcaagagcatggtcagcgccggctccggcgaggtggacagcttctccctcgggctgctgtgcatcagcatcatgatcgaggaggtgatgcgctcccggtggagccgcaagatgctcatgaccggcaccctggccgtcttcttcctgctcatcatggggcagctgacctggaacgacctgatccggctctgcatcatggtgggcgcgaacgcctccgaccgcatggggatgggcacgacctacctggccctgatggccaccttcaagatgcgcccgatgctcgccgtgggcctgctgttccggcgcctcaccagccgggaggtcctgctgctcacgatcgggctgtccctggtggcgagcgtcgagctccccaactccctggaggagctgggcgacgggctcgccatgggcatcatgatcctgaagctgctcaccgacttccagagccaccagctgtgggccaccctgctctccctgaccttcatcaagacgacctacagcctgcactacgcctggaagaccatggcgatggtgctctccatcgtgagcctgttccccctgtgcctctccaccacgagccagaagaccacctggctgcccgtcctgctcggctccctggggtgcaagccgctgaccatgttcctcatcgccgagaacaagatctggggccgcaagagctggcccctgaacgaggggatcatggccgtgggcatcgtgagcatcctgctctccagcctgctgaagaacgacgtccccctcgccgggcccctgatcgccggcggcatgctgatcgcgtgctacgtgatctccgggagctccgccgacctcagcctggagaaggccgccgaggtgtcctgggaggaggaggccgagcacagcggcgcgtcccacaacatcctggtcgaggtgcaggacgacgggacgatgaagatcaaggacgaggagcgggacgacaccctcaccatcctgctgaaggccaccctcctggccgtgagcggcgtctacccgctgtccatccccgccaccctcttcgtgtggtacttctggcagaagaagaagcagcgcagcggggtgctgtgggacacgcccagcccgcccgaggtcgagcgggccgtgctggacgacggcatctaccgcatcatgcagcggggcctgctcgggcgcagccaggtgggcgtcggggtgttccaggagaacgtgttccacaccatgtggcacgtcacccggggcgcggtgctgatgtaccaggggaagcgcctggagccctcctgggccagcgtgaagaaggacctcatctcctacggcggcgggtggcggctgcagggcagctggaacaccggggaggaggtccaggtgatcgccgtggagcccggcaagaaccccaagaacgtccagacggcccccgggaccttcaagacctccgagggcgaggtgggcgccatcgcgctggacttcaagcccgggaccagcggcagccccatcgtgaaccgcgaggggaagatcgtcggcctctacggcaacggggtggtgacgacctccggcacctacgtcagcgccatcgcccaggccaaggcgtcccaggaggggcccctgccggagatcgagaacgaggtgttccggaagcgcaacctgaccatcatggacctccaccccggcagcgggaagacgcggcgctacctgcccgccatcgtgcgggaggccatcaagcgcaagctgcggaccctcatcctggccccgacccgcgtcgtggcctccgagatggcggaggccctgaagggcatgcccatccgctaccagaccacggccgtcaagagcgagcacaccggcaaggagatcgtcgacctcatgtgccacgccaccttcaccatgcggctgctgtcccccgtgcgcgtgcccaactacaacatgatcatcatggacgaggcccacttcacggacccgagctccatcgcggcccgggggtacatcagcacccgcgtcggcatgggggaggccgccgccatcttcatgaccgcgacgccgcccggctccgtggaggccttcccccagagcaacgccgtgatccaggacgaggagcgggacatcccggagcgctcctggaacagcgggtacgagtggatcacggacttccccggcaagaccgtctggttcgtgccctccatcaagagcggcaacgacatcgccaactgcctccggaagaacgggaagcgcgtgatccagctgtcccggaagaccttcgacaccgagtaccagaagacgaagaacaacgactgggactacgtcgtgaccaccgacatcagcgagatgggcgcgaacttccgcgccgaccgggtgatcgacccccgccggtgcctgaagccggtcatcctcaaggacgggcccgagcgcgtgatcctggccggccccatgcccgtcaccgtggcctccgccgcgcagcggcgcgggcggatcggccgcaaccacaacaaggagggcgaccagtacatctacatggggcagccgctgaacaacgacgaggaccacgcccactggacggaggccaagatgctcctggacaacatcaacacccccgagggcatcatccccgccctgttcgagcccgagcgggagaagtccgccgcgatcgacggggagtaccgcctccgcggcgaggcccggaagaccttcgtggagctgatgcgccgcggggacctgccggtctggctcagctacaaggtggcctccgagggcttccagtacagcgaccgccggtggtgcttcgacggcgagcgcaacaaccaggtgctggaggagaacatggacgtcgagatctggaccaaggagggggagcggaagaagctgcgcccccggtggctcgacgcccgcacgtactccgaccccctggccctgcgggagttcaaggagttcgcggccggccgccggagcgtgtccggggacctcatcctggagatcggcaagctgccccagcacctcacccagcgcgcccagaacgccctggacaacctggtgatgctccacaacagcgagcagggcgggcgggcgtaccgccacgccatggaggagctgccggacaccatcgagaccctgatgctcctggccctgatcgccgtcctcacgggcggggtgaccctgttcttcctgtccggccgggggctcggcaagaccagcatcggcctgctgtgcgtgatggcctccagcgtcctcctgtggatggcgtccgtggagccccactggatcgccgccagcatcatcctggagttcttcctcatggtgctgctgatccccgagcccgaccgccagcggaccccgcaggacaaccagctcgcctacgtcgtgatcgggctgctgttcatgatcctcaccgtggccgcgaacgagatgggcctgctggagacgaccaagaaggacctcgggatcggccacgtcgccgtggagaaccaccaccacgccgccatgctggacgtggacctgcaccccgcctccgcgtggaccctctacgccgtcgccaccacgatcatcacccccatgatgcgccacaccatcgagaacaccacggccaacatcagcctgaccgccatcgcgaaccaggccgccatcctgatggggctcgacaagggctggccgatctccaagatggacatcggcgtgcccctgctggccctcgggtgctacagccaggtgaaccccctgaccctgaccgcggccgtcctcatgctggtggcccactacgccatcatcggccccgggctgcaggccaaggcgacgcgggaggcccagaagcgcaccgccgccggcatcatgaagaacccgaccgtggacgggatcgtcgccatcgacctcgaccccgtggtgtacgacgcgaagttcgagaagcagctgggccagatcatgctgctcatcctgtgcacctcccagatcctgctcatgcgcacgacctgggccctgtgcgagagcatcaccctggccaccggccccctcacgaccctgtgggaggggtcccccggcaagttctggaacaccaccatcgccgtcagcatggccaacatcttccgggggagctacctggcgggcgccggcctcgccttctccctgatgaagtccctcgggggcgggcgccgggggacgggggcccagggcgagaccctcggcgagaagtggaagcgccagctgaaccagctgtccaagagcgagttcaacacctacaagcggtccgggatcatggaggtggaccgcagcgaggcgaaggagggcctcaagcgcggggagaccacgaagcacgccgtgtcccgcggcaccgccaagctgcggtggttcgtcgagcgcaacctggtgaagccggaggggaaggtgatcgacctgggctgcggccgcggcgggtggagctactactgcgccgggctcaagaaggtcaccgaggtgaaggggtacaccaagggcgggcccggccacgaggagcccatccccatggccacgtacgggtggaacctggtgaagctgcactccggcaaggacgtcttcttcatcccgcccgagaagtgcgacaccctcctgtgcgacatcggggagagctcccccaaccccaccatcgaggagggccgcaccctgcgggtgctcaagatggtggagccgtggctgcgcgggaaccagttctgcatcaagatcctgaacccctacatgcccagcgtcgtggagacgctcgagcagatgcagcggaagcacggcggcatgctggtgcgcaaccccctgtcccggaacagcacccacgagatgtactgggtctcctgcgggaccggcaacatcgtgagcgcggtgaacatgacctcccgcatgctcctgaaccggttcaccatggcccaccgcaagccgacgtacgagaaggacgtcgacctgggggccggcacccgccacgtggccgtggagcccgaggtcgccaacctcgacatcatcggccagcggatcgagaacatcaagcacgagcacaagagcacctggcactacgacgaggacaacccctacaagacctgggcgtaccacgggtcctacgaggtgaagcccagcggcagcgcctccagcatggtcaacggggtggtgaagctgctgacgaagccgtgggacgtcatccccatggtgacccagatcgccatgaccgacaccacgcccttcggccagcagcgcgtgttcaaggagaaggtcgacacccggacccccaaggccaagcgcgggaccgcccagatcatggaggtgacggcgaagtggctctggggcttcctgtcccggaacaagaagccgcgcatctgcacccgggaggagttcacccgcaaggtgcggagcaacgccgccatcggcgccgtcttcgtggacgagaaccagtggaactccgcgaaggaggccgtggaggacgagcgcttctgggacctggtccaccgggagcgcgagctccacaagcaggggaagtgcgcgacctgcgtgtacaacatgatgggcaagcgggagaagaagctgggggagttcggcaaggccaaggggagccgcgccatctggtacatgtggctgggcgcgcggttcctcgagttcgaggccctgggcttcatgaacgaggaccactggttctcccgcgagaacagcctgtccggggtggagggcgaggggctccacaagctgggctacatcctgcgggacatcagcaagatccccgggggcaacatgtacgccgacgacacggccggctgggacacccgcatcaccgaggacgacctccagaacgaggccaagatcaccgacatcatggagcccgagcacgcgctgctggccaagtccatcttcaagctcacgtaccagaacaaggtcgtgcgggtgcagcgcccggccaagaacgggaccgtcatggacgtgatcagccggcgcgaccagcgcggctccggccaggtgggcacctacggcctgaacaccttcacgaacatggaggcccagctgatccggcagatggagagcgaggggatcttctcccccagcgagctcgagacccccaacctggccggccgcgtcctggactggctcgagaagcacggggtggagcggctgaagcgcatggcgatctccggcgacgactgcgtggtcaagcccatcgacgaccggttcgccaccgccctgaccgccctcaacgacatggggaaggtgcgcaaggacatcccgcagtgggagcccagcaagggctggaacgactggcagcaggtccccttctgcagccaccacttccaccagctgatcatgaaggacggccgggagatcgtcgtgccctgccgcaaccaggacgagctggtggggcgggcccgcgtctcccagggcgcggggtggagcctccgggagacggcctgcctgggcaagtcctacgcccagatgtggcagctgatgtacttccaccgccgggacctccgcctggccgcgaacgccatctgcagcgccgtgccggtggactgggtccccacctcccggaccacctggagcatccacgcccaccaccagtggatgacgaccgaggacatgctgtccgtgtggaaccgcgtgtggatcgaggagaacccctggatggaggacaagacccacatcagctcctggggcgacgtcccctacctcggcaagcgggaggaccagtggtgcggcagcctgatcgggctgaccgcccgcgcgacgtgggccaccaacatccaggtggccatcaaccaggtgcggcgcctcatcggcaacgagaactacctggactacatgacctccatgaagcgcttcaagaacgagagcgacccggagggggccctgtggtga

SEQ ID NO: 8419 - RNA, 9879 nt, synthetic construct
  misc_feature 1..9879: note = derived and/or modified CDS sequence (opt1) from DENV-1__FJ410249__SS-prME
  source 1..9879: mol_type = other RNA
agcgtgacgatgctgctcatgctgatgcccacggccctggccttccacctcacgacccggggcggggagccccacatgatcgtgagcaagcaggagcggggcaagagcctgctgttcaagaccagcgcgggggtgaacatgtgcaccctcatcgccatggacctgggcgagttctgcgaggacacgatgacctacaagtgcccccggatcaccgaggccgagcccgacgacgtggactgctggtgcaacgccaccgacacgtgggtgacctacgggacctgcagccagaccggcgagcggcgccgggacaagcgctccgtggccctggcgccccacgtgggcctcgggctggagacgcggaccgagacctggatgagctccgagggcgcctggaagcagatccagcgcgtcgagacctgggccctgcggcaccccgggttcacggtgatcgccctcttcctggcgcacgccatcggcaccagcatcacccagaaggggatcatcttcatcctgctcatgctggtgaccccctccatggccatgcgctgcgtcggcgtgggcagccgggacttcgtggaggggctgtccggcgccacgtgggtcgacgtggtgctcgagcacgggagctgcgtcaccaccatggccaaggacaagcccaccctggacatcgagctgctcaagacggaggtgaccaaccccgcggtgctgcgcaagctgtgcatcgaggccaagatctccaacaccaccacggacagccggtgcccgacccagggcgaggccaccctcgtcgaggagcaggacgccaacttcgtgtgccgccggaccttcgtggaccgcggctgggggaacggctgcgggctgttcggcaaggggtccctgatcacgtgcgccaagttcaagtgcgtcaccaagctcgagggcaagaccgtgcagtacgagaacctgaagtacagcgtgatcgtcaccgtgcacacgggcgaccagcaccaggtcgggaacgagtccaccgagcacggcaccaccgcgaccatcacgccccaggcccccagcaccgagatccagctgaccgactacggggccctcaccctggactgcagcccccggacgggcctggacttcaacgagatggtgctcctgaccatgaaggagaagtcctggctggtgcacaagcagtggttcctcgacctgccgctgccctggaccagcggggcctccaccagccaggagacgtggaaccgcaaggacctcctggtcaccttcaagaccgcccacgcgaagaagcaggaggtggtggtcctgggctcccaggagggcgccatgcacaccgccctcacgggggccaccgagatccagaccagcggcaccacgaccatcttcgccgggcacctgaagtgccggctgaagatggacaagctcaccctgaagggcatgtcctacgtgatgtgcaccgggagcttcaagctggagaaggaggtggcggagacgcagcacggcaccgtcctcgtgcagatcaagtacgagggcaccgacgccccctgcaagatccccttctccacccaggacgagaagggggtgacgcagaacggccgcctgatcaccgccaacccgatcgtcaccgacaaggagaagcccgtgaacatcgaggccgagccgcccttcggggagagctacatcgtgatcggcgcgggcgagaaggccctgaagctgtcctggttcaagaaggggagctccatcggcaagatgttcgaggccaccgcccgcggggcccgccgcatggcgatcctcggcgacacggcctgggacttcgggagcatcggcggcgtcttcacctccgtggggaagctggtgcaccagatcttcggcgccgcctacggggtcctgttcagcggcgtgtcctggaccatgaagatcgggatcggcgtgctcctgacctggctgggcctcaacagccggtccacgagcctgtccatgacctgcatcgccgtcgggctggtgaccctctacctgggcgtgatggtccaggcggacagcgggtgcgtgatcaactggaagggccgcgagctgaagtgcgggagcggcatcttcgtgaccaacgaggtccacacgtggaccgagcagtacaagttccaggccgactccccgaagcggctcagcgccgccatcggcaaggcctgggaggagggggtgtgcggcatccgctccgcgacccggctggagaacatcatgtggaagcagatcagcaacgagctgaaccacatcctcctggagaacgacatgaagttcaccgtggtcgtgggggacgtggccggcatcctggcccaggggaagaagatgatccgcccccagcccatggagtacaagtactcctggaagtcctggggcaaggccaagatcatcggcgcggacgtccagaacaccacgttcatcatcgacgggcccaacaccccggagtgccccgacgaccagcgggcctggaacatctgggaggtggaggactacggcttcgggatcttcaccaccaacatctggctcaagctgcgcgactcctacacccaggtgtgcgaccaccggctgatgagcgccgccatcaaggactccaaggccgtccacgcggacatgggctactggatcgagagcgagaagaacgagacctggaagctcgcccgcgcctccttcatcgaggtgaagacctgcatctggcccaagagccacaccctgtggtccaacggcgtgctggagagcgagatgatcatccccaagatctacgggggcccgatctcccagcacaactaccggcccgggtacttcacgcagaccgccggcccctggcacctcgggaagctggagctggacttcgacctctgcgagggcaccaccgtcgtggtggacgagcactgcggcaaccgcgggccgagcctgcggacgaccaccgtcaccggcaagatcatccacgagtggtgctgccgctcctgcacgctgccgcccctgcggttcaagggggaggacggctgctggtacgggatggagatccgccccgtgaaggagaaggaggagaacctggtcaagagcatggtcagcgccggctccggcgaggtggacagcttctccctggggctcctgtgcatcagcatcatgatcgaggaggtgatgcggtcccgctggagccggaagatgctgatgaccggcaccctcgcggtcttcttcttcctgatcatggggcagctgacctggaacgacctcatccgcctgtgcatcatggtgggcgccaacgcctccgaccgcatggggatgggcacgacctacctggccctcatggccaccttcaagatgcggccgatgttcgcggtggggctgctgttccgccggctcaccagccgcgaggtcctgctgctcacgaccgggctgtccctggtggccagcgtcgagctccccaactccctggaggagctgggcgacgggctcgccatgggcatcatgatcctgaagctgctcaccgacttccagagccaccagctgtgggccaccctgctctccctgacgttcatcaagaccaccttcagcctgcactacgcgtggaagaccatggccatggtgctctccatcgtgagcctgttccccctgtgcctctccacgaccagccagaagaccacctggctgcccgtcctgctcggctccctggggtgcaagccgctgacgatgttcctcatcgccgagaacaagatctggggccgcaagagctggcccctgaacgaggggatcatggccgtgggcatcgtgagcatcctgctctccagcctgctgaagaacgacgtccccctcgccgggcccctgatcgcgggcggcatgctgatcgcctgctacgtgatctccgggagctccgccgacctcagcctggagaaggccgccgaggtgtcctgggaggaggaggcggagcacagcggcgcctcccacaacatcctggtcgaggtgcaggacgacgggaccatgaagatcaaggacgaggagcgcgacgacaccctcaccatcctgctgaaggccaccctcctggccgtgagcggcgtctacccgctgtccatccccgccaccctcttcgtgtggtacttctggcagaagaagaagcagcggagcggggtgctgtgggacacccccagcccgcccgaggtcgagcgcgcggtgctggacgacggcatctaccggatcatgcagcgcggcctcctggggcggagccaggtgggcgtcggggtgttccaggagaacgtgttccacaccatgtggcacgtcacccgcggcgccgtgctgatgtaccaggggaagcggctggagccctcctgggccagcgtgaagaaggacctcatctcctacggcggcgggtggcgcctgcagggcagctggaacacgggggaggaggtccaggtgatcgccgtggagcccggcaagaaccccaagaacgtccagaccgcccccgggaccttcaagacctccgagggcgaggtgggcgcgatcgccctggacttcaagcccgggacgagcggcagccccatcgtgaaccgggaggggaagatcgtcggcctctacggcaacggggtggtgaccacctccggcacctacgtcagcgccatcgcccaggcgaaggcctcccaggaggggcccctgccggagatcgaggacgaggtgttccgcaagcggaacctgacgatcatggacctccaccccggcagcgggaagacccgccggtacctgcccgccatcgtgcgcgaggccatcaagcggaagctgcgcaccctcatcctggccccgacccgcgtcgtggcgtccgagatggccgaggccctgaagggcatgcccatccggtaccagacgaccgccgtcaagagcgagcacaccggcaaggagatcgtcgacctcatgtgccacgccaccttcacgatgcgcctgctgtcccccgtgcgggtgcccaactacaacatgatcatcatggacgaggcgcacttcaccgacccgagctccatcgccgcccgcgggtacatcagcacccgggtcggcatgggggaggccgccgcgatcttcatgaccgccacgccgcccggctccgtggaggccttcccccagagcaacgccgtgatccaggacgaggagcgcgacatcccggagcggtcctggaacagcgggtacgagtggatcaccgacttccccggcaagaccgtctggttcgtgccctccatcaagagcggcaacgacatcgcgaactgcctccgcaagaacgggaagcgggtgatccagctgtcccgcaagaccttcgacacggagtaccagaagaccaagaacaacgactgggactacgtcgtgaccaccgacatcagcgagatgggcgccaacttccgggccgaccgcgtgatcgacccccggcgctgcctgaagccggtcatcctcaaggacgggcccgagcgggtgatcctggccggccccatgcccgtcacggtggcctccgcggcccagcgccgggggcgcatcggccggaaccacaacaaggagggcgaccagtacatctacatggggcagccgctgaacaacgacgaggaccacgcccactggaccgaggccaagatgctcctggacaacatcaacacccccgagggcatcatccccgccctgttcgagcccgagcgcgagaagtccgcggccatcgacggggagtaccgcctccggggcgaggcccgcaagaccttcgtggagctgatgcggcgcggggacctgccggtctggctcagctacaaggtggcctccgagggcttccagtacagcgaccggcgctggtgcttcgacggcgagcggaacaaccaggtgctggaggagaacatggacgtcgagatctggacgaaggagggggagcgcaagaagctgcggccccgctggctcgacgcccggacctactccgaccccctggcgctgcgcgagttcaaggagttcgccgccggccggcgcagcgtgtccggggacctcatcctggagatcggcaagctgccccagcacctcacccagcgggcccagaacgcgctggacaacctggtgatgctccacaacagcgagcagggcgggcgcgcctaccggcacgccatggaggagctgccggacaccatcgagacgctgatgctcctggccctgatcgccgtcctcaccggcggggtgaccctgttcttcctgtccggccgcgggctcggcaagaccagcatcggcctgctgtgcgtgatggcgtccagcgtcctcctgtggatggcctccgtggagccccactggatcgccgccagcatcatcctggagttcttcctcatggtgctgctgatccccgagcccgaccggcagcgcaccccgcaggacaaccagctcgcctacgtcgtgatcgggctgctgttcatgatcctcacggtggcggccaacgagatgggcctgctggagaccaccaagaaggacctcgggatcggccacgtcgccgtggagaaccaccaccacgccgccatgctggacgtggacctgcaccccgcgtccgcctggaccctctacgccgtcgccacgaccatcatcacccccatgatgcggcacaccatcgagaacacgaccgccaacatcagcctgaccgcgatcgccaaccaggccgccatcctgatggggctcgacaagggctggccgatctccaagatggacatcggcgtgcccctgctggcgctcgggtgctacagccaggtgaaccccctgaccctgacggccgccgtcctcatgctggtggcccactacgccatcatcggccccgggctgcaggcgaaggccacccgcgaggcccagaagcgcaccgccgccggcatcatgaagaacccgaccgtggacgggatcgtcgcgatcgacctcgaccccgtggtgtacgacgccaagttcgagaagcagctgggccagatcatgctgctcatcctgtgcacgtcccagatcctgctcatgcggaccacctgggccctgtgcgagagcatcaccctggccacgggccccctcaccaccctgtgggaggggtcccccggcaagttctggaacaccacgatcgccgtcagcatggcgaacatcttccgcgggagctacctggccggcgccggcctcgccttctccctgatgaagtccctcgggggcgggcggcgcgggaccggggcgcagggcgagaccctcggcgagaagtggaagcggcagctgaaccagctgtccaagagcgagttcaacacctacaagcgctccgggatcatggaggtggaccggagcgaggccaaggagggcctcaagcgcggggagacgaccaagcacgccgtgtcccggggcaccgccaagctgcgctggttcgtcgagcggaacctggtgaagccggaggggaaggtgatcgacctcggctgcggccgcgggggctggagctactactgcgccgggctgaagaaggtcaccgaggtgaagggctacacgaagggcgggcccggccacgaggagcccatccccatggcgacctacgggtggaacctggtgaagctgcactccggcaaggacgtcttcttcatcccgcccgagaagtgcgacaccctcctgtgcgacatcggggagagctcccccaaccccaccatcgaggagggccggacgctgcgcgtgctcaagatggtggagccgtggctgcgggggaaccagttctgcatcaagatcctgaacccctacatgcccagcgtcgtggagaccctcgagcagatgcagcgcaagcacggcggcatgctggtgcggaaccccctgtcccgcaacagcacccacgagatgtactgggtctcctgcgggaccggcaacatcgtgagcgccgtgaacatgacctcccggatgctcctgaaccgcttcacgatggcccaccgcaagccgacctacgagcgggacgtcgacctgggggccggcacccgccacgtggccgtggagcccgaggtcgcgaacctcgacatcatcggccagcggatcgagaacatcaagcacgagcacaagagcacctggcactacgacgaggacaacccctacaagacgtgggcctaccacgggtcctacgaggtgaagcccagcggcagcgcctccagcatggtcaacggggtggtgaagctgctgaccaagccgtgggacgtcatccccatggtgacccagatcgccatgaccgacacgacccccttcggccagcagcgcgtgttcaaggagaaggtcgacacccggacccccaaggccaagcgcgggacggcgcagatcatggaggtgaccgccaagtggctctggggcttcctgtcccggaacaagaagccgcgcatctgcacccgggaggagttcacccgcaaggtgcggagcaacgccgccatcggcgcggtcttcgtggacgagaaccagtggaactccgccaaggaggccgtggaggacgagcgcttctgggacctggtccaccgggagcgcgagctccacaagcaggggaagtgcgccacgtgcgtgtacaacatgatgggcaagcgggagaagaagctgggggagttcggcaaggccaaggggagccgcgcgatctggtacatgtggctgggcgcccggttcctcgagttcgaggccctgggcttcatgaacgaggaccactggttctcccgcgagaacagcctgtccggggtggagggcgaggggctccacaagctgggctacatcctgcgggacatcagcaagatccccgggggcaacatgtacgccgacgacaccgccggctgggacacccgcatcaccgaggacgacctccagaacgaggcgaagatcacggacatcatggagcccgagcacgccctgctggccaagtccatcttcaagctcacctaccagaacaaggtcgtgcgggtgcagcgcccggccaagaacgggaccgtcatggacgtgatcagccgccgggaccagcgcggctccggccaggtgggcacctacggcctgaacacgttcaccaacatggaggcccagctgatccggcagatggagagcgaggggatcttctcccccagcgagctcgagacccccaacctggcgggccgcgtcctggactggctcgagaagcacggggtggagcggctgaagcgcatggccatctccggcgacgactgcgtggtcaagcccatcgacgaccggttcgccaccgccctgacggccctcaacgacatggggaaggtgcgcaaggacgtgccgcagtgggagcccagcaagggctggaacgactggcagcaggtccccttctgcagccaccacttccaccagctgatcatgaaggacggccgggagatcgtggtgccctgccgcaaccaggacgagctggtcgggcgggcgcgcgtgtcccagggcgccgggtggagcctccgggagaccgcctgcctgggcaagtcctacgcccagatgtggcagctgatgtacttccaccgccgggacctccgcctggcggccaacgccatctgcagcgccgtgccggtcgactgggtgcccacctcccggaccacgtggagcatccacgcccaccaccagtggatgaccaccgaggacatgctgtccgtgtggaaccgcgtctggatcgaggagaacccctggatggaggacaagacccacatcagctcctggggcgacgtgccctacctcggcaagcgggaggaccagtggtgcggcagcctgatcgggctgacggcgcgcgccacctgggccaccaacatccaggtggccatcaaccaggtccgccggctcatcggcaacgagaactacctggactacatgacctccatgaagcgcttcaagaacgagagcgacccggagggggccctgtggtga

SEQ ID NO: 8420 - RNA, 9879 nt, synthetic construct
  misc_feature 1..9879: note = derived and/or modified CDS sequence (opt1) from DENV-1__FJ410251__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgccggggtgaacatgtgcaccctcatcgccatggacctgggcgagctgtgcgaggacaccatgacctacaagtgcccccgcatcaccgaggccgagcccgacgacgtggactgctggtgcaacgccaccgacacctgggtgacctacgggacctgcagccagacgggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgggaaggccctgaagctcagctggttcaagaagggctccagcatcgggaagatgttcgaggccaccgcccgcggcgcccggcgcatggcgatcctgggggacacggcctgggacttcggctccgtgggcggggtgttcaccagcgtcggcaagctggtgcaccagatcttcgggaccgcctacggcgtcctgttctccggggtcagctggaccatgaagatcggcatcggcgtgctgctgacgtggctcgggctgaactcccgcagcacctccctgagcatgacctgcatcgccgtgggcctcgtcaccctgtacctgggggtgatggtgcaggccgactccggctgcgtcatcaactggaaggggcgggagctcaagtgcggcagcggcatcttcgtgacgaacgaggtgcacacctggaccgagcagtacaagttccaggcggacagcccgaagcgcctgtccgccgccatcgggaaggcctgggaggagggcgtctgcgggatccggagcgccacccgcctggagaacatcatgtggaagcagatctccaacgagctcaaccacatcctgctggagaacgacatgaagttcaccgtggtggtcggcgacgtggtggggatcctcgcgcagggcaagaagatgatccggccccagcccatggagcacaagtacagctggaagtcctggggcaaggccaagatcatcggggccgacgtccagaacacgaccttcatcatcgacggccccaacaccccggagtgccccgacgaccagcgcgcctggaacatctgggaggtggaggactacgggttcggcatcttcaccacgaacatctggctgaagctgcgggacagctacacccaggtgtgcgaccaccgcctcatgtccgcggccatcaaggacagcaaggccgtccacgccgacatgggctactggatcgagtccgagaagaacgagacctggaagctggcccgggcgagcttcatcgaggtgaagacctgcatctggcccaagtcccacacgctgtggagcaacggggtgctcgagtccgagatgatcatccccaagatctacggcgggccgatcagccagcacaactaccgccccggctacttcacccagaccgccgggccctggcacctgggcaagctggagctcgacttcgacctgtgcgagggcaccacggtcgtggtggacgagcactgcgggaaccggggcccgtccctgcgcaccaccaccgtcacggggaagatcatccacgagtggtgctgccggagctgcaccctgccgcccctccgcttcaagggcgaggacgggtgctggtacggcatggagatccggcccgtgaaggagaaggaggagaacctggtgaagtccatggtcagcgccggcagcggggaggtggactccttcagcctcggcctgctgtgcatctccatcatgatcgaggaggtgatgcgcagccggtggtcccgcaagatgctcatgaccgggaccctggccgtcttcctgctcctgatcatgggccagctgacgtggaacgacctcatccggctgtgcatcatggtgggggccaacgcgagcgaccgcatgggcatgggcaccacctacctggccctcatggccaccttcaagatgcgcccgatgttcgccgtggggctgctgttccggcgcctcacgtcccgggaggtcctgctgctcaccatcgggctgagcctggtggcctccgtcgagctccccaacagcctggaggagctgggggacggcctcgcgatgggcatcatgatcctgaagctgctcaccgacttccagtcccaccagctgtgggccaccctgctcagcctgacgttcatcaagaccaccctgtccctccactacgcctggaagaccatggccatggtgctgagcatcgtgtccctgttccccctctgcctgagcacgacctcccagaagaccacctggctgcccgtcctcctggggagcctgggctgcaagccgctcacgatgttcctgatcaccgagaacaagatctgggggcgcaagtcctggcccctgaacgagggcatcatggcggtgggggtggtcagcatcctcctgagctccctgctcaagaacgacgtgcccctggccggccccctgatcgccggcgggatgctcatcgcctgctacgtgatcagcggctccagcgccgacctgtccctggagaaggcggccgaggtcagctgggaggaggaggccgagcactccggggccagccacaacatcctcgtggaggtgcaggacgacggcaccatgaagatcaaggacgaggagcgggacgacaccctgaccatcctgctcaaggccacgctgctggcggtctccggggtgtacccgctcagcatccccgccaccctgttcgtgtggtacttctggcagaagaagaagcagcgctccggcgtcctgtgggacacccccagcccgcccgaggtggagcgggccgtgctggacgacggcatctaccgcatcatgcagcgggggctcctgggccgctcccaggtcggggtgggcgtgttccaggagaacgtcttccacaccatgtggcacgtgacgcgcggggccgtgctgatgtaccagggcaagcgcctcgagcccagctgggcctccgtcaagaaggacctgatcagctacggcgggggctggcggctgcaggggtcctggaacaccggcgaggaggtccaggtgatcgcggtcgagcccgggaagaaccccaagaacgtgcagaccgcccccggcaccttcaagacgcccgagggcgaggtgggggccatcgccctcgacttcaagcccggcaccagcgggtcccccatcgtcaaccgcgagggcaagatcgtgggcctgtacgggaacggcgtggtcaccaccagcgggacgtacgtgagcgccatcgcgcaggccaaggcctcccaggagggcccgctgcccgagatcgaggacgaggtgttccggaagcgcaacctcaccatcatggacctgcaccccgggagcggcaagacccggcgctacctgccggccatcgtccgggaggcgatcaagcgcaagctccggaccctgatcctggcccccacgcgcgtggtggcctccgagatggccgaggccctcaagggcatgcccatccgctaccagaccaccgcggtcaagagcgagcacaccgggaaggagatcgtggacctgatgtgccacgccacgttcaccatgcggctgctctcccccgtgcgcgtcccgaactacaacatgatcatcatggacgaggcccacttcaccgaccccagctccatcgccgcccggggctacatcagcacccgcgtggggatgggcgaggcggccgccatcttcatgacggccacgccgcccgggtccgtggaggccttcccgcagagcaacgcggtcatccaggacgaggagcgggacatccccgagcgctcctggaacagcggctacgagtggatcaccgacttccccggcaagaccgtgtggttcgtgccctccatcaagagcgggaacgacatcgccaactgcctgcggaagaacggcaagcgcgtcatccagctgtcccggaagacgttcgacaccgagtaccagaagaccaagaacaacgactgggactacgtggtgaccacggacatcagcgagatgggggccaacttccgcgccgaccgggtcatcgacccgcgccggtgcctcaagcccgtgatcctgaaggacggccccgagcgcgtcatcctggcggggcccatgccggtgaccgtggcctccgccgcccagcggcgcggccggatcggccgcaaccacaacaaggagggggaccagtacatctacatgggccagcccctcaacaacgacgaggaccacgcccactggaccgaggcgaagatgctgctggacaacatcaacacccccgaggggatcatccccgccctcttcgagccggagcgggagaagtccgccgccatcgacggcgagtaccgcctgcgcggggaggcccggaagacgttcgtcgagctgatgcgccggggcgacctccccgtgtggctgtcctacaaggtggcgagcgagggcttccagtacagcgaccgccggtggtgcttcgacggggagcgcaacaaccaggtcctggaggagaacatggacgtggagatctggaccaaggagggcgagcggaagaagctccgcccccggtggctggacgcccgcacctactccgaccccctggccctccgggagttcaaggagttcgccgccgggcgccggagcgtgtccggcgacctgatcctggagatcggcaagctcccgcagcacctgacccagcgcgcgcagaacgccctggacaacctcgtcatgctgcacaacagcgagcagggcgggcgggcctaccgccacgccatggaggagctgcccgacacgatcgagaccctcatgctgctggcgctcatcgccgtgctgaccgggggcgtgaccctgttcttcctctccgggcggggcctgggcaagaccagcatcgggctgctctgcgtcatggcctccagcgtgctgctgtggatggcctccgtggagccccactggatcgccgcgagcatcatcctcgagttcttcctgatggtcctgctcatccccgagccggaccgccagcggacgccccaggacaaccagctggcctacgtggtgatcggcctcctcttcatgatcctgaccgtcgccgccaacgagatggggctgctcgagaccaccaagaaggacctgggcatcgggcacgtggccgtggagaaccaccaccacgcgacgatgctggacgtcgacctccaccccgcctccgcctggaccctgtacgccgtggccaccaccatcatcacgccgatgatgcgccacaccatcgagaacaccaccgcgaacatcagcctgacggccatcgccaaccaggccgccatcctcatgggcctggacaagggctggcccatctccaagatggacatcggggtgcccctgctcgcgctgggctgctacagccaggtcaaccccctgaccctcaccgccgccgtgctgatgctggtggcccactacgcgatcatcgggccgggcctccaggccaaggccacccgggaggcccagaagcgcacggccgcggggatcatgaagaaccccaccgtcgacggcatcgtggccatcgacctggaccccgtggtctacgacgccaagttcgagaagcagctgggccagatcatgctcctgatcctgtgcacctcccagatcctcctgatgcgcaccacgtgggccctgtgcgagagcatcaccctcgccaccgggcccctgaccacgctgtgggagggctccccggggaagttctggaacaccaccatcgcggtgagcatggccaacatcttccggggctcctacctcgccggcgccgggctggccttcagcctgatgaagtccctcggcgggggccgccgggggaccggcgcgcagggcgagacgctgggggagaagtggaagcgccagctgaaccagctctccaagagcgagttcaacatctacaagcggtccggcatcatggaggtggaccgcagcgaggccaaggaggggctgaagcggggcgagaccacccgccacgccgtctcccgggggaccgccaagctgcgctggttcgtggagcggaacctggtgaagcccgagggcaaggtcatcgacctcggctgcgggcgcggcgggtggagctactactgcgcgggcctgaagaaggtgacggaggtgaaggggtacaccaagggcggccccgggcacgaggagcccatcccgatggccacctacggctggaacctggtcaagctccactccgggaaggacgtgttcttcacgccgcccgagaagtgcgacacgctgctgtgcgacatcggcgagagctcccccaacccgaccatcgaggaggggcggaccctccgcgtgctgaagatggtcgagccctggctgcggggcaaccagttctgcatcaagatcctcaacccctacatgcccagcgtggtggagaccctggagcagatgcagcgcaagcacggcgggatgctggtccggaacccgctctcccgcaacagcacccacgagatgtactgggtgtcctgcggcacggggaacatcgtgagcgccgtcaacatgacctcccggatgctgctgaaccgcttcaccatggcccaccgcaagcccacctacgagcgggacgtggacctcggcgccggcacgcgccacgtggcggtcgagcccgaggtggccaacctggacatcatcgggcagcggatcgagaacatcaagcacgagcacaagagcacctggcactacgacgaggacaacccctacaagacctgggcctaccacggctcctacgaggtcaagccgagcgggtccgccagcagcatggtgaacggcgtggtcaagctgctcaccaagccctgggacgtgatccccatggtgacgcagatcgccatgaccgacaccacccccttcgggcagcagcgcgtcttcaaggagaaggtggacacgcggaccccgaaggcgaagcgcggcaccgcccagatcatggaggtgaccgcccggtggctgtggggcttcctgtcccgcaacaagaagccccggatctgcacgcgcgaggagttcacccggaaggtccgcagcaacgccgccatcggggcggtgttcgtggacgagaaccagtggaactccgccaaggaggccgtcgaggacgagcggttctgggacctcgtgcagaaggagcgcgagctgcacaagcagggcaagtgcgcgacctgcgtgtacaacatgatggggaagcgggagaagaagctgggcgagttcgggaaggcgaagggcagccgcgccatctggtacatgtggctcggcgcccggttcctggagttcgaggccctggggttcatgaacgaggaccactggttctcccgcgagaacagcctctccggcgtcgagggggagggcctgcacaagctggggtacatcctccgggacatcagcaagatccccggcggcaacatgtacgccgacgacaccgcggggtgggacacgcgcatcaccgaggacgacctgcagaacgaggccaagatcaccgacatcatggagccggagcacgccctgctcgccacctccatcttcaagctgacgtaccagaacaaggtggtgcgggtccagcgccccgccaagaacggcaccgtgatggacgtgatcagccgccgggaccagcgcgggtccggccaggtcggcacctacgggctgaacaccttcacgaacatggaggcgcagctcatccggcagatggagagcgagggcatcttcctgccctccgagctggagacccccaacctcgccgagcgcgtgctggactggctggagaagtacggggtggagcggctcaagcgcatggccatcagcggcgacgactgcgtcgtgaagccgatcgacgaccggttcgccaccgccctgaccgcgctgaacgacatggggaaggtgcgcaaggacatcccccagtgggagccctccaagggctggaacgactggcagcaggtccccttctgcagccaccacttccaccagctcatcatgaaggacggccgggagatcgtggtgccgtgccgcaaccaggacgagctggtcgggcgggcccgcgtgtcccagggcgccgggtggagcctgcgggagacggcctgcctcggcaagagctacgcccagatgtggcagctgatgtacttccaccgccgggacctgcgcctcgcggccaacgccatctgctccgccgtgcccgtcgactgggtgcccaccagccggaccacctggtccatccacgcgcaccaccagtggatgacgaccgaggacatgctgagcgtgtggaaccgcgtctggatcgaggagaacccctggatggaggacaagacccacgtgtccagctggggcgacgtgccgtacctgggcaagcgggaggaccagtggtgcggctccctcatcgggctgaccgcccgcgccacctgggccagcaacatccaggtcgccatcaaccaggtgcgccggctgatcggcaacgagaactacctcgactacatgacgtccatgaagcgcttcaagaacgagggggaccccgagggcgcgctgtggtga

SEQ ID NO: 8421 - RNA, 9879 nt, synthetic construct
  misc_feature 1..9879: note = derived and/or modified CDS sequence (opt1) from DENV-1__FJ410252__SS-prME
  source 1..9879: mol_type = other RNA
agcgtgaccatgctgctgatgctgatgcccaccgccctggccttccacctcacgacccggggcggggagccccacatgatcgtgtccaagcaggagcggggcaagagcctgctgttcaagacctccgccggggtgaacatgtgcaccctcatcgccatggacctgggcgagttctgcgaggacaccatgacctacaagtgcccccgcatcaccgaggccgagcccgacgacgtggactgctggtgcaacgccaccgacacgtgggtcacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtcgagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccctggtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctcaccgactacggggccctgaccctggactgcagcccccggaccggcctcgacttcaacgagatggtcctgctgacgatgaaggagaagtcctggctcgtgcacaagcagtggttcctggacctgccgctcccctggaccagcggggcctccaccagccaggagacctggaaccggcaggacctgctggtgacgttcaagaccgcccacgcgaagaagcaggaggtcgtggtgctcggctcccaggagggcgccatgcacaccgccctgaccggggccacggagatccagaccagcggcaccaccacgatcttcgccgggcacctgaagtgccgcctcaagatggacaagctgaccctgaagggcatgtcctacgtcatgtgcaccgggagcttcaagctcgagaaggaggtggcggagacccagcacggcacggtgctggtccagatcaagtacgagggcaccgacgccccctgcaagatccccttcctgacccaggacgagaagggggtgacccagaacggccggctgatcacggccaacccgatcgtgaccgacaaggagaagcccgtcaacatcgaggccgagccgcccttcggggagtcctacatcgtgatcggcgcgggcgagaaggccctcaagctgagctggttcaagaaggggtccagcatcggcaagatgttcgaggccaccgcccgcggggcccggcgcatggcgatcctgggcgacaccgcctgggacttcgggtccatcggcggcgtgttcacgagcgtcgggaagctcgtgcaccagatcttcggcaccgcctacggggtgctgttctccggcgtcagctggaccatgaagatcgggatcggcgtgctgctcacctggctgggcctgaactcccgcagcacgtccctcagcatgacctgcatcgccgtggggctggtcaccctgtacctcggcgtgatggtgcaggccgactccgggtgcgtcatcaactggaagggccgggagctgaagtgcgggagcggcatcttcgtgaccaacgaggtgcacacgtggaccgagcagtacaagttccaggcggacagcccgaagcgcctgtccgccgccatcggcaaggcctgggaggagggggtctgcggcatccggagcgccacccgcctcgagaacatcatgtggaagcagatctccaacgagctgaaccacatcctgctcgagaacgacatgaagttcaccgtggtggtcggggacgtggcgggcatcctggcccaggggaagaagatgatccggccccagcccatggagtacaagtacagctggaagtcctggggcaaggccaagatcatcggcgccgacgtgcagaacaccacgttcatcatcgacgggcccaacaccccggagtgccccgacgaccagcgcgcgtggaacatctgggaggtcgaggactacggcttcgggatcttcaccaccaacatctggctgaagctccgggacagctacacccaggtgtgcgactaccgcctgatgtccgccgccatcaaggacagcaaggccgtgcacgccgacatgggctactggatcgagtccgagaagaacgagacctggaagctggcgcgggccagcttcatcgaggtcaagacctgcatctggcccaagtcccacaccctctggagcaacggcgtgctggagtccgagatgatcatccccaagatctacgggggcccgatcagccagcacaactaccgccccgggtacttcacgcagaccgccggcccctggcacctggggaagctcgagctggacttcgacctgtgcgagggcaccaccgtggtcgtggacgagcactgcggcaaccgggggccgtccctccgcacgaccaccgtgaccggcaagatcatccacgagtggtgctgccggagctgcacgctgccgcccctgcgcttcaagggggaggacggctgctggtacgggatggagatccggcccgtcaaggagaaggaggagaacctcgtgaagtccatggtgagcgccggcagcggcgaggtcgactccttcagcctggggctgctctgcatctccatcatgatcgaggaggtgatgcgcagccggtggtcccgcaagatgctgatgaccggcaccctggccgtgttcttcctcctgatcatggggcagctgacctggaacgacctcatccggctgtgcatcatggtcggcgcgaacgccagcgaccgcatggggatgggcacgacctacctggccctcatggccaccttcaagatgcgcccgatgttcgccgtgggcctgctgttccggcgcctcacctcccgggaggtgctgctgctcacgatcgggctgagcctggtcgcgtccgtggagctccccaacagcctggaggagctgggcgacgggctcgccatgggcatcatgatcctgaagctgctcaccgacttccagtcccaccagctgtgggccaccctgctcagcctgaccttcatcaagacgaccttctccctgcactacgcctggaagaccatggcgatggtcctcagcatcgtgtccctgttccccctgtgcctcagcaccacgtcccagaagaccacctggctgcccgtgctgctcggcagcctggggtgcaagccgctgaccatgttcctcatcgccgagaacaagatctggggccgcaagtcctggcccctgaacgaggggatcatggccgtcggcatcgtgagcatcctgctcagctccctgctgaagaacgacgtgcccctcgccgggcccctgatcgccggcggcatgctgatcgcgtgctacgtcatcagcgggtccagcgccgacctctccctggagaaggccgccgaggtgagctgggaggaggaggccgagcactccggcgcgagccacaacatcctggtggaggtccaggacgacgggacgatgaagatcaaggacgaggagcgggacgacaccctcaccatcctgctgaaggccaccctcctggccgtgtccggcgtgtacccgctgagcatccccgccaccctcttcgtctggtacttctggcagaagaagaagcagcgctccggggtgctgtgggacacgcccagcccgcccgaggtggagcgggccgtcctggacgacggcatctaccgcatcatgcagcggggcctgctcgggcgctcccaggtgggcgtgggggtcttccaggagaacgtgttccacaccatgtggcacgtgacccggggcgcggtcctgatgtaccaggggaagcgcctggagcccagctgggcctccgtgaagaaggacctcatcagctacggcggcgggtggcggctgcagggctcctggaacaccggggaggaggtgcaggtcatcgccgtggagcccggcaagaaccccaagaacgtgcagacggcccccgggaccttcaagaccagcgagggcgaggtcggcgccatcgcgctggacttcaagcccgggacctccggcagccccatcgtgaaccgcgaggggaagatcgtgggcctctacggcaacggggtcgtgacgaccagcggcacctacgtgtccgccatcgcccaggccaaggcgagccaggaggggcccctgccggagatcgaggacgaggtcttccggaagcgcaacctgaccatcatggacctccaccccggctccgggaagacgcggcgctacctgcccgccatcgtgcgggaggccatcaagcgcaagctgcggaccctcatcctggccccgacccgcgtggtcgccagcgagatggcggaggccctgaagggcatgcccatccgctaccagaccacggccgtgaagtccgagcacaccggcaaggagatcgtggacctcatgtgccacgccaccttcaccatgcggctgctgagccccgtccgcgtgcccaactacaacatgatcatcatggacgaggcccacttcacggacccgtccagcatcgcggcccgggggtacatctccacccgcgtgggcatgggggaggccgccgccatcttcatgaccgcgacgccgcccggcagcgtcgaggccttcccccagtccaacgccgtgatccaggacgaggagcgggacatcccggagcgcagctggaactccgggtacgagtggatcacggacttccccggcaagaccgtgtggttcgtccccagcatcaagtccggcaacgacatcgccaactgcctccggaagaacgggaagcgcgtgatccagctgagccggaagaccttcgacaccgagtaccagaagacgaagaacaacgactgggactacgtggtcaccaccgacatctccgagatgggcgcgaacttccgcgccgaccgggtgatcgacccccgccggtgcctgaagccggtgatcctcaaggacgggcccgagcgcgtcatcctggccggccccatgcccgtgaccgtcgccagcgccgcgcagcggcgcgggcggatcggccgcaaccacaacaaggagggcgaccagtacatctacatggggcagccgctgaacaacgacgaggaccacgcccactggacggaggccaagatgctcctggacaacatcaacacccccgagggcatcatccccgccctgttcgagcccgagcgggagaagtccgccgcgatcgacggggagtaccgcctccgcggcgaggcccggaagaccttcgtggagctgatgcgccgcggggacctgccggtgtggctcagctacaaggtcgccagcgagggcttccagtactccgaccgccggtggtgcttcgacggcgagcgcaacaaccaggtgctggaggagaacatggacgtggagatctggaccaaggagggggagcggaagaagctgcgcccccggtggctcgacgcccgcacgtacagcgaccccctggccctgcgggagttcaaggagttcgcggccggccgccggtccgtcagcggggacctcatcctggagatcggcaagctgccccagcacctcacccagcgcgcccagaacgccctggacaacctggtgatgctccacaactccgagcagggcgggcgggcgtaccgccacgccatggaggagctgccggacaccatcgagaccctgatgctcctggccctgatcgccgtgctcacgggcggggtcaccctgttcttcctgagcggccgggggctcggcaagacctccatcggcctgctgtgcgtgatggccagctccgtgctcctgtggatggcgagcgtcgagccccactggatcgccgcctccatcatcctggagttcttcctcatggtgctgctgatccccgagcccgaccgccagcggaccccgcaggacaaccagctcgcctacgtggtcatcgggctgctgttcatgatcctcaccgtggccgcgaacgagatgggcctgctggagacgaccaagaaggacctcgggatcggccacgtggccgtcgagaaccaccaccacgccgccatgctggacgtggacctgcaccccgccagcgcgtggaccctctacgccgtggccaccacgatcatcacccccatgatgcgccacaccatcgagaacaccacggccaacatctccctgaccgccatcgcgaaccaggccgccatcctgatggggctcgacaagggctggccgatcagcaagatggacatcggcgtccccctgctggccctcgggtgctactcccaggtgaaccccctgaccctgaccgcggccgtgctcatgctggtcgcccactacgccatcatcggccccgggctgcaggccaaggcgacgcgggaggcccagaagcgcaccgccgccggcatcatgaagaacccgaccgtggacgggatcgtggccatcgacctcgaccccgtcgtgtacgacgcgaagttcgagaagcagctgggccagatcatgctgctcatcctgtgcaccagccagatcctgctcatgcgcacgacctgggccctgtgcgagtccatcaccctggccaccggccccctcacgaccctgtgggaggggagccccggcaagttctggaacaccaccatcgccgtgtccatggccaacatcttccgggggagctacctggcgggcgccggcctcgccttcagcctgatgaagtccctcgggggcgggcgccgggggacgggggcccagggcgagaccctcggcgagaagtggaagcgccagctgaaccagctgagcaagtccgagttcaacacctacaagcggagcgggatcatggaggtcgaccgctccgaggcgaaggagggcctcaagcgcggggagaccacgaagcacgccgtgagccgcggcaccgccaagctgcggtggttcgtggagcgcaacctggtcaagccggaggggaaggtgatcgacctgggctgcggccgcggcgggtggtcctactactgcgccgggctcaagaaggtgaccgaggtcaaggggtacaccaagggcgggcccggccacgaggagcccatccccatggccacgtacgggtggaacctggtgaagctgcacagcggcaaggacgtgttcttcatcccgcccgagaagtgcgacaccctcctgtgcgacatcggggagtccagccccaaccccaccatcgaggagggccgcaccctgcgggtcctcaagatggtggagccgtggctgcgcgggaaccagttctgcatcaagatcctgaacccctacatgccctccgtggtcgagacgctcgagcagatgcagcggaagcacggcggcatgctggtgcgcaaccccctgagccggaactccacccacgagatgtactgggtgagctgcgggaccggcaacatcgtctccgcggtgaacatgaccagccgcatgctcctgaaccggttcaccatggcccaccgcaagccgacgtacgagcgcgacgtggacctgggggccggcacccggcacgtcgccgtggagcccgaggtggccaacctcgacatcatcggccagcgcatcgagaacatcaagcacgagcacaagtccacctggcactacgacgaggacaacccctacaagacctgggcgtaccacgggagctacgaggtcaagccctccggcagcgccagctccatggtgaacggggtcgtgaagctgctgacgaagccgtgggacgtgatccccatggtcacccagatcgccatgaccgacaccacgcccttcggccagcagcgggtgttcaaggagaaggtggacacccgcacccccaaggccaagcgggggaccgcccagatcatggaggtcacggcgaagtggctctggggcttcctgagccgcaacaagaagccgcggatctgcacccgcgaggagttcacccggaaggtgcgctccaacgccgccatcggcgccgtgttcgtcgacgagaaccagtggaacagcgcgaaggaggccgtggaggacgagcggttctgggacctggtgcaccgcgagcgggagctccacaagcaggggaagtgcgcgacctgcgtctacaacatgatgggcaagcgcgagaagaagctgggggagttcggcaaggccaaggggtcccgggccatctggtacatgtggctgggcgcgcgcttcctcgagttcgaggccctgggcttcatgaacgaggaccactggttcagccgggagaactccctgagcggggtggagggcgaggggctccacaagctgggctacatcctgcgcgacatctccaagatccccgggggcaacatgtacgccgacgacacggccggctgggacacccggatcaccgaggacgacctccagaacgaggccaagatcaccgacatcatggagcccgagcacgcgctgctggccaagagcatcttcaagctcacgtaccagaacaaggtggtccgcgtgcagcggccggccaagaacgggaccgtgatggacgtcatctcccgccgcgaccagcggggcagcggccaggtgggcacctacggcctgaacaccttcacgaacatggaggcccagctgatccgccagatggagtccgaggggatcttcagcccctccgagctcgagacccccaacctggccggccgggtgctggactggctcgagaagcacggggtcgagcgcctgaagcggatggcgatcagcggcgacgactgcgtggtgaagcccatcgacgaccgcttcgccaccgccctgaccgccctcaacgacatggggaaggtccggaaggacatcccgcagtgggagccctccaagggctggaacgactggcagcaggtccccttctgcagccaccacttccaccagctgatcatgaaggacggccgcgagatcgtggtcccctgccggaaccaggacgagctggtggggcgcgcccgggtgagccagggcgcggggtggtccctccgcgagacggcctgcctgggcaagagctacgcccagatgtggcagctgatgtacttccaccggcgcgacctccggctggccgcgaacgccatctgctccgccgtcccggtggactgggtgcccaccagccgcaccacctggtccatccacgcccaccaccagtggatgacgaccgaggacatgctgagcgtctggaaccgggtgtggatcgaggagaacccctggatggaggacaagacccacatctccagctggggcgacgtgccctacctcggcaagcgcgaggaccagtggtgcggctccctgatcgggctgaccgcccgggcgacgtgggccaccaacatccaggtcgccatcaaccaggtgcgccgcctcatcggcaacgagaactacctggactacatgaccagcatgaagcggttcaagaacgagtccgacccggagggggccctgtggtga

SEQ ID NO: 8422 - RNA, 9879 nt, synthetic construct
  misc_feature 1..9879: note = derived and/or modified CDS sequence (opt1) from DENV-1__FJ461331__SS-prME
  source 1..9879: mol_type = other RNA
agcgtgaccatgctgctcatgctgatgcccaccgccctggccttccacctcaccacccgcggcggggagccccacatgatcgtgagcaagcaggagcggggcaagagcctgctgttcaagacctccgccggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctgatccaccagatcttcggcaccgcctacggggtcctcttctccggcgtgagctggaccatgaagatcgggatcggcgtcctgctgacgtggctcggcctgaactcccgcagcacctccctgagcatgacctgcatcgccgtggggctcgtgaccctgtacctgggcgtcatggtgcaggccgactccgggtgcgtgatcaactggaagggccgggagctcaagtgcgggagcggcatcttcgtcacgaacgaggtgcacacctggaccgagcagtacaagttccaggcggacagcccgaagcgcctgtccgccgccatcggcaaggcctgggaggagggggtgtgcggcatccggagcgccacccgcctggagaacatcatgtggaagcagatctccaacgagctcaaccacatcctgctggagaacgacatgaagctcaccgtcgtggtgggggacgtcgcgggcatcctggggcagggcaagaagatgatccggccccagcccatggagtacaagtacagctggaagtcctggggcaaggccaagatcatcggggccgacgcccagaacacgaccttcatcatcgacggccccaacaccccggagtgccccgacgaccagcgcgcgtggaacatctgggaggtggaggactacgggttcggcatcttcaccacgaacatctggctgaagctccgggacagctacacccaggtgtgcgaccaccgcctgatgtccgccgccatcaaggacagcaaggccgtccacgccgacatgggctactggatcgagtccgagaagaacgagacctggaagctggcgcgggccagcttcatcgaggtgaagacctgcatctggcccaagtcccacacgctctggagcaacggggtgctggagtccgagatgatcatccccaagatctacggcgggccgatcagccagcacaactaccgccccggctacttcacccagaccgccgggccctggcacctgggcaagctcgagctggacttcgacctgtgcgagggcaccacggtcgtggtggacgagcactgcgggaaccggggcccgtccctccgcaccaccaccgtcacggggaagatcatccacgagtggtgctgccggagctgcaccctgccgcccctgcgcttccggggcgaggacgggtgctggtacggcatggagatccgccccgtgaaggagaaggaggagaacctcgtgaagtccatggtcagcgccggcagcggggaggtggactccttcagcctgggcctgctctgcatctccatcatgatcgaggaggtgatgcggagccgctggtcccggaagatgctgatgaccgggaccctggccgtcttcttcctcctgatcatgggccagctgacgtggaacgacctcatccgcctgtgcatcatggtgggggcgaacgccttcgaccgcatgggcatgggcaccacctacctggccctcatggccaccttcaagatgcggccgatgttcgccgtggggctgctgttccgccggctcacgagccgcgaggtcctgctgctcaccatcggcctgtccctggtggcgagcgtggagctccccaactccctggaggagctgggggacggcctcgccatgggcatcatgatcctgaagctgctcaccgacttccagagccaccagctgtgggccaccctgctctccctgacgttcatcaagaccaccttcagcctgcactacgcctggaagaccatggcgatggtcctctccatcgtgagcctgttccccctgtgcctctccacgaccagccagaagaccacctggctgcccgtcctgctcgggtccctgggctgcaagccgctgacgatgttcctcatcgccgagaacaagatctgggggcggaagtcctggcccctgaacgagggcatcatggccgtggggatcgtgtccatcctgctcagcagcctgctgaagaacgacgtccccctcgccggccccctgatcgccggcgggatgctgatcgcgtgctacgtgatctccggcagctccgccgacctcagcctggagaaggccgccgaggtgtcctgggaggaggaggccgagcacagcggggcgtcccacaacatcctggtcgaggtgcaggacgacggcaccatgaagatcaaggacgaggagcgcgacgacaccctcaccatcctgctgaaggccaccctcctggccgtgagcggggtctacccgctgtccatccccgccaccctcttcgtgtggtacttctggcagaagaagaagcagcggagcggcgtgctgtgggacacccccagcccgcccgtcgtggagcgcgccgtgctggacgacggcatctaccggatcatgcagcgcgggctgctcggccggagccaggtcggggtgggcgtgttccaggagaacgtcttccacaccatgtggcacgtgacccgcggggcggtgctgatgtaccagggcaagcggctggagccctcctgggccagcgtcaagaaggacctcatctcctacggcgggggctggcgcctgcgggggagctggaacacgggcgaggaggtccaggtgatcgccgtcgagcccgggaagaaccccaagaacgtgcagaccgcccccggcaccttcaagacccccgagggcgaggtgggggccatcgcgctggacttcaagcccggcacgtccgggagccccatcgtcaaccgcgagggcaagatcgtgggcctctacgggaacggcgtggtcaccacctccgggacctacgtgagcgccatcgcccaggccaaggcgagccaggagggcccgctgcccgagatcgaggacgaggtgttccggaagcgcaacctgacgatcatggacctccaccccgggtccggcaagacccggcgctacctgccggccatcgtccgggaggccatcaagcgcaagctgcgcaccctcatcctggcccccacccgggtggtggccagcgagatggcggaggccctgaagggcatgcccatccgctaccagacgaccgccgtcaagtccgagcacaccgggaaggagatcgtggacctcatgtgccacgccaccttcacgatgcggctgctgagccccgtgcgcgtcccgaactacaacatgatcatcatggacgaggcccacttcaccgacccctccagcatcgcggcccggggctacatctccacccgcgtggggatgggcgaggccgccgccatcttcatgaccgcgacgccgcccgggagcgtggaggccttcccgcagtccaacgccgtcatccaggacgaggagcgggacatccccgagcgcagctggaactccggccacgagtggatcaccgacttccccggcaagaccgtgtggttcgtgcccagcatcaagtccgggaacgacatcgccaactgcctccggaagaacggcaagcgcgtcatccagctgagccggaagaccttcgacacggagtaccagaagaccaagaacaacgactgggactacgtggtgaccaccgacatctccgagatgggggcgaacttccgcgccgaccgggtcatcgacccgcgccggtgcctgaagcccgtgatcctcaaggacggccccgagcgcgtgatcctggccgggcccatgccggtcacggtggccagcgccgcgcagcggcgcggccggatcggccgcaaccacaacaaggagggggaccagtacatctacatgggccagcccctgaacaacgacgaggaccacgcccactggaccgaggccaagatgctcctggacaacatcaacacccccgaggggatcatccccgccctgttcgagccggagcgcgagaagtccgccgcggtcgacggcgagtaccggctccgcggggaggcccggaagaccttcgtggagctgatgcgccggggcgacctgcccgtgtggctcagctacaaggtcgcctccgagggcttccagtacagcgaccgccggtggtgcttcgacggggagcgcaacaaccaggtgctggaggagaacatggacgtggagatctggacgaaggagggcgagcggaagaagctgcgcccccggtggctcgacgcccgcacctacagcgaccccctggccctgcgggagttcaaggagttcgcggccgggcgccggtccgtcagcggcgacctcatcctggagatcggcaagctgccgcagcacctcacccagcgcgcccagaacgccctggacaacctggtgatgctccacaactccgagcagggcgggcgggcgtaccgccacgccatggaggagctgcccgacaccatcgagacgctgatgctcctggccctgatcgccgtgctcaccgggggcgtcaccctgttcttcctgagcgggcggggcctcggcaagacctccatcgggctgctgtgcgtgatggccagctccgtgctcctgtggatggcgagcgtcgagccccactggatcgccgcctccatcatcctggagttcttcctcatggtgctgctgatccccgagccggaccgccagcggacgccccaggacaaccagctcgcctacgtggtcatcggcctgctgttcatgatcctcacggtggccgcgaacgagatggggctgctggagaccaccaagaaggacctcggcatcgggcacgtggccgtcgagaaccaccaccacgccgccatgctggacgtggacctgcaccccgccagcgcgtggaccctctacgccgtggccacgaccatcatcaccccgatgatgcgccacaccatcgagaacacgaccgccaacatctccctgaccgccatcgcgaaccaggccgccatcctgatgggcctcgacaagggctggcccatcagcaagatggacatcggggtccccctgctggccctcggctgctactcccaggtgaaccccctgaccctgacggcggccgtgctcatgctggtcgcccactacgccatcatcgggccgggcctgcaggccaaggcgacccgcgaggcccagaagcggaccgccgccgggatcatgaagaaccccaccgtggacggcatcgtggccatcgacctcgaccccgtcgtgtacgacgcgaagttcgagaagcagctgggccagatcatgctgctcatcctgtgcacgagccagatcctgctcatgcgcaccacctgggccctgtgcgagtccatcaccctggccacggggcccctcaccaccctgtgggagggcagcccggggaagttctggaacaccacgatcgccgtgtccatggccaacatcttccggggcagctacctggcgggcgccgggctcgccttctccctgatgaagtccctgggcgggggccgccgggggaccggcgcccagggcgagaccctcggggagaagtggaagcgccagctgaaccagctgagcaagtccgagttcaacacctacaagcggagcggcatcatggaggtcgaccgctccgaggcgaaggaggggctcaagcggggcgagacgaccaagcacgccgtgagccgcgggaccgccaagctgcggtggttcgtggagcgcaacctggtcaagcccgagggcaaggtgatcgacctgggctgcgggcggggcgggtggtcctactactgcgccggcctcaagaaggtgaccgaggtcaaggggtacacgaagggcggccccgggcacgaggagcccatcccgatggccacctacggctggaacctggtgaagctgcacagcgggaaggacgtgttcttcatcccgcccgagaagtgcgacaccctcctgtgcgacatcggcgagtccagccccaacccgaccatcgaggaggggcgcacgctgcgggtcctcaagatggtggagccctggctgcgcggcaaccagttctgcatcaagatcctgaacccctacatgccctccgtggtcgagaccctcgagcagatgcagcggaagcacggcgggatgctggtgcgcaacccgctgagccggaactccacccacgagatgtactgggtgagctgcggcaccgggaacatcgtctccgcggtgaacatgaccagccgcatgctcctgaaccgcttcacgatggcccaccggaagcccacctacgagcgcgacgtggacctgggcaccggcacccggcacgtcgccgtggagcccgaggtggccaacctcgacatcatcgggcagcgcatcgagaacatcaagcacgagcacaagtccacgtggcactacgacgaggacaacccctacaagacctgggcctaccacggcagctacgaggtcaagccgtccgggagcgcgtccagcatggtgaacggcgtcgtgaagctgctgaccaagccctgggacgtgatccccatggtcacccagatcgccatgacggacaccacccccttcgggcagcagcgggtgttcaaggagaaggtggacacccgcacgccgaaggccaagcggggcaccgcccagatcatggaggtcaccgcccgctggctctggggcttcctgagccggaacaagaagccccgcatctgcacccgggaggagttcacgcgcaaggtgcggtccaacgcggccatcggggccgtgttcgtcgacgagaaccagtggaacagcgccaaggaggcggtggaggacgagcgcttctgggacctggtgcaccgggagcgcgagctccacaagcagggcaagtgcgcgacctgcgtctacaacatgatggggaagcgggagaagaagctgggcgagttcgggaaggccaagggctcccgcgccatctggtacatgtggctgggcgcccggttcctcgagttcgaggcgctggggttcatgaacgaggaccactggttcagccgcgagaactccctgagcggcgtggagggggagggcctccacaagctggggtacatcctgcgggacatctccaagatccccggcggcaacatgtacgccgacgacaccgccgggtgggacacccgcatcacggaggacgacctccagaacgaggccaagatcaccgacatcatggagccggagcacgccctgctggcgaaggccatcttcaagctcacctaccagaacaaggtggtccgcgtgcagcggcccgccaagaacggcaccgtgatggacgtcatcagccgccgggaccagcgcgggtccggccaggtgggcacgtacgggctgaacaccttcaccaacatggaggcccagctgatccggcagatggagagcgagggcatcttctcccccagcgagctcgagacccccaacctggccgagcgcgcgctggactggctcgagaagtacggggtggagcggctgaagcgcatggccatctccggcgacgactgcgtcgtgaagccgatcgacgaccggttcgccacggccctgaccgccctcaacgacatggggaaggtgcgcaaggacatcccccagtgggagcccagcaagggctggaacgactggcagcaggtccccttctgctcccaccacttccaccagctgatcatgaaggacggccgggagatcgtggtgccgtgccgcaaccaggacgagctggtcgggcgggcgcgcgtgagccagggcgccgggtggtccctccgggagaccgcctgcctgggcaagagctacgcccagatgtggcagctgatgtacttccaccgccgggacctccgcctggcggccaacgccatctgcagcgccgtgcccgtcgactgggtgcccacctcccggacgacctggagcatccacgcccaccaccagtggatgaccaccgaggacatgctgtccgtgtggaaccgcgtctggatcgaggagaacccctggatggaggacaagacgcacatcagctcctgggaggacgtgccgtacctcgggaagcgcgaggaccagtggtgcggcagcctgatcggcctgaccgcgcgggccacctgggccaccaacatccaggtggccatcaaccaggtccgccggctcatcgggaacgagaactacctggactacatgacctccatgaagcgcttcaagaacgagagcgaccccgagggcgccctgtggtga

SEQ ID NO: 8423 - RNA, 9879 nt, synthetic construct
  misc_feature 1..9879: note = derived and/or modified CDS sequence (opt1) from DENV-1__FJ410256__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggggagttctgcgaggacaccatgacctacaagtgcccccggatcaccgaggccgagcccgacgacgtggactgctggtgcaacgccaccgacacgtgggtgacctacgggacctgcagccagaccggggagcaccggcgcgacaagcggtccgtggccctggcgccccacgtgggcctcgggctggagacgcgcaccgagacctggatgagctccgagggcgcctggaagcagatccagaaggtcgagacctgggccctgcggcaccccgggttcacggtgatcgccctcttcctggcgcacgccatcggcaccagcatcacccagaaggggatcatcttcatcctgctcatgctggtgaccccctccatggccatgcgctgcgtcggcatcggcagccgggacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcgcaagctgtgcatcgaggccaagatctccaacaccaccacggacagccggtgcccgacccagggcgaggccaccctcgtggaggagcaggacaccaacttcgtctgccgccggacgttcgtggaccgcggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacacgggcgaccagcaccaggtggggaacgagtccaccgagcacggcaccaccgccaccatcacgccccaggcgcccagcaccgagatccagctgaccgactacggggccctcaccctggactgcagcccccggacgggcctggacttcaacgagatggtcctcctgaccatgaaggagaagtcctggctggtgcacaagcagtggttcctcgacctgccgctgccctggaccagcggggcctccaccagccaggagacgtggaaccgcaaggacctcctggtgaccttcaagaccgcccacgccaagaagcaggaggtcgtggtgctgggctcccaggagggcgcgatgcacaccgccctcacgggggccaccgagatccagaccagcggcaccacgaccatcttcgccgggcacctgaagtgccggctgaagatggacaagctcaccctgaagggcatgtcctacgtcatgtgcaccgggagcttcaagctggagaaggaggtggccgagacgcagcacggcaccgtgctcgtccagatcaagtacgagggcaccgacgcgccctgcaagatccccttctccacccaggacgagaagggggtgacgcagaacggccgcctgatcaccgccaacccgatcgtgaccgacaaggagaagcccgtcaacatcgaggccgagccgcccttcggggagagctacatcgtgatcggcgccggcgagaaggcgctgaagctgtcctggttcaagaaggggagctccatcggcaagatgttcgaggccaccgcccgcggggcccgccggatggccatcctcggcgacacggcgtgggacttcgggagcatcggcggcgtgttcacctccgtcgggaagctggtgcaccagatcttcggcaccgcctacggggtgctgttcagcggcgtctcctggaccatgaagatcgggatcggcgtgctcctgacgtggctgggcctcaacagccgctccaccagcctgtccatgacctgcatcgccgtggggctggtcaccctctacctgggcgtgatggtgcaggccgacagcgggtgcgtcatcaactggaagggccgcgagctgaagtgcgggagcggcatcttcgtgacgaacgaggtgcacacctggaccgagcagtacaagttccaggccgactccccgaagcggctcagcgcggccatcggcaaggcctgggaggagggggtctgcggcatccgctccaccacccggctggagaacatcatgtggaagcagatcagcaacgagctgaaccacatcctcctggagaacgacatgaagttcacggtggtggtcggggacgtggccggcatcctggcccaggggaagaagatgatccgcccccagcccatggagtacaagtactcctggaagtcctggggcaaggcgaagatcatcggcgccgacgtgcagaacaccaccttcatcatcgacgggcccaacaccccggagtgccccgacgaccagcgggcctggaacatctgggaggtcgaggactacggcttcgggatcttcacgaccaacatctggctcaagctgcgcgactcctacacccaggtgtgcgaccaccggctgatgagcgccgcgatcaaggactccaaggccgtgcacgccgacatgggctactggatcgagagcgagaagaacgagacctggaagctcgcccgcgcctccttcatcgaggtcaagacgtgcatctggcccaagagccacaccctgtggtccaacggcgtgctggagagcgagatgatcatccccaagatctacgggggcccgatctcccagcacaactaccggcccgggtacttcacccagaccgcgggcccctggcacctcgggaagctggagctggacttcgacctctgcgagggcacgaccgtggtcgtggacgagcactgcggcaaccgcgggccgagcctgcggaccaccacggtgaccggcaagatcatccacgagtggtgctgccgctcctgcaccctgccgcccctgcggttcaagggggaggacggctgctggtacgggatggagatccgccccgtcaaggagaaggaggagaacctggtcaagagcatggtgagcgccggctccggcgaggtcgacagcttctccctggggctcctgtgcatcagcatcatgatcgaggaggtgatgcggtcccgctggagccggaagatgctgatgaccggcacgctcgccgtgttcttcctgctgatcatggggcagctcacctggaacgacctgatccgcctgtgcatcatggtcggcgccaacgcctccgaccggatggggatgggcaccacctacctcgcgctgatggccacgttcaagatgcgcccgatgttcgccgtgggcctcctgttccgccggctgaccagccgcgaggtgctgctcctgaccatcgggctgtccctcgtcgccagcgtggagctgcccaactccctggaggagctcggcgacgggctggccatgggcatcatgatcctgaagctcctgaccgacttccagagccaccagctgtgggcgacgctcctgtccctgaccttcatcaagaccaccttcagcctccactacgcctggaagacgatggccatggtcctgtccatcgtgagcctgttccccctctgcctgtccaccaccagccagaagaccacgtggctgcccgtgctcctgggctccctggggtgcaagccgctcaccatgttcctgatcgccgagaacaagatctggggccgcaagagctggcccctgaacgaggggatcatggcggtcggcatcgtgagcatcctcctgtccagcctgctcaagaacgacgtgcccctggccgggcccctgatcgccggcggcatgctcatcgcctgctacgtcatctccgggagctccgccgacctgagcctggagaaggcggccgaggtgtcctgggaggaggaggccgagcacagcggcgcctcccacaacatcctcgtggaggtccaggacgacgggaccatgaagatcaaggacgaggagcgcgacgacaccctgaccatcctgctcaaggccacgctgctggcggtgagcggcgtgtacccgctctccatccccgccaccctgttcgtctggtacttctggcagaagaagaagcagcggagcggggtgctgtgggacacccccagcccgcccgaggtggagcgcgccgtcctcgacgacggcatctaccggatcatgcagcgcggcctgctggggcggagccaggtgggcgtgggggtcttccaggagaacgtgttccacaccatgtggcacgtgacgcgcggcgccgtcctgatgtaccaggggaagcggctcgagccctcctgggccagcgtgaagaaggacctgatctcctacggcggcgggtggcgcctgcagggcagctggaacaccggggaggaggtgcaggtcatcgcggtggagcccggcaagaaccccaagaacgtgcagaccgcccccgggaccttcaagacgtccgagggcgaggtcggcgccatcgccctcgacttcaagcccgggaccagcggcagccccatcgtgaaccgggaggggaagatcgtgggcctgtacggcaacggggtcgtgaccacctccggcacgtacgtgagcgccatcgcgcaggccaaggcctcccaggaggggcccctgccggagatcgaggacgaggtcttccgcaagcggaacctcaccatcatggacctgcaccccggcagcgggaagacccgccggtacctgcccgccatcgtgcgcgaggcgatcaagcggaagctccgcaccctgatcctggccccgacgcgggtggtcgcctccgagatggccgaggccctcaagggcatgcccatccgctaccagaccaccgcggtcaagagcgagcacaccggcaaggagatcgtggacctgatgtgccacgccacgttcaccatgcgcctgctctcccccgtccgggtgcccaactacaacatgatcatcatggacgaggcccacttcaccgacccgagctccatcgccgcccgcgggtacatcagcacccgggtgggcatgggggaggcggccgccatcttcatgacggccacgccgcccggctccgtcgaggccttcccccagagcaacgcggtgatccaggacgaggagcgcgacatcccggagcggtcctggaacagcgggtacgagtggatcaccgacttccccggcaagaccgtgtggttcgtcccctccatcaagagcggcaacgacatcgccaactgcctgcgcaagaacgggaagcgggtgatccagctgtcccgcaagacgttcgacaccgagtaccagaagaccaagaacaacgactgggactacgtggtcaccacggacatcagcgagatgggcgccaacttccgggccgaccgcgtgatcgacccccggcgctgcctcaagccggtgatcctgaaggacgggcccgagcgggtcatcctggcgggccccatgcccgtgaccgtcgcctccgccgcccagcgccgggggcgcatcggccggaaccacaacaaggagggcgaccagtacatctacatggggcagccgctcaacaacgacgaggaccacgcccactggaccgaggcgaagatgctgctggacaacatcaacacccccgagggcatcatccccgccctcttcgagcccgagcgcgagaagtccgccgccatcgacggggagtaccggctgcgcggcgaggcccgcaagacgttcgtggagctgatgcggcgcggggacctcccggtgtggctgagctacaaggtcgcgtccgagggcttccagtacagcgaccggcgctggtgcttcgacggcgagcggaacaaccaggtgctggaggagaacatggacgtggagatctggaccaaggagggggagcgcaagaagctccggccccgctggctggacgcccggacctactccgaccccctggccctccgcgagttcaaggagttcgccgccggccggcgcagcgtctccggggacctgatcctggagatcggcaagctcccccagcacctgacccagcgggcgcagaacgccctggacaacctcgtgatgctgcacaacagcgagcagggcgggcgcgcctaccggcacgccatggaggagctgccggacacgatcgagaccctcatgctgctggcgctcatcgccgtgctgaccggcggggtcaccctgttcttcctctccggccgcgggctgggcaagaccagcatcggcctgctctgcgtggtggcctccagcgtcctgctgtggatggcctccgtggagccccactggatcgccgcgagcatcatcctcgagttcttcctgatggtgctgctcatccccgagcccgaccggcagcgcacgccgcaggacaaccagctggcctacgtcgtgatcgggctcctcttcatgatcctgaccgtggccgccaacgagatgggcctgctcgagaccaccaagaaggacctggggatcggccacgtcgccgcggagaaccaccaccacgccgccatgctggacgtggacctccaccccgcctccgcctggacgctgtacgcggtggccaccaccatcatcacccccatgatgcggcacacgatcgagaacaccaccgccaacatcagcctgaccgccatcgccaaccaggcggccatcctcatggggctggacaagggctggccgatctccaagatggacatcggcgtccccctgctcgccctggggtgctacagccaggtgaaccccctgacgctcaccgccgcggtgctgatgctggtcgcccactacgccatcatcggccccgggctccaggccaaggccacccgcgaggcgcagaagcggaccgccgccggcatcatgaagaacccgacggtggacgggatcgtggccatcgacctggaccccgtcgtgtacgacgccaagttcgagaagcagctgggccagatcatgctcctgatcctgtgcacctcccagatcctcctgatgcgcaccacctgggcgctgtgcgagagcatcacgctcgccaccggccccctgaccaccctgtgggaggggtcccccggcaagttctggaacacgaccatcgccgtgagcatggccaacatcttccgcgggagctacctcgccggcgcgggcctggccttctccctgatgaagtccctcgggggcgggcggcgcggcaccggggcccagggcgagaccctgggcgagaagtggaagcggcagctgaaccagctctccaagagcgagttcaacacgtacaagcgctccgggatcatggaggtcgaccggagcgaggccaaggagggcctgaagcgcggggagaccaccaagcacgcggtgtcccggggcaccgccaagctgcgctggttcgtggagcggaacctcgtcaagccggaggggaaggtgatcgacctgggctgcggccgcgggggctggagctactactgcgccgggctgaagaaggtgacggaggtcaagggctacaccaagggcgggcccggccacgaggagcccatccccatggccacctacgggtggaacctggtgaagctccactccggcaaggacgtgttcttcatcccgcccgagaagtgcgacaccctgctgtgcgacatcggggagagctcccccaaccccacgatcgaggagggccggaccctccgcgtcctgaagatggtggagccgtggctgcgggggaaccagttctgcatcaagatcctcaacccctacatgcccagcgtggtcgagaccctggagcagatgcagcgcaagcacggcggcatgctggtgcggaaccccctctcccgcaacagcacccacgagatgtactgggtgtcctgcgggaccggcaacatcgtcagcgccgtgaacatgacgtcccggatgctgctgaaccgcttcaccatggcgcaccggaagccgacctacgagcgcgacgtggacctcggggccggcacccgccacgtcgccgtggagcccgaggtggccaacctggacatcatcggccagcggatcgagaacatcaagcacgagcacaagagcacgtggcactacgacgaggacaacccctacaagacctgggcctaccacgggtcctacgaggtcaagcccagcggcagcgcgtccagcatggtgaacggggtcgtgaagctgctcaccaagccgtgggacgtgatccccatggtcacccagatcgccatgacggacaccacccccttcggccagcagcgcgtgttcaaggagaaggtggacacccggacgcccaaggccaagcgcgggaccgcccagatcatggaggtcaccgccaagtggctgtggggcttcctgtcccggaacaagaagccgcgcatctgcacccgggaggagttcacgcgcaaggtgcggagcaacgcggccatcggcgccgtgttcgtcgacgagaaccagtggaactccgccaaggaggcggtggaggacgagcgcttctgggacctcgtgcaccgggagcgcgagctgcacaagcaggggaagtgcgcgacctgcgtctacaacatgatgggcaagcgggagaagaagctgggggagttcggcaaggccaaggggagccgcgccatctggtacatgtggctcggcgcccggttcctggagttcgaggcgctgggcttcatgaacgaggaccactggttctcccgcgagaacagcctctccggggtggagggcgaggggctgcacaagctgggctacatcctccgggacatcagcaagatccccgggggcaacatgtacgccgacgacaccgccggctgggacacccgcatcacggaggacgacctgcagaacgaggccaagatcaccgacatcatggagcccgagcacgccctgctcgcgaagtccatcttcaagctgacctaccagaacaaggtggtccgggtgcagcgcccggccaagaacgggaccgtgatggacgtcatcagccggcgcgaccagcgcggctccggccaggtgggcacgtacggcctgaacaccttcaccaacatggaggcccagctcatccggcagatggagagcgaggggatcttctcccccagcgagctggagacccccaacctggccggccgcgtgctcgactggctggagaagcacggggccgagcggctgaagcgcatggcgatctccggcgacgactgcgtcgtgaagcccatcgacgaccggttcgccacggccctcaccgccctgaacgacatggggaaggtgcgcaaggacatcccgcagtgggagcccagcaagggctggaacgactggcagcaggtccccttctgcagccaccacttccaccagctgatcatgaaggacggccgggagatcgtggtgccctgccgcaaccaggacgagctcgtcgggcgggcccgcgtgtcccagggcgcggggtggagcctgcgggagaccgcctgcctgggcaagtcctacgcccagatgtggcagctcatgtacttccaccgccgggacctgcgcctggccgcgaacgccatctgcagcgccgtgccggtcgactgggtgcccacctcccggacgacctggagcatccacgcccaccaccagtggatgaccaccgaggacatgctctccgtgtggaaccgcgtctggatcgaggagaacccctggatggaggacaagacgcacatcagctcctggggcgacgtgccctacctgggcaagcgggaggaccagtggtgcggcagcctgatcgggctcaccgcccgcgcgacctgggccaccaacatccaggtggccatcaaccaggtccggcgcctgatcggcaacgagaactacctggactacatgacctccatgaagcgcttcaagaacgagagcgacccggagggggccctctggtga

SEQ ID NO: 8424 - RNA, 9879 nt, synthetic construct
  misc_feature 1..9879: note = derived and/or modified CDS sequence (opt1) from DENV-1__FJ410257__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacacgatgacctacaagtgcccccgcatcaccgaggccgagcccgacgacgtggactgctggtgcaacgccaccgacacctgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgccgctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcaccacgcaggacgagaagggggtgacccagaacggccggctgatcaccgccaacccgatcgtgaccgacaaggagaagcccgtcaacatcgaggccgagccgcccttcggggagagctacatcgtgatcggcgcgggcgagaaggccctgaagctctcctggttcaagaaggggagctccatcggcaagatgttcgaggccacggcccgcggggcccggcgcatggcgatcctgggcgacaccgcctgggacttcgggagcatcggcggcgtgttcacctccgtcgggaagctggtgcaccagatcttcggcaccgcctacggggtcctgttcagcggcgtctcctggacgatgaagatcgggatcggcgtgctgctgacctggctcggcctgaacagccgctccaccagcctgtccatgacctgcatcgccgtggggctcgtcacgctgtacctgggcgtgatggtgcaggccgacagcgggtgcgtcatcaactggaagggccgggagctcaagtgcgggtccggcatcttcgtgaccaacgaggtgcacacctggaccgagcagtacaagttccaggcggacagcccgaagcgcctgagcgccgccatcggcaaggcctgggaggagggggtctgcggcatccggtccgccacccgcctggagaacatcatgtggaagcagatcagcaacgagctcaaccacatcctgctggagaacgacatgaagctcacggtggtggtcggggacgtggcgggcatcctggggcagggcaagaagatgatccggccccagcccatggagtacaagtactcctggaagtcctggggcaaggccaagatcatcggggccgacgcccagaacaccaccttcatcatcgacggccccaacaccccggagtgccccgacgaccagcgcgcgtggaacatctgggaggtggaggactacgggttcggcatcttcacgaccaacatctggctgaagctccgggactcctacacccaggtctgcgaccaccgcctgatgagcgccgccatcaaggactccaaggccgtgcacgccgacatgggctactggatcgagagcgagaagaacgagacctggaagctggcgcgggcctccttcatcgaggtgaagacgtgcatctggcccaagagccacaccctctggtccaacggggtcctggagagcgagatgatcatccccaagatctacggcgggccgatctcccagcacaactaccgccccggctacttcacccagaccgccgggccctggcacctgggcaagctcgagctggacttcgacctgtgcgagggcacgaccgtggtggtcgacgagcactgcgggaaccggggcccgagcctccgcaccaccacggtgaccgggaagatcatccacgagtggtgctgccggtcctgcaccctgccgcccctgcgcttccggggcgaggacgggtgctggtacggcatggagatccgccccgtgaaggagaaggaggagaacctcgtcaagagcatggtgtccgccggcagcggggaggtggacagcttctccctgggcctgctctgcatcagcatcatgatcgaggaggtcatgcggtcccgctggagccggaagatgctgatgaccgggacgctggccgtgttcttcctcctgatcatgggccagctgacctggaacgacctcatccgcctgtgcatcatggtgggggcgaacgcctccgaccgcatgggcatgggcaccacctacctggccctcatggccacgttcaagatgcggccgatgttcgccgtcgggctgctgttccgccggctcaccagccgcgaggtgctgctgctcaccatcggcctgtccctggtggcgagcgtcgagctccccaactccctggaggagctgggggacggcctcgccatgggcatcatgatcctgaagctgctcaccgacttccagagccaccagctgtgggccacgctgctctccctgaccttcatcaagaccaccttcagcctgcactacgcctggaagacgatggcgatggtgctctccatcgtcagcctgttccccctgtgcctctccaccaccagccagaagaccacgtggctgcccgtgctgctcgggtccctgggctgcaagccgctgaccatgttcctcatcgccgagaacaagatctgggggcgcaagagctggcccctgaacgagggcatcatggccgtggggatcgtctccatcctgctcagcagcctgctgaagaacgacgtgcccctcgccggccccctgatcgccggcgggatgctgatcgcgtgctacgtgatctccggcagctccgccgacctcagcctggagaaggccgccgaggtctcctgggaggaggaggccgagcacagcggggcgtcccacaacatcctggtggaggtgcaggacgacggcaccatgaagatcaaggacgaggagcgcgacgacaccctcaccatcctgctgaaggccacgctcctggccgtcagcggggtgtacccgctgtccatccccgccaccctcttcgtgtggtacttctggcagaagaagaagcagcggagcggcgtcctgtgggacacccccagcccgcccgaggtggagcgcgccgtgctggacgacggcatctaccggatcatgcagcgcgggctgctcggccggagccaggtcggggtgggcgtgttccaggagaacgtcttccacaccatgtggcacgtgacgcgcggggcggtgctgatgtaccagggcaagcggctggagccctcctgggccagcgtcaagaaggacctcatctcctacggcgggggctggcgcctgcgggggagctggaacaccggcgaggaggtccaggtgatcgccgtcgagcccgggaagaaccccaagaacgtgcagaccgcccccggcaccttcaagacgcccgagggcgaggtgggggccatcgcgctggacttcaagcccggcacctccgggagccccatcgtcaaccgcgagggcaagatcgtgggcctctacgggaacggcgtggtcaccacctccgggacgtacgtgagcgccatcgcccaggccaaggcgagccaggagggcccgctgcccgagatcgaggacgaggtgttccggaagcgcaacctgaccatcatggacctccaccccgggtccggcaagacccggcgctacctgccggccatcgtccgggaggccatcaagcgcaagctgcgcaccctcatcctggcccccacgcgggtggtggccagcgagatggcggaggccctgaagggcatgcccatccgctaccagaccaccgccgtcaagtccgagcacaccgggaaggagatcgtggacctcatgtgccacgccacgttcaccatgcggctgctgagccccgtgcgcgtcccgaactacaacatgatcatcatggacgaggcccacttcaccgacccctccagcatcgcggcccggggctacatctccacccgcgtggggatgggcgaggccgccgccatcttcatgacggcgacgccgcccgggagcgtggaggccttcccgcagtccaacgccgtcatccaggacgaggagcgggacatccccgagcgcagctggaactccggctacgagtggatcaccgacttcagcggcaagaccgtgtggttcgtgccctccatcaagagcgggaacgacatcgccaactgcctccggaagaacggcaagcgcgtcatccagctgtcccggaagacgttcgacaccgagtaccagaagaccaagaacaacgactgggactacgtggtgaccacggacatcagcgagatgggggcgaacttccgcgccgaccgggtcatcgacccccgccggtgcctgaagccggtgatcctcaaggacggccccgagcgcgtgatcctggccgggcccatgcccgtcaccgtggcctccgccgcgcagcggcgcggccggatcggccgcaactacaacaaggagggggaccagtacatctacatgggccagccgctgaacaacgacgaggaccacgcccactggaccgaggccaagatgctcctggacaacatcaacacccccgaggggatcatccccgccctgttcgagcccgagcgcgagaagtccgccgcggtcgacggcgagtaccggctccgcggggaggcccggaagacgttcgtggagctgatgcgccggggcgacctgccggtgtggctctcctacaaggtcgccagcgagggcttccagtacagcgaccgccggtggtgcttcgacggggagcgcaacaaccaggtgctggaggagaacatggacgtggagatctggaccaaggagggcgaccggaagaagctgcgcccccggtggctcgacgcccgcacctactccgaccccctggccctgcgggagctcaaggagttcgcggccgggcgccggagcgtctccggcgacctgatcctggagatcggcaagctcccccagcacctgacccagcgcgcccagaacgccctggacaacctcgtgatgctgcacaacagcgagcagggcgggcgggcgtaccgccacgccatggaggagctgccggacacgatcgagaccctcatgctgctggccctcatcgccgtgctgaccgggggcgtcaccctgttcttcctctccgggcggggcctgggcaagaccagcatcgggctgctctgcgtgatggcctccagcgtgctgctgtggatggcgtccgtcgagccccactggatcgccgccagcatcatcctcgagttcttcctgatggtgctgctcatccccgagcccgaccgccagcggacgccgcaggacaaccagctggcctacgtggtcatcggcctcctcttcatgatcctgaccgtggccgcgaacgagatggggctgctcgagaccaccaagaaggacctgggcatcgggcacgtggccgtcgagaaccaccaccacgccgccatgctggacgtggacctccaccccgcctccgcgtggacgctgtacgccgtggccaccaccatcatcacccccatgatgcgccacacgatcgagaacaccaccgccaacatcagcctgaccgccatcgcgaaccaggccgccatcctcatgggcctggacaagggctggccgatctccaagatggacatcggggtccccctgctcgccctgggctgctacagccaggtgaaccccctgacgctcaccgcggccgtgctgatgctggtcgcccactacgccatcatcgggcccggcctccaggccaaggcgacccgcgaggcccagaagcggaccgccgccgggatcatgaagaacccgacggtggacggcatcgtggccatcgacctggaccccgtcgtgtacgacgcgaagttcgagaagcagctgggccagatcatgctcctgatcctgtgcacctcccagatcctcctgatgcgcaccacctgggccctgtgcgagagcatcacgctcgccaccgggcccctgaccaccctgtgggagggctcccccgggaagttctggaacacgaccatcgccgtgagcatggccaacatcttccggggctcctacctcgcgggcgccgggctggccttcagcctgatgaagtccctcggcgggggccgccgggggaccggcgcccagggcgagaccctgggggagaagtggaagcgccagctgaaccagctctccaagagcgagttcaacacgtacaagcggtccggcatcatggaggtcgaccgcagcgaggcgaaggaggggctgaagcggggcgagaccaccaagcacgccgtgtcccgcgggaccgccaagctgcggtggttcgtggagcgcaacctggtcaagccggagggcaaggtgatcgacctcggctgcgggcggggcgggtggagctactactgcgccggcctgaagaaggtgacggaggtcaaggggtacaccaagggcggccccgggcacgaggagcccatccccatggccacctacggctggaacctggtgaagctccactccgggaaggacgtgttcttcatcccgcccgagaagtgcgacaccctgctgtgcgacatcggcgagagctcccccaaccccacgatcgaggaggggcgcaccctccgggtcctgaagatggtggagccgtggctgcgcggcaaccagttctgcatcaagatcctcaacccctacatgcccagcgtggtcgagaccctggagcagatgcagcggaagcacggcgggatgctggtgcgcaaccccctctcccggaacagcacccacgagatgtactgggtgtcctgcggcaccgggaacatcgtcagcgcggtgaacatgacgtcccgcatgctgctgaaccgcttcaccatggcccaccggaagccgacctacgagcgcgacgtggacctcggcaccggcacgcggcacgtcgccgtggagcccgaggtggccaacctggacatcatcgggcagcgcatcgagaacatcaagcacgagcacaagagcacctggcactacgacgaggacaacccctacaagacctgggcctaccacggctcctacgaggtcaagcccagcgggtccgcgagcagcatggtgaacggcgtcgtgaagctgctcaccaagccgtgggacgtgatccccatggtcacgcagatcgccatgaccgacaccacccccttcgggcagcagcgggtgttcaaggagaaggtggacacgcgcacccccaaggccaagcggggcaccgcccagatcatggaggtcaccgcccgctggctgtggggcttcctgtcccggaacaagaagccgcgcatctgcacgcgggaggagttcacccgcaaggtgcggagcaacgcggccatcggggccgtgttcgtcgacgagaaccagtggaactccgccaaggaggcggtggaggacgagcgcttctgggacctcgtgcaccgggagcgcgagctgcacaagcagggcaagtgcgcgacctgcgtctacaacatgatggggaagcgggagaagaagctgggcgagttcgggaaggccaagggcagccgcgccatctggtacatgtggctcggcgcccggttcctggagttcgaggcgctggggttcatgaacgaggaccactggttctcccgcgagaacagcctctccggcgtggagggggagggcctgcacaagctggggtacatcctccgggacatcagcaagatccccggcggcaacatgtacgccgacgacaccgccgggtgggacacgcgcatcaccgaggacgacctgcagaacgaggccaagatcaccgacatcatggagcccgagcacgccctgctcgcgaaggccatcttcaagctgacctaccagaacaaggtggtccgcgtgcagcggccggccaagaacggcacggtgatggacgtcatctcccgccgggaccagcgcgggagcggccaggtgggcacctacgggctgaacaccttcaccaacatggaggcccagctcatccggcagatggagtccgagggcatcttcagcccctccgagctggagacgcccaacctggccgagcgcgcgctcgactggctggagaagtacggggtggagcggctgaagcgcatggccatcagcggcgacgactgcgtcgtgaagcccatcgacgaccggttcgccaccgccctcaccgccctgaacgacatggggaaggtgcgcaaggacatcccgcagtgggagccctccaagggctggaacgactggcagcaggtccccttctgcagccaccacttccaccagctgatcatgaaggacggccgggagatcgtggtgccctgccgcaaccaggacgagctcgtcgggcgggcgcgcgtgtcccagggcgccgggtggagcctgcgggagaccgcctgcctgggcaagagctacgcccagatgtggcagctcatgtacttccaccgccgggacctgcgcctggcggccaacgccatctgctccgccgtgccggtcgactgggtgcccacgagccggaccacctggtccatccacgcccaccaccagtggatgaccacggaggacatgctcagcgtgtggaaccgcgtctggatcgaggagaacccctggatggaggacaagacccacatctccagctgggaggacgtgccctacctggggaagcgcgaggaccagtggtgcggctccctgatcggcctcaccgcgcgggccacctgggccaccaacatccaggtggccatcaaccaggtccgccggctgatcgggaacgagaactacctggactacatgacgagcatgaagcgcttcaagaacgagtccgacccggagggcgccctctggtga

SEQ ID NO: 8425 - RNA, 9879 nt, synthetic construct
  misc_feature 1..9879: note = derived and/or modified CDS sequence (opt1) from DENV-1__FJ461332__SS-prME
  source 1..9879: mol_type = other RNA
agcgtgaccatgctgctcatgctgatgcccaccgccctggccttccacctcaccacccgcggcggggagccccacatgatcgtgagcaagcaggagcggggcaagagcctgctgttcaagacctccgcgggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtggagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctgatccaccagatcttcggcaccgcctacggggtcctcttctccggcgtgagctggaccatgaagatcgggatcggcgtcctgctgacgtggctcggcctgaactcccgcagcacctccctgagcatgacctgcatcgccgtggggctcgtgaccctgtacctgggcgtcatggtgcaggccgactccgggtgcgtgatcaactggaagggccgggagctcaagtgcgggagcggcatcttcgtcacgaacgaggtgcacacctggaccgagcagtacaagttccaggcggacagcccgaagcgcctgtccgccgccatcggcaaggcctgggaggagggggtgtgcggcatccggagcgccacccgcctggagaacatcatgtggaagcagatctccaacgagctcaaccacatcctgctggagaacgacatgaagctcaccgtcgtggtgggggacgtcgcgggcatcctggggcagggcaagaagatgatccggccccagcccatggagtacaagtacagctggaagtcctggggcaaggccaagatcatcggggccgacgcccagaacacgaccttcatcatcgacggccccaacaccccggagtgccccgacgaccagcgcgcgtggaacatctgggaggtggaggactacgggttcggcatcttcaccacgaacatctggctgaagctccgggacagctacacccaggtgtgcgaccaccgcctgatgtccgccgccatcaaggacagcaaggccgtccacgccgacatgggctactggatcgagtccgagaagaacgagacctggaagctggcgcgggccagcttcatcgaggtgaagacctgcatctggcccaagtcccacacgctctggagcaacggggtgctggagtccgagatgatcatccccaagatctacggcgggccgatcagccagcacaactaccgccccggctacttcacccagaccgccgggccctggcacctgggcaagctcgagctggacttcgacctgtgcgagggcaccacggtcgtggtggacgagcactgcgggaaccggggcccgtccctccgcaccaccaccgtcacggggaagatcatccacgagtggtgctgccggagctgcaccctgccgcccctgcgcttccggggcgaggacgggtgctggtacggcatggagatccgccccgtgaaggagaaggaggagaacctcgtgaagtccatggtcagcgccggcagcggggaggtggactccttcagcctgggcctgctctgcatctccatcatgatcgaggaggtgatgcggagccgctggtcccggaagatgctgatgaccgggaccctggccgtcttcttcctcctgatcatgggccagctgacgtggaacgacctcatccgcctgtgcatcatggtgggggcgaacgccttcgaccgcatgggcatgggcaccacctacctggccctcatggccaccttcaagatgcggccgatgttcgccgtggggctgctgttccgccggctcacgagccgcgaggtcctgctgctcaccatcggcctgtccctggtggcgagcgtggagctccccaactccctggaggagctgggggacggcctcgccatgggcatcatgatcctgaagctgctcaccgacttccagagccaccagctgtgggccaccctgctctccctgacgttcatcaagaccaccttcagcctgcactacgcctggaagaccatggcgatggtcctctccatcgtgagcctgttccccctgtgcctctccacgaccagccagaagaccacctggctgcccgtcctgctcgggtccctgggctgcaagccgctgacgatgttcctcatcgccgagaacaagatctgggggcggaagtcctggcccctgaacgagggcatcatggccgtggggatcgtgtccatcctgctcagcagcctgctgaagaacgacgtccccctcgccggccccctgatcgccggcgggatgctgatcgcgtgctacgtgatctccggcagctccgccgacctcagcctggagaaggccgccgaggtgtcctgggaggaggaggccgagcacagcggggcgtcccacaacatcctggtcgaggtgcaggacgacggcaccatgaagatcaaggacgaggagcgcgacgacaccctcaccatcctgctgaaggccaccctcctggccgtgagcggggtctacccgctgtccatccccgccaccctcttcgtgtggtacttctggcagaagaagaagcagcggagcggcgtgctgtgggacacccccagcccgcccgtcgtggagcgcgccgtgctggacgacggcatctaccggatcatgcagcgcgggctgctcggccggagccaggtcggggtgggcgtgttccaggagaacgtcttccacaccatgtggcacgtgacccgcggggcggtgctgatgtaccagggcaagcggctggagccctcctgggccagcgtcaagaaggacctcatctcctacggcgggggctggcgcctgcgggggagctggaacacgggcgaggaggtccaggtgatcgccgtcgagcccgggaagaaccccaagaacgtgcagaccgcccccggcaccttcaagacccccgagggcgaggtgggggccatcgcgctggacttcaagcccggcacgtccgggagccccatcgtcaaccgcgagggcaagatcgtgggcctctacgggaacggcgtggtcaccacctccgggacctacgtgagcgccatcgcccaggccaaggcgagccaggagggcccgctgcccgagatcgaggacgaggtgttccggaagcgcaacctgacgatcatggacctccaccccgggtccggcaagacccggcgctacctgccggccatcgtccgggaggccatcaagcgcaagctgcgcaccctcatcctggcccccacccgggtggtggccagcgagatggcggaggccctgaagggcatgcccatccgctaccagacgaccgccgtcaagtccgagcacaccgggaaggagatcgtggacctcatgtgccacgccaccttcacgatgcggctgctgagccccgtgcgcgtcccgaactacaacatgatcatcatggacgaggcccacttcaccgacccctccagcatcgcggcccggggctacatctccacccgcgtggggatgggcgaggccgccgccatcttcatgaccgcgacgccgcccgggagcgtggaggccttcccgcagtccaacgccgtcatccaggacgaggagcgggacatccccgagcgcagctggaactccggccacgagtggatcaccgacttccccggcaagaccgtgtggttcgtgcccagcatcaagtccgggaacgacatcgccaactgcctccggaagaacggcaagcgcgtcatccagctgagccggaagaccttcgacacggagtaccagaagaccaagaacaacgactgggactacgtggtgaccaccgacatctccgagatgggggcgaacttccgcgccgaccgggtcatcgacccgcgccggtgcctgaagcccgtgatcctcaaggacggccccgagcgcgtgatcctggccgggcccatgccggtcacggtggccagcgccgcgcagcggcgcggccggatcggccgcaaccacaacaaggagggggaccagtacatctacatgggccagcccctgaacaacgacgaggaccacgcccactggaccgaggccaagatgctcctggacaacatcaacacccccgaggggatcatccccgccctgttcgagccggagcgcgagaagtccgccgcggtcgacggcgagtaccggctccgcggggaggcccggaagaccttcgtggagctgatgcgccggggcgacctgcccgtgtggctcagctacaaggtcgcctccgagggcttccagtacagcgaccgccggtggtgcttcgacggggagcgcaacaaccaggtgctggaggagaacatggacgtggagatctggacgaaggagggcgagcggaagaagctgcgcccccggtggctcgacgcccgcacctacagcgaccccctggccctgcgggagttcaaggagttcgcggccgggcgccggtccgtcagcggcgacctcatcctggagatcggcaagctgccgcagcacctcacccagcgcgcccagaacgccctggacaacctggtgatgctccacaactccgagcagggcgggcgggcgtaccgccacgccatggaggagctgcccgacaccatcgagacgctgatgctcctggccctgatcgccgtgctcaccgggggcgtcaccctgttcttcctgagcgggcggggcctcggcaagacctccatcgggctgctgtgcgtgatggccagctccgtgctcctgtggatggcgagcgtcgagccccactggatcgccgcctccatcatcctggagttcttcctcatggtgctgctgatccccgagccggaccgccagcggacgccccaggacaaccagctcgcctacgtggtcatcggcctgctgttcatgatcctcacggtggccgcgaacgagatggggctgctggagaccaccaagaaggacctcggcatcgggcacgtggccgtcgagaaccaccaccacgccgccatgctggacgtggacctgcaccccgccagcgcgtggaccctctacgccgtggccacgaccatcatcaccccgatgatgcgccacaccatcgagaacacgaccgccaacatctccctgaccgccatcgcgaaccaggccgccatcctgatgggcctcgacaagggctggcccatcagcaagatggacatcggggtccccctgctggccctcggctgctactcccaggtgaaccccctgaccctgacggcggccgtgctcatgctggtcgcccactacgccatcatcgggccgggcctgcaggccaaggcgacccgcgaggcccagaagcggaccgccgccgggatcatgaagaaccccaccgtggacggcatcgtggccatcgacctcgaccccgtcgtgtacgacgtgaagttcgagaagcagctgggccagatcatgctgctcatcctgtgcacgagccagatcctgctcatgcgcaccacctgggcgctgtgcgagtccatcaccctggccacggggcccctcaccaccctgtgggagggcagcccggggaagttctggaacaccacgatcgccgtctccatggccaacatcttccggggcagctacctggccggcgcggggctcgccttctccctgatgaagtccctgggcgggggccgccgggggaccggcgcccagggcgagaccctcggggagaagtggaagcgccagctgaaccagctgagcaagtccgagttcaacacctacaagcggagcggcatcatggaggtggaccgctccgaggccaaggaggggctcaagcggggcgagacgaccaagcacgcggtgagccgcgggaccgccaagctgcggtggttcgtcgagcgcaacctggtgaagcccgagggcaaggtgatcgacctgggctgcgggcggggcgggtggtcctactactgcgccggcctcaagaaggtcaccgaggtgaaggggtacacgaagggcggccccgggcacgaggagcccatcccgatggccacctacggctggaacctggtgaagctgcacagcgggaaggacgtcttcttcatcccgcccgagaagtgcgacaccctcctgtgcgacatcggcgagtccagccccaacccgaccatcgaggaggggcgcacgctgcgggtgctcaagatggtggagccctggctgcgcggcaaccagttctgcatcaagatcctgaacccctacatgccctccgtcgtggagaccctcgagcagatgcagcggaagcacggcgggatgctggtgcgcaacccgctgagccggaactccacccacgagatgtactgggtcagctgcggcaccgggaacatcgtgtccgccgtgaacatgaccagccgcatgctcctgaaccgcttcacgatggcgcaccggaagcccacctacgagcgcgacgtcgacctgggcaccggcacccggcacgtggccgtggagcccgaggtcgccaacctcgacatcatcgggcagcgcatcgagaacatcaagcacgagcacaagtccacgtggcactacgacgaggacaacccctacaagacctgggcctaccacggcagctacgaggtgaagccgtccgggagcgcctccagcatggtcaacggcgtggtgaagctgctgaccaagccctgggacgtcatccccatggtgacccagatcgcgatgacggacaccacccccttcgggcagcagcgggtgttcaaggagaaggtcgacacccgcacgccgaaggccaagcggggcaccgcccagatcatggaggtgaccgcccgctggctctggggcttcctgagccggaacaagaagccccgcatctgcacccgggaggagttcacgcgcaaggtgcggtccaacgccgcgatcggggccgtcttcgtggacgagaaccagtggaacagcgccaaggaggccgtggaggacgagcgcttctgggacctggtccaccgggagcgcgagctccacaagcagggcaagtgcgcgacctgcgtgtacaacatgatggggaagcgggagaagaagctgggcgagttcgggaaggccaagggctcccgcgccatctggtacatgtggctgggcgcccggttcctcgagttcgaggccctggggttcatgaacgaggaccactggttcagccgcgagaactccctgagcggcgtggagggggagggcctccacaagctggggtacatcctgcgggacatctccaagatccccggcggcaacatgtacgcggacgacaccgccgggtgggacacccgcatcacggaggacgacctccagaacgaggccaagatcaccgacatcatggagccggagcacgccctgctggccaaggcgatcttcaagctcacctaccagaacaaggtcgtgcgcgtgcagcggcccgccaagaacggcaccgtcatggacgtgatcagccgccgggaccagcgcgggtccggccaggtgggcacgtacgggctgaacaccttcaccaacatggaggcccagctgatccggcagatggagagcgagggcatcttctcccccagcgagctcgagacccccaacctggccgagcgcgccctggactggctcgagaagtacggggtcgagcggctgaagcgcatggcgatctccggcgacgactgcgtggtgaagccgatcgacgaccggttcgccacggccctgaccgccctcaacgacatggggaaggtccgcaaggacatcccccagtgggagcccagcaagggctggaacgactggcagcaggtccccttctgctcccaccacttccaccagctgatcatgaaggacggccgggagatcgtggtcccgtgccgcaaccaggacgagctggtggggcgggcccgcgtgagccagggcgcggggtggtccctccgggagaccgcctgcctgggcaagagctacgcccagatgtggcagctgatgtacttccaccgccgggacctccgcctggccgcgaacgccatctgcagcgccgtccccgtggactgggtgcccacctcccggacgacctggagcatccacgcccaccaccagtggatgaccaccgaggacatgctgtccgtctggaaccgcgtgtggatcgaggagaacccctggatggaggacaagacgcacatcagctcctgggaggacgtgccgtacctcgggaagcgcgaggaccagtggtgcggcagcctgatcggcctgaccgcccgggcgacctgggccaccaacatccaggtcgccatcaaccaggtgcgccggctcatcgggaacgagaactacctggactacatgacctccatgaagcgcttcaagaacgagagcgaccccgagggcgccctgtggtga

SEQ ID NO: 8426 - RNA, 9879 nt, synthetic construct
  misc_feature 1..9879: note = derived and/or modified CDS sequence (opt1) from DENV-1__FJ461333__SS-prME
  source 1..9879: mol_type = other RNA
agcgtgaccatgctgctcatgctgatgcccaccgccctggccttccacctcaccacccggggcggggagccccacatggtggtgagcaagcaggagcggggcaagagcctgctgttcaagaccagcgcgggggtgaacatgtgcaccctcatcgccatggacctgggcgagctgtgcgaggacaccatgacctacaagtgcccccggatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtggagacctgggccctccgccaccccgggttcacggtgatcgccctgttcctggcgcacgccatcggcaccagcatcacccagaaggggatcatcttcatcctcctgatgctggtcaccccctccatggccatgcggtgcgtgggcatcggcagccgcgacttcgtggaggggctctccggcgccacgtgggtcgacgtggtgctggagcacgggagctgcgtcaccaccatggccaaggacaagcccaccctggacatcgagctcctgaagacggaggtgaccaaccccgcgatcctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtcctgttctccggcgtcagctggaccatgaagatcgggctgggcgtgctgctcacgtggctgggcctgaactcccgcagcacctccctcagcatgacctgcatcgccgtggggctggtcaccctgtacctcggcgtgatggtgcaggccgactccgggtgcgtcatcaactggaagggccgggagctgaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctcgagaacgtgatgtggaagcagatctccaacgagctgaaccacatcctgctcgagaacgacatgaagttcaccgtggtcgtgggggacgtggcgggcatcctggcccaggggaagaagatgatccggccccagcccatggagcacaagtacagctggaagtcctggggcaaggccaagatcatcggcgccgacgtccagaacacgaccttcatcatcgacgggcccaacaccccggagtgccccgacgaccagcgcgcgtggaacatctgggaggtggaggactacggcttcgggatcttcaccacgaacatctggctgaagctccgggacagctacacccaggtgtgcgaccaccgcctgatgtccgccgccatcaaggacagcaaggccgtccacgccgacatgggctactggatcgagtccgagaagaacgagacctggaagctggcgcgggccagcttcatcgaggtgaagacctgcatctggcccaagtcccacacgctctggagcaacggcgtgctggagtccgagatgatcatccccaagatctacgggggcccgatcagccagcacaactaccgccccgggtacttcacccagaccgccggcccctggcacctggggaagctcgagctggacttcgacctgtgcgagggcaccacggtcgtggtggacgagcactgcggcaaccgggggccgtccctccgcaccaccaccgtcacgggcaagatcatccacgagtggtgctgccggagctgcaccctgccgcccctgcgcttccgcggggaggacggctgctggtacgggatggagatccgccccgtgaaggagaaggaggagaacctcgtgaagtccatggtcagcgccggcagcggcgaggtggactccttcagcctggggctgctctgcatctccatcatgatcgaggaggtgatgcggagccgctggtcccggaagatgctgatgaccggcaccctggccgtcttcctcctgctgatcatggggcagctcacgtggaacgacctgatccgcctgtgcatcatggtgggcgcgaacgccagcgaccgcatggggatgggcaccacctacctcgccctgatggccaccttcaagatgcggccgatgttcgccgtggggctcctgttccgccggctgacgtcccgcgaggtcctgctcctgaccatcgggctgagcctcgtggcgtccgtcgagctgcccaacagcctggaggagctcggcgacgggctggccatgggcatcatgatcctgaagctcctgaccgacttccagtcccaccagctgtgggccaccctcctgagcctgacgttcatcaagaccaccttctccctccactacgcctggaagaccatggcgatggtgctgagcatcgtgtccctgttccccctctgcctgagcacgacctcccagaagaccacctggctgcccgtcctcctgggcagcctggggtgcaagccgctcacgatgttcctgatcgccgagaacaagatctggggccggcgctcctggcccctgaacgaggggatcatggccgtgggcatcgtgagcatcctcctgagctccctgctcaagaacgacgtccccctggccgggcccctgatcgccggcggcatgctcatcgcgtgctacgtgatcagcgggtccagcgccgacctgtccctggagaaggccgccgaggtgagctgggaggaggaggccgagcactccggcgcgagccacaacatcctcgtcgaggtgcaggacgacgggaccatgaagatcaaggacgaggagcgggacgacaccctgaccatcctgctcaaggccaccctgctggccgtgtccggcgtctacccgctcagcatccccgccacgctgttcgtgtggtacttctggcagaagaagaagcagcgctccggggtgctgtgggacacccccagcccgcccgaggtcgagcgggccgtgctggacgacggcatctaccgcatcatgcagcggggcctcctggggcgctcccaggtgggcgtcggggtgttccaggagaacgtgttccacaccatgtggcacgtcacccggggcgcggtgctgatgtaccaggggaagcgcctcgagcccagctgggcctccgtgaagaaggacctgatcagctacggcggcgggtggcggctgcagggctcctggaacacgggggaggaggtccaggtgatcgccgtggagcccggcaagaaccccaagaacgtccagaccgcccccgggaccttcaagacccccgagggcgaggtgggcgccatcgcgctcgacttcaagcccgggacgagcggctcccccatcgtgaaccgcgaggggaagatcgtcggcctgtacggcaacggggtggtgaccaccagcggcacctacgtcagcgccatcgcccaggccaaggcgtcccaggaggggccgctgcccgagatcgaggacgaggtgttccggaagcgcaacctcacgatcatggacctgcaccccggcagcgggaagacccggcgctacctgccggccatcgtgcgggaggccatcaagcgcaagctccgcaccctgatcctggcccccacccgggtcgtggcctccgagatggcggaggccctcaagggcatgcccatccgctaccagacgaccgccgtcaagagcgagcacaccggcaaggagatcgtcgacctgatgtgccacgccaccttcacgatgcggctgctctcccccgtgcgcgtgccgaactacaacatgatcatcatggacgaggcccacttcaccgaccccagctccatcgcggcccgggggtacatcagcacccgcgtcggcatgggggaggccgccgccatcttcatgaccgcgacgccgcccggctccgtggaggccttcccgcagagcaacgccgtgatccaggacgaggagcgggacatccccgagcgctcctggaacagcgggtacgagtggatcaccgacttccccggcaagaccgtctggttcgtgccctccatcaagagcggcaacgacatcgccaactgcctgcggaagaacgggaagcgcgtgatccagctgtcccggaagaccttcgacacggagtaccagaagaccaagaacaacgactgggactacgtcgtgaccaccgacatcagcgagatgggcgcgaacttccgcgccgaccgggtgatcgacccgcgccggtgcctcaagcccgtcatcctgaaggacgggcccgagcgcgtgatcctggccggccccatgccggtcacggtggcctccgccgcgcagcggcgcgggcggatcggccgcaaccacaacaaggagggcgaccagtacatctacatggggcagcccctcaacaacgacgaggaccacgcccactggaccgaggccaagatgctgctggacaacatcaacacccccgagggcatcatccccgccctcttcgagccggagcgcgagaagtccgccgcgatcgacggggagtaccggctgcgcggcgaggcccggaagaccttcgtggagctgatgcgccgcggggacctccccgtctggctgtcctacaaggtggccagcgagggcttccagtacagcgaccgccggtggtgcttcgacggcgagcgcaacaaccaggtgctggaggagaacatggacgtcgagatctggacgaaggagggggagcggaagaagctccgcccccggtggctggacgcccgcacctactccgaccccctggccctccgggagttcaaggagttcgcggccggccgccggagcgtgtccggggacctgatcctggagatcggcaagctcccgcagcacctgacccagcgcgcccagaacgccctggacaacctcgtgatgctgcacaacagcgagcagggcgggcgggcgtaccgccacgccatggaggagctgcccgacaccatcgagacgctcatgctgctggccctcatcgccgtcctgaccggcggggtgaccctgttcttcctctccggccgggggctgggcaagaccagcatcggcctgctctgcgtgatggcctccagcgtcctgctgtggatggcgtccgtggagccccactggatcgccgccagcatcatcctcgagttcttcctgatggtgctgctcatccccgagccggaccgccagcggacgccccaggacaaccagctggcctacgtcgtgatcgggctcctcttcatgatcctgacggtggccgcgaacgagatgggcctgctcgagaccaccaagaaggacctggggatcggccacgccgccgtcgggaaccaccaccacgccgccatgctggacgtggacctccaccccgcgtccgcctggaccctgtacgccgtggccacgaccatcatcaccccgatgatgcgccacaccatcgagaacacgaccgccaacatcagcctgaccgcgatcgccaaccaggccgccatcctcatgggcctggacaagggctggcccatctccaagatggacatcggggtccccctgctcgcgctgggctgctacagccaggtgaaccccctgaccctcacggccgccgtgctgatgctggtcgcccactacgccatcatcgggccgggcctccaggcgaaggccacccgcgaggcccagaagcggaccgccgccgggatcatgaagaaccccaccgtggacggcatcgtggcgatcgacctggaccccgtcgtgtacgacgccaagttcgagaagcagctgggccagatcatgctcctgatcctgtgcacgtcccagatcctcctgatgcgcaccacctgggccctgtgcgagagcatcaccctcgccacggggcccctgaccaccctgtgggagggctccccggggaagttctggaacaccacgatcgccgtgagcatggcgaacatcttccggggctcctacctcgccggcgccgggctggccttcagcctgatgaagtccctcggcgggggccgccgggggaccggcgcgcagggcgagaccctgggggagaagtggaagcgccagctgaaccagctctccaagagcgagttcaacacctacaagcggtccggcatcatggaggtcgaccgcagcgaggccaaggaggggctgaagcggggcgagacgaccaagcacgccgtgtcccgcgggaccgccaagctgcggtggttcgtggagcgcaacctggtcaagcccgagggcaaggtgatcgacctcggctgcgggcggggcgggtggagctactactgcgccggcctgaagaaggtgaccgaggtcaaggggtacacgaagggcggccccgggcacgaggagcccatcccgatggcgacctacggctggaacctggtgaagctccactccgggaaggacgtgttcttcatcccgcccgagaagtgcgacaccctgctgtgcgacatcggcgagagctcccccaacccgaccatcgaggaggggcgcacgctccgggtcctgaagatggtggagccctggctgcgcggcaaccagttctgcatcaagatcctcaacccctacatgcccagcgtggtcgagaccctggagcagatgcagcggaagcacggcgggatgctggtgcgcaacccgctctcccggaacagcacccacgagatgtactgggtgtcctgcggcaccgggaacatcgtcagcgccgtgaacatgacctcccgcatgctgctgaaccgcttcacgatggcccaccggaagcccacctacgagcgcgacgtggacctcggcgccggcacccggcacgtcgccgtggagcccgaggtggcgaacctggacatcatcgggcagcgcatcgagaacatcaagcacgagcacaagagcacctggcactacgacgaggacaacccctacaagacgtgggcctaccacggctcctacgaggtcaagccgagcgggtccgccagcagcatggtgaacggcgtcgtgaagctgctcaccaagccctgggacgtgatccccatggtcacccagatcgccatgaccgacacgacccccttcgggcagcagcgggtgttcaaggagaaggtggacacccgcaccccgaaggccaagcggggcacggcgcagatcatggaggtcaccgccaagtggctgtggggcttcctgtcccgcaacaagaagccccggatctgcacccgcgaggagttcacccggaaggtgcgcagcaacgccgccatcggggcggtgttcgtcgacgagaaccagtggaactccgccaaggaggccgtggaggacgagcggttctgggacctcgtgcaccgcgagcgggagctgcacaagcagggcaagtgcgccacgtgcgtctacaacatgatggggaagcgcgagaagaagctgggcgagttcgggaaggccaagggcagccgggcgatctggtacatgtggctcggcgcccgcttcctggagttcgaggccctggggttcatgaacgaggaccactggttctcccgggagaacagcctctccggcgtggagggggagggcctgcacaagctggggtacatcctccgcgacatcagcaagatccccggcggcaacatgtacgccgacgacaccgccgggtgggacacccggatcaccgaggacgacctgcagaacgaggcgcgcatcacggacatcatggagccggagcacgccctgctcgccaagtccatcttcaagctgacctaccagaacaaggtggtccgcgtgcagcggcccgccaagaacggcaccgtgatggacgtcatcagccgccgggaccagcgcgggtccggccaggtgggcacctacgggctgaacacgttcaccaacatggaggcccagctcatccggcagatggagagcgagggcatcttctcccccagcgagctggagacccccaacctggcggagcgcgtgctcgactggctggagaagtacggggtcgagcggctgaagcgcatggccatctccggcgacgactgcgtggtgaagccgatcgacgaccggttcgccaccgccctcacggccctgaacgacatggggaaggtccgcaaggacatcccccagtgggagcccagcaagggctggaacgactggcagcaggtccccttctgctcccaccacttccaccagctgatcatgaaggacggccgggagatcgtggtcccgtgccgcaaccaggacgagctcgtggggcgggcgcgcgtgagccagggcgccgggtggagcctgcgggagaccgcctgcctgggcaagtcctacgcccagatgtggcagctcatgtacttccaccgccgggacctgcgcctggcggccaacgccatctgcagcgccgtccccgtggactggatccccacctcccggaccacgtggagcatccacgcccaccaccagtggatgaccaccgaggacatgctctccgtgtggaaccgcgtctggatcgaggagaacccctggatggaggacaagacccacatcagctcctggggcgacgtgccgtacctgggcaagcgcgaggaccagtggtgcggcagcctgatcgggctcacggcgcgggccacctgggccaccaacgtgcaggtcgccatcaaccaggtgcgccggctgatcggcaacgagaactacctggactacatgacctccatgaagcgcttcaagaacgagagcgaccccgagggggccctctggtga

SEQ ID NO: 8427 - RNA, 9879 nt, synthetic construct
  misc_feature 1..9879: note = derived and/or modified CDS sequence (opt1) from DENV-1__FJ410262__SS-prME
  source 1..9879: mol_type = other RNA
agcgtgaccatgctgctcatgctgatgcccaccgccctggccttccacctcacgacccgcggcggggagccccacatgatcgtgagcaagcaggagcggggcaagagcctgctgttcaagaccagcgcgggggtgaacatgtgcaccctcatcgccatggacctgggcgagttctgcgaggacacgatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagaccgtccagtacgagaacctgaagtacagcgtgatcgtgaccgtccacacgggcgaccagcaccaggtggggaacgagtccaccgagcacggcaccaccgcgaccatcacgccccaggcccccagcaccgagatccagctgaccgactacggggccctcaccctggactgcagcccccggacgggcctggacttcaacgagatggtcctcctgaccatgaaggagaagtcctggctggtgcacaagcagtggttcctcgacctgccgctgccctggaccagcggggcctccaccagccaggagacgtggaaccggaaggacctcctggtgaccttcaagaccgcccacgcgaagaagcaggaggtcgtggtgctgggctcccaggagggcgccatgcacaccgccctcacgggggccaccgagatccagaccagcggcaccacgaccatcttcgccgggcacctgaagtgccgcctgaagatggacaagctcaccctgaagggcatgtcctacgtcatgtgcaccgggagcttcaagctggagaaggaggtggcggagacgcagcacggcaccgtgctcgtccagatcaagtacgagggcaccgacgccccctgcaagatccccttctccacccaggacgagaagggggtgacgcagaacggccggctgatcaccgccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacacggcctgggacttcgggagcatcggcggcgtgttcacctccgtcgggaagctggtgcaccagatcttcggcaccgcctacggggtgctgttcagcggcgtctcctggaccatgaagatcgggatcggcgtgctcctgacgtggctgggcctcaacagccgctccaccagcctgtccatgacctgcatcgccgtggggctggtcaccctctacctgggcgtgatggtgcaggccgacagcgggtgcgtcatcaactggaagggccgggagctgaagtgcgggagcggcatcttcgtgacgaacgaggtgcacacctggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagttcaccgtggtggtcggggacgtggcgggcatcctggcccaggggaagaagatgatccggccccagcccatggagtacaagtactcctggaagtcctggggcaaggccaagatcatcggcgccgacgtgcagaacacgaccttcatcatcgacgggcccaacaccccggagtgccccgacgaccagcgcgcgtggaacatctgggaggtcgaggactacggcttcgggatcttcaccacgaacatctggctcaagctgcgggactcctacacccaggtgtgcgaccaccgcctgatgagcgccgccatcaaggactccaaggccgtgcacgccgacatgggctactggatcgagagcgagaagaacgagacctggaagctcgcgcgggcctccttcatcgaggtcaagacctgcatctggcccaagagccacacgctgtggtccaacggcgtgctggagagcgagatgatcatccccaagatctacgggggcccgatctcccagcacaactaccgccccgggtacttcacccagaccgccggcccctggcacctcgggaagctggagctggacttcggcctctgcgagggcaccacggtggtcgtggacgagcactgcgggaaccggggcccgagcctgcgcaccaccaccgtgacggggaagatcatccacgagtggtgctgccggtcctgcaccctgccgcccctgcgcttcaagggcgaggacgggtgctggtacggcatggagatccggcccgtcaaggagaaggaggagaacctggtcaagagcatggtgagcgccggctccggggaggtcgacagcttctccctgggcctcctgtgcatcagcatcatgatcgaggaggtgatgcgctcccggtggagccgcaagatgctgatgaccgggaccctcgccgtgttcttcctgctgatcatgggccagctcacgtggaacgacctgatccggctgtgcatcatggtcggggcgaacgcctccgaccgcatgggcatgggcaccacctacctcgccctgatggccaccttcaagatgcgcccgatgttcgccgtggggctcctgttccggcgcctgacgagccgggaggtgctgctcctgaccatcggcctgtccctcgtcgcgagcgtggagctgcccaactccctggaggagctcggggacggcctggccatgggcatcatgatcctgaagctcctgaccgacttccagagccaccagctgtgggccaccctcctgtccctgacgttcatcaagaccaccttcagcctccactacgcctggaagaccatggcgatggtcctgtccatcgtgagcctgttccccctctgcctgtccacgaccagccagaagaccacctggctgcccgtgctcctggggtccctgggctgcaagccgctcacgatgttcctgatcgccgagaacaagatctgggggcgcaagagctggcccctgaacgagggcatcatggccgtcgggatcgtgagcatcctcctgtccagcctgctcaagaacgacgtgcccctggccggccccctgatcgccggcgggatgctcatcgcgtgctacgtcatctccggcagctccgccgacctgagcctggagaaggccgccgaggtgtcctgggaggaggaggccgagcacagcggggcgtcccacaacatcctcgtggaggtccaggacgacggcaccatgaagatcaaggacgaggagcgggacgacaccctgaccatcctgctcaaggccaccctgctggccgtgagcggggtgtacccgctctccatccccgccacgctgttcgtctggtacttctggcagaagaagaagcagcgcagcggcgtgctgtgggacacccccagcccgcccgaggtggagcgggccgtcctcgacgacggcatctaccgcatcatgcagcgggggctgctgggccgcagccaggtgggggtgggcgtcttccaggagaacgtgttccacaccatgtggcacgtgacccgcggggcggtcctgatgtaccagggcaagcgcctcgagccctcctgggccagcgtgaagaaggacctgatctcctacggcgggggctggcggctgcaggggagctggaacacgggcgaggaggtgcaggtcatcgccgtggagcccgggaagaaccccaagaacgtgcagaccgcccccggcaccttcaagacctccgagggcgaggtcggggccatcgcgctcgacttcaagcccggcacgagcgggagccccatcgtgaaccgcgagggcaagatcgtgggcctgtacgggaacggcgtcgtgaccacctccgggacctacgtgagcgccatcgcccaggccaaggcgtcccaggagggccccctgccggagatcgaggacgaggtcttccggaagcgcaacctcacgatcatggacctgcaccccgggagcggcaagacccggcgctacctgcccgccatcgtgcgggaggccatcaagcgcaagctccggaccctgatcctggccccgacccgcgtggtcgcctccgagatggcggaggccctcaagggcatgcccatccgctaccagacgaccgccgtcaagagcgagcacaccgggaaggagatcgtggacctgatgtgccacgccaccttcacgatgcggctgctctcccccgtccgcgtgcccaactacaacatgatcatcatggacgaggcccacttcaccgacccgagctccatcgcggcccggggctacatcagcacccgcgtggggatgggcgaggccgccgccatcttcatgaccgcgacgccgcccgggtccgtcgaggccttcccccagagcaacgccgtgatccaggacgaggagcgggacatcccggagcgctcctggaacagcggctacgagtggatcaccgacttccccggcaagaccgtgtggttcgtcccctccatcaagagcgggaacgacatcgccaactgcctgcggaagaacggcaagcgcgtgatccagctgtcccggaagaccttcgacacggagtaccagaagaccaagaacaacgactgggactacgtggtcaccaccgacatcagcgagatgggggcgaacttccgcgccgaccgggtgatcgacccccgccggtgcctcaagccggtgatcctgaaggacggccccgagcgcgtcatcctggccgggcccatgcccgtgacggtcgcctccgccgcgcagcggcgcggccggatcggccgcaaccacaacaaggagggggaccagtacatctacatgggccagccgctcaacaacgacgaggaccacgcccactggaccgaggccaagatgctgctggacaacatcaacacccccgaggggatcatccccgccctcttcgagcccgagcgggagaagtccgccgcgatcgacggcgagtaccgcctgcgcggggaggcccggaagaccttcgtggagctgatgcgccggggcgacctcccggtgtggctgagctacaaggtcgcctccgagggcttccagtacagcgaccgccggtggtgcttcgacggggagcgcaacaaccaggtgctggaggagaacatggacgtggagatctggacgaaggagggcgagcggaagaagctccgcccccggtggctggacgcccgcacctactccgaccccctggccctccgggagttcaaggagttcgcggccgggcgccggagcgtctccggcgacctgatcctggagatcggcaagctcccccagcacctgacccagcgcgcccagaacgccctggacaacctcgtgatgctgcacaacagcgagcagggcgggcgggcgtaccgccacgccatggaggagctgccggacaccatcgagacgctcatgctgctggccctcatcgccgtgctgaccgggggcgtcaccctgttcttcctctccgggcggggcctgggcaagaccagcatcgggctgctctgcgtgatggcctccagcgtgctgctgtggatggcgtccgtcgagccccactggatcgccgccagcatcatcctcgagttcttcctgatggtgctgctcatccccgagcccgaccgccagcggaccccgcaggacaaccagctggcctacgtggtcatcggcctcctcttcatgatcctgacggtggccgcgaacgagatggggctgctcgagaccaccaagaaggacctgggcatcgggcacgtggccgtcgagaaccaccaccacgccgccatgctggacgtggacctccaccccgcctccgcgtggaccctgtacgccgtggccacgaccatcatcacccccatgatgcgccacaccatcgagaacacgaccgccaacatcagcctgaccgccatcgcgaaccaggccgccatcctcatgggcctggacaagggctggccgatctccaagatggacatcggggtccccctgctcgccctgggctgctacagccaggtgaaccccctgaccctcacggcggccgtgctgatgctggtcgcccactacgccatcatcgggcccggcctccaggccaaggcgacccgggaggcccagaagcgcaccgccgccgggatcatgaagaacccgaccgtggacggcatcgtggccatcgacctggaccccgtcgtgtacgacgcgaagttcgagaagcagctgggccagatcatgctcctgatcctgtgcacgtcccagatcctcctgatgcgcaccacctgggccctgtgcgagagcatcaccctcgccacggggcccctgaccaccctgtgggagggctcccccgggaagttctggaacaccacgatcgccgtgagcatggccaacatcttccggggcagctacctcgcgggcgccgggctggccttctccctgatgaagtccctcggcgggggccgccgggggaccggcgcccagggcgagaccctgggggagaagtggaagcgccagctgaaccagctctccaagagcgagttcaacacctacaagcggtccggcatcatggaggtcgaccgcagcgaggcgaaggaggggctgaagcggggcgagacgaccaagcacgccgtgtcccgcgggaccgccaagctgcggtggttcgtggagcgcaacctcgtcaagccggagggcaaggtgatcgacctgggctgcgggcggggcgggtggagctactactgcgccggcctgaagaaggtgaccgaggtcaaggggtacacgaagggcggccccgggcacgaggagcccatccccatggccacctacggctggaacctggtgaagctccactccgggaaggacgtgttcttcatcccgcccgagaagtgcgacaccctgctgtgcgacatcggcgagagctcccccaaccccaccatcgaggaggggcgcacgctccgggtcctgaagatggtggagccgtggctgcgcggcaaccagttctgcatcaagatcctcaacccctacatgcccagcgtggtcgagaccctggagcagatgcagcggaagcacggcgggatgctggtgcgcaaccccctctcccggaacagcacccacgagatgtactgggtgtcctgcggcaccgggaacatcgtcagcgcggtgaacatgacctcccgcatgctgctgaaccggttcacgatggcccaccgcaagccgacctacgagcgcgacgtggacctcggcgccggcacccggcacgtcgccgtggagcccgaggtggccaacctggacatcatcgggcagcgcatcgagaacatcaagcacgagcacaagagcacctggcactacgacgaggacaacccctacaagacgtgggcgtaccacggctcctacgaggtcaagcccagcgggagcgcctccagcatggtgaacggcgtcgtgaagctgctcaccaagccgtgggacgtgatccccatggtcacccagatcgccatgaccgacacgacccccttcgggcagcagcgggtgttcaaggagaaggtggacacccgcacccccaaggccaagcggggcacggcccagatcatggaggtcaccgcgaagtggctgtggggcttcctgtcccgcaacaagaagccgcggatctgcacccgcgaggagttcacccggaaggtgcgcagcaacgccgccatcggggccgtgttcgtcgacgagaaccagtggaactccgcgaaggaggccgtggaggacgagcggttctgggacctcgtgcaccgcgagcgggagctgcacaagcagggcaagtgcgccacgtgcgtctacaacatgatggggaagcgcgagaagaagctgggcgagttcgggaaggccaagggcagccgggccatctggtacatgtggctcggcgcgcgcttcctggagttcgaggccctggggttcatgaacgaggaccactggttctcccgggagaacagcctctccggcgtggagggggagggcctgcacaagctggggtacatcctccgcgacatcagcaagatccccggcggcaacatgtacgccgacgacaccgccgggtgggacacccggatcaccgaggacgacctgcagaacgaggccaagatcacggacatcatggagcccgagcacgcgctgctcgccaagtccatcttcaagctgacctaccagaacaaggtggtccgcgtgcagcggccggccaagaacggcaccgtgatggacgtcatcagccgccgcgaccagcgggggtccggccaggtgggcacctacgggctgaacacgttcaccaacatggaggcccagctcatccgccagatggagagcgagggcatcttctcccccagcgagctggagacccccaacctggccgggcgggtgctcgactggctggagaagcacggcgtcgagcgcctgaagcggatggcgatctccggggacgactgcgtggtgaagcccatcgacgaccgcttcgccaccgccctcacggccctgaacgacatgggcaaggtccggaaggacatcccgcagtgggagcccagcaagggctggaacgactggcagcaggtccccttctgcagccaccacttccaccagctgatcatgaaggacgggcgcgagatcgtggtcccctgccggaaccaggacgagctcgtgggccgcgcccgggtgtcccagggggcgggctggagcctgcgcgagaccgcctgcctggggaagtcctacgcccagatgtggcagctcatgtacttccaccggcgcgacctgcggctggccgcgaacgccatctgcagcgccgtcccggtggactgggtgcccacctcccgcaccacgtggagcatccacgcccaccaccagtggatgaccaccgaggacatgctctccgtctggaaccgggtgtggatcgaggagaacccctggatggaggacaagacccacatcagctcctggggcgacgtgccctacctgggcaagcgcgaggaccagtggtgcgggagcctgatcggcctcacggcccgggcgacctgggccaccaacatccaggtcgccatcaaccaggtgcgccgcctgatcgggaacgagaactacctggactacatgacctccatgaagcggttcaagaacgagagcgacccggagggcgccctctggtga

SEQ ID NO: 8428 - RNA, 9879 nt, synthetic construct
  misc_feature 1..9879: note = derived and/or modified CDS sequence (opt1) from DENV-1__FJ410263__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacatcatgacctacaagtgcccccgcatcaccgagaccgagcccgacgacgtggactgctggtgcaacgccaccgacacctgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccaccccgggttcacggtgatcgccctgttcctggcccacgcgatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgccgtgctgcggaagctctgcatcgaggcgaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgccaccatcacgccccaggcgcccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgccaagaagcaggaggtcgtggtgctcggcagccaggagggcgcgatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggccgagacgcagcacggcaccgtgctggtccagatcaagtacgagggcaccgacgcgccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccaccgcccgcggggcccggcgcatggccatcctgggcgacacggcgtgggacttcgggtccatcggcggcgtgttcaccagcgtcgggaagctggtgcaccagatcttcggcaccgcctacggggtgctgttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggccgactccgggtgcgtcatcaactggaagggccgggagctcaagtgcgggagcggcatcttcgtgacgaacgaggtgcacacctggaccgagcagtacaagttccaggccgacagcccgaagcgcctgtccgcggccatcggcaaggcctgggaggagggggtctgcggcatccggagcgccacccgcctggagaacatcatgtggaagcagatctccaacgagctcaaccacatcctgctggagaacgacatgaagttcaccgtggtggtcggggacgtggccggcatcctcgcgcaggggaagaagatgatccggccccagcccatggagtacaagtacagctggaagtcctggggcaaggccaagatcatcggcgccgacgtgcagaacacgaccttcatcatcgacgggcccaacaccccggagtgccccgacgaccagcgcgcctggaacatctgggaggtcgaggactacggcttcgggatcttcaccacgaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacctgcatctggcccaagtcccacacgctgtggagcaacggcgtgctcgagtccgagatgatcatccccaagatctacgggggcccgatcagccagcacaactaccgccccgggtacttcacccaggccgccggcccctggcacctggggaagctggagctcgacttcgacctgtgcgagggcaccaccgtggtcgtggacgagcactgcggcaaccgggggccgtccctgcgcacgaccaccgtgaccggcaagatcatccacgagtggtgctgccggagctgcacgctgccgcccctccgcttccgcggggaggacggctgctggtacgggatggagatccgccccgtcaaggagaaggaggagaacctggtgaagtccatggtgagcgccggcagcggcgaggtcgactccttcagcctcgggctgctgtgcatctccatcatgatcgaggaggtgatgcggagccgctggtcccggcgcatgctcatgaccggcaccctggccgtgttcttcctgctcatcatggggcagctgacctggaacgacctgatccgcctctgcatcatggtcggcgcgaacgccagcgaccggatggggatgggcacgacctacctggccctgatggccaccttcaagatgcgcccgatgttcgccgtgggcctcctgttccggcgcctgacctcccgggaggtgctcctgctgacgatcgggctcagcctggtcgcgtccgtggagctgcccaacagcctcgaggagctgggcgacgggctggccatgggcatcatgatcctcaagctgctgaccgacttccagtcccaccagctctgggccaccctgctgagcctcaccttcatcaagacgaccttctccctgcactacgcctggaagaccatggcgatggtcctgagcatcgtgtccctcttccccctgtgcctgagcaccacgtcccagaagaccacctggctccccgtgctgctgggcagcctcgggtgcaagccgctgaccatgttcctgatcgccgagaacaagatctggggccgccggtcctggcccctcaacgaggggatcatggccgtcggcatcgtgagcatcctgctgagctccctcctgaagaacgacgtgcccctggccgggcccctcatcgccggcggcatgctgatcgcgtgctacgtcatcagcgggtccagcgccgacctgtccctcgagaaggccgccgaggtgagctgggaggaggaggccgagcactccggcgcgagccacaacatcctggtggaggtccaggacgacgggacgatgaagatcaaggacgaggagcgcgacgacaccctgaccatcctcctgaaggccaccctgctcgccgtgtccggcgtgtacccgctgagcatccccgccaccctgttcgtctggtacttctggcagaagaagaagcagcggtccggggtgctctgggacacgcccagcccgcccgaggtggagcgcgccgtcctggacgacggcatctaccggatcatgcagcgcggcctgctggggcggtcccaggtgggcgtgggggtcttccaggagaacgtgttccacaccatgtggcacgtgacccgcggcgcggtcctcatgtaccaggggaagcggctggagcccagctgggcctccgtgaagaaggacctgatcagctacggcggcgggtggcgcctccagggctcctggaacaccggggaggaggtgcaggtcatcgccgtggagcccggcaagaaccccaagaacgtgcagacggcccccgggaccttcaagacccccgagggcgaggtcggcgccatcgcgctggacttcaagcccgggaccagcggctcccccatcgtgaaccgggaggggaagatcgtgggcctgtacggcaacggggtcgtgacgaccagcggcacctacgtgagcgccatcgcccaggccaaggcgtcccaggaggggccgctccccgagatcgaggacgaggtcttccgcaagcggaacctgaccatcatggacctgcaccccggcagcgggaagacgcgccggtacctcccggccatcgtgcgcgaggccatcaagcgcaagctgcggaccctgatcctcgcccccacccgcgtggtcgcctccgagatggcggaggccctgaagggcatgcccatccggtaccagaccacggccgtcaagagcgagcacaccggcaaggagatcgtggacctgatgtgccacgccaccttcaccatgcgcctcctgtcccccgtccgggtgccgaactacaacatgatcatcatggacgaggcccacttcacggaccccagctccatcgcggcccgcgggtacatcagcacccgggtgggcatgggggaggccgccgccatcttcatgaccgcgacgccgcccggctccgtcgaggccttcccgcagagcaacgccgtgatccaggacgaggagcgcgacatccccgagcggtcctggaacagcgggtacgagtggatcacggacttccccggcaagaccgtgtggttcgtcccctccatcaagagcggcaacgacatcgccaactgcctgcgcaagaacgggaagcgggtgatccagctctcccgcaagaccttcgacaccgagtaccagaagacgaagaacaacgactgggactacgtggtcaccaccgacatcagcgagatgggcgcgaacttccgggccgaccgcgtgatcgacccgcggcgctgcctgaagcccgtgatcctgaaggacgggcccgagcgggtcatcctcgccggccccatgccggtgaccgtcgcctccgccgcgcagcgccgggggcgcatcggccgcaaccacaacaaggagggcgaccagtacatctacatggggcagcccctgaacaacgacgaggaccacgcccactggacggaggccaagatgctgctcgacaacatcaacacccccgagggcatcatccccgccctgttcgagccggagcgggagaagtccgccgcgatcgacggggagtaccgcctgcggggcgaggcccgcaagaccttcgtggagctcatgcggcgcggggacctgcccgtgtggctgtcctacaaggtcgccagcgagggcttccagtacagcgaccggcgctggtgcttcgacggcgagcggaacaaccaggtgctcgaggagaacatggacgtggagatctggaccaaggagggggagcgcaagaagctgcggccccgctggctggacgcccggacgtactccgaccccctcgccctgcgcgagttcaaggagttcgcggccggccggcgcagcgtctccggggacctgatcctcgagatcggcaagctgccgcagcacctgacccagcgggcccagaacgccctcgacaacctggtgatgctgcacaacagcgagcagggcgggcgcgcgtaccggcacgccatggaggagctccccgacaccatcgagaccctgatgctgctcgccctgatcgccgtgctgacgggcggggtcaccctcttcttcctgtccggccgcgggctgggcaagaccagcatcggcctcctgtgcgtgatggcctccagcgtgctgctctggatggcgtccgtcgagccccactggatcgccgccagcatcatcctggagttcttcctgatggtgctcctgatccccgagccggaccggcagcgcacgccccaggacaaccagctggcctacgtggtcatcgggctcctgttcatgatcctgaccgtggccgcgaacgagatgggcctcctggagacgaccaagaaggacctggggatcggccacgtggccgtcgagaaccaccaccacgccgccatgctcgacgtggacctgcaccccgcctccgcgtggaccctgtacgccgtggccaccacgatcatcaccccgatgatgcgccacaccatcgagaacaccacggccaacatcagcctcaccgccatcgcgaaccaggccgccatcctgatggggctggacaagggctggcccatctccaagatggacatcggcgtccccctcctggccctggggtgctacagccaggtgaaccccctcaccctgaccgcggccgtgctgatgctcgtcgcccactacgccatcatcggcccggggctgcaggccaaggcgacgcgggaggcccagaagcgcaccgccgccggcatcatgaagaaccccaccgtggacgggatcgtggccatcgacctggaccccgtcgtgtacgacgcgaagttcgagaagcagctcggccagatcatgctgctgatcctctgcacctcccagatcctgctgatgcggacgacctgggccctctgcgagagcatcaccctggccaccggccccctgacgaccctctgggaggggtccccgggcaagttctggaacaccaccatcgccgtgagcatggccaacatcttccgcgggtcctacctggcgggcgccggcctggccttcagcctcatgaagtccctcgggggcgggcggcgcgggacgggggcccagggcgagaccctgggcgagaagtggaagcggcagctcaaccagctgtccaagagcgagttcaacacctacaagcgctccgggatcatggaggtcgaccggagcgaggcgaaggagggcctgaagcgcggggagaccacgaagcacgccgtgtcccggggcaccgccaagctccgctggttcgtggagcggaacctggtcaagcccgaggggaaggtgatcgacctgggctgcggccgcgggggctggagctactactgcgccgggctgaagaaggtgaccgaggtcaagggctacaccaagggcggccccggccacgaggagcccatcccgatggccacgtacgggtggaacctcgtgaagctgcactccggcaaggacgtgttcttcatcccgcccgagaagtgcgacaccctgctctgcgacatcggggagagctcccccaacccgaccatcgaggagggccggaccctgcgcgtcctgaagatggtggagccctggctccgggggaaccagttctgcatcaagatcctgaacccctacatgcccagcgtggtcgagacgctggagcagatgcagcgcaagcacggcggcatgctcgtgcggaacccgctgtcccgcaacagcacccacgagatgtactgggtgtcctgcgggaccggcaacatcgtcagcgcggtgaacatgacctcccgcatgctgctcaaccggttcaccatggcccaccgcaagcccacgtacgagcgggacgtggacctgggggccggcacccgccacgtcgccgtggagcccgaggtggccaacctggacatcatcggccagcggatcgagaacatcaagcacgagcacaagagcacctggcactacgacgaggacaacccctacaagacctgggcgtaccacgggtcctacgaggtcaagccgagcggctccgccagcagcatggtgaacggggtcgtgaagctcctgacgaagccctgggacgtgatccccatggtcacccagatcgccatgaccgacaccacgcccttcggccagcagcgcgtgttcaaggagaaggtggacacccggaccccgaaggccaagcgcgggaccgcccagatcatggaggtcacggcgaagtggctgtggggcttcctctcccggaacaagaagccccgcatctgcacccgggaggagttcacccgcaaggtgcggagcaacgccgccatcggcgccgtgttcgtcgacgagaaccagtggaactccgcgaaggaggccgtggaggacgagcgcttctgggacctggtgcaccgggagcgcgagctgcacaagcaggggaagtgcgcgacctgcgtctacaacatgatgggcaagcgggagaagaagctcggggagttcggcaaggccaaggggagccgcgccatctggtacatgtggctgggcgcgcggttcctggagttcgaggccctcggcttcatgaacgaggaccactggttctcccgcgagaacagcctgtccggggtggagggcgaggggctgcacaagctcggctacatcctgcgggacatcagcaagatccccgggggcaacatgtacgccgacgacacggccggctgggacacccgcatcaccgaggacgacctgcagaacgaggcccgcatcaccgacatcatggagccggagcacgcgctcctggccaagtccatcttcaagctgacgtaccagaacaaggtggtccgggtgcagcgccccgccaagaacgggaccgtgatggacgtcatcagccggcgcgaccagcggggctccggccaggtggggacctacggcctcaacaccttcacgaacatggaggcccagctgatccgccagatggagagcgaggggatcttctcccccagcgagctggagacccccaacctcgccgagcgggtgctggactggctggagaagtacggcgtcgagcgcctcaagcggatggcgatctccggggacgactgcgtggtgaagccgatcgacgaccgcttcgccaccgccctgaccgccctgaacgacatgggcaaggtccggaaggacatcccccagtgggagcccagcaaggggtggaacgactggcagcaggtccccttctgctcccaccacttccaccagctcatcatgaaggacggccgcgagatcgtggtcccgtgccggaaccaggacgagctggtgggccgcgcccgggtgagccagggggcgggctggagcctgcgcgagacggcctgcctcgggaagtcctacgcccagatgtggcagctgatgtacttccaccggcgcgacctgcggctcgccgcgaacgccatctgcagcgccgtccccgtggactggatccccacctcccgcaccacctggagcatccacgcccaccaccagtggatgacgaccgaggacatgctgtccgtgtggaaccgcgtctggatcgaggagaacccctggatggaggacaagacccacatcagctcctggggcgacgtgccgtacctggggaagcgggaggaccagtggtgcggcagcctcatcggcctgaccgcccgcgcgacgtgggccaccaacatccaggtggccatcaaccaggtccggcgcctgatcgggaacgagaactacctcgactacatgacctccatgaagcggttcaagaacgagagcgaccccgagggcgccctgtggtga

SEQ ID NO: 8429 - RNA, 9879 nt, synthetic construct
  misc_feature 1..9879: note = derived and/or modified CDS sequence (opt1) from DENV-1__FJ410264__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgccggggtgaacatgtgcaccctcatcgccatggacctgggcgagctgtgcgaggacaccatgacctacaagtgcccccggatcaccgaggccgagcccgacgacgtggactgctggtgcaacgccacggacacctgggtgacctacgggacctgcagccagacgggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcatccagaacggccggctgatcacggccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacaccgcctgggacttcgggtccgtgggcggcgtgttcacgagcgtcgggaagctggtgcaccagatcttcggcaccgcctacggggtcctgttctccggcgtcagctggaccatgaagatcgggatcggcgtgctgctgacctggctcggcctgaactcccgcagcacgtccctgagcatgacctgcatcgccgtggggctcgtcaccctgtacctgggcgtgatggtgcaggccgactccgggtgcgtcatcaactggaagggccgggagctcaagtgcgggagcggcatcttcgtgaccaacgaggtgcacacgtggaccgagcagtacaagttccaggcggacagcccgaagcgcctgtccgccgccatcggcaaggcctgggaggagggggtctgcggcatccggagcgccacccgcctggagaacatcatgtggaagcagatctccaacgagctcaaccacatcctgctggagaacgacatgaagttcaccgtggtggtcggggacgtggtgggcatcctcgcgcaggggaagaagatgatccggccccagcccatggagcacaagtacagctggaagtcctggggcaaggccaagatcatcggcgccgacgtccagaacaccacgttcatcatcgacgggcccaacaccccggagtgccccgacgaccagcgcgcctggaacatctgggaggtggaggactacggcttcgggatcttcaccaccaacatctggctgaagctgcgggacagctacacccaggtgtgcgaccaccgcctcatgtccgcggccatcaaggacagcaaggccgtccacgccgacatgggctactggatcgagtccgagaagaacgagacctggaagctggcccgggcgagcttcatcgaggtgaagacctgcatctggcccaagtcccacaccctgtggagcaacggcgtgctcgagtccgagatgatcatccccaagatctacgggggcccgatcagccagcacaactaccgccccgggtacttcacgcagaccgccggcccctggcacctggggaagctggagctcgacttcgacctgtgcgagggcaccaccgtcgtggtggacgagcactgcggcaaccgggggccgtccctgcgcacgaccaccgtcaccggcaagatcatccacgagtggtgctgccggagctgcacgctgccgcccctccgcttcaagggggaggacggctgctggtacgggatggagatccggcccgtgaaggagaaggaggagaacctggtgaagtccatggtcagcgccggcagcggcgaggtggactccttcagcctcgggctgctgtgcatctccatcatgatcgaggaggtgatgcgcagccggtggtcccgcaagatgctcatgaccggcaccctggccgtcttcctgctcctgatcatggggcagctgacctggaacgacctcatccggctgtgcatcatggtgggcgccaacgcgagcgaccgcatggggatgggcacgacctacctggccctcatggccaccttcaagatgcgcccgatgttcgccgtggggctgctgttccggcgcctcacctcccgggaggtcctgctgctcacgatcgggctgagcctggtggcctccgtcgagctccccaacagcctggaggagctgggcgacgggctcgcgatgggcatcatgatcctgaagctgctcaccgacttccagtcccaccagctgtgggccaccctgctcagcctgaccttcatcaagacgaccctgtccctccactacgcctggaagaccatggccatggtgctgagcatcgtgtccctgttccccctctgcctgagcaccacgtcccagaagaccacctggctgcccgtcctcctgggcagcctggggtgcaagccgctcaccatgttcctgatcacggagaacaagatctggggccgcaagtcctggcccctgaacgaggggatcatggcggtgggcgtggtcagcatcctcctgagctccctgctcaagaacgacgtgcccctggccgggcccctgatcgccggcggcatgctcatcgcctgctacgtgatcagcgggtccagcgccgacctgtccctggagaaggcggccgaggtcagctgggaggaggaggccgagcactccggcgccagccacaacatcctcgtggaggtgcaggacgacgggaccatgaagatcaaggacgaggagcgggacgacaccctgaccatcctgctcaaggccaccctgctggcggtctccggcgtgtacccgctcagcatccccgccacgctgttcgtgtggtacttctggcagaagaagaagcagcgctccggggtcctgtgggacacccccagcccgcccgaggtggagcgggccgtgctggacgacggcatctaccgcatcatgcagcggggcctcctggggcgctcccaggtcggcgtgggggtgttccaggagaacgtcttccacaccatgtggcacgtgacccggggcgccgtgctgatgtaccaggggaagcgcctcgagcccagctgggcctccgtcaagaaggacctgatcagctacggcggcgggtggcggctgcagggctcctggaacacgggggaggaggtccaggtgatcgcggtcgagcccggcaagaaccccaagaacgtgcagaccgcccccgggaccttcaagacccccgagggcgaggtgggcgccatcgccctcgacttcaagcccgggacgagcggctcccccatcgtcaaccgcgaggggaagatcgtgggcctgtacggcaacggggtggtcaccaccagcggcacctacgtgagcgccatcgcgcaggccaaggcctcccaggaggggccgctgcccgagatcgaggacgaggtgttccggaagcgcaacctcacgatcatggacctgcaccccggcagcgggaagacccggcgctacctgccggccatcgtccgggaggcgatcaagcgcaagctccggaccctgatcctggcccccacccgcgtggtggcctccgagatggccgaggccctcaagggcatgcccatccgctaccagacgaccgcggtcaagagcgagcacaccggcaaggagatcgtggacctgatgtgccacgccaccttcacgatgcggctgctctcccccgtgcgcgtcccgaactacaacatgatcatcatggacgaggcccacttcaccgaccccagctccatcgccgcccgggggtacatcagcacccgcgtgggcatgggggaggcggccgccatcttcatgaccgccacgccgcccggctccgtggaggccttcccgcagagcaacgcggtcatccaggacgaggagcgggacatccccgagcgctcctggaacagcgggtacgagtggatcaccgacttccccggcaagaccgtgtggttcgtgccctccatcaagagcggcaacgacatcgccaactgcctgcggaagaacgggaagcgcgtcatccagctgtcccggaagaccttcgacacggagtaccagaagaccaagaacaacgactgggactacgtggtgaccaccgacatcagcgagatgggcgccaacttccgcgccgaccgggtcatcgacccgcgccggtgcctcaagcccgtgatcctgaaggacgggcccgagcgcgtcatcctggcgggccccatgccggtgacggtggcctccgccgcccagcggcgcgggcggatcggccgcaaccacaacaaggagggcgaccagtacatctacatggggcagcccctcaacaacgacgaggaccacgcccactggaccgaggcgaagatgctgctggacaacatcaacacccccgagggcatcatccccgccctcttcgagccggagcgggagaagtccgccgccatcgacggggagtaccgcctgcgcggcgaggcccggaagaccttcgtcgagctgatgcgccgcggggacctccccgtgtggctgtcctacaaggtggcgagcgagggcttccagtacagcgaccgccggtggtgcttcgacggcgagcgcaacaaccaggtcctggaggagaacatggacgtggagatctggacgaaggagggggagcggaagaagctccgcccccggtggctggacgcccgcacctactccgaccccctggccctccgggagttcaaggagttcgccgccggccgccggagcgtgtccggggacctgatcctggagatcggcaagctcccgcagcacctgacccagcgcgcgcagaacgccctggacaacctcgtcatgctgcacaacagcgagcagggcgggcgggcctaccgccacgccatggaggagctgcccgacaccatcgagacgctcatgctgctggcgctcatcgccgtgctgaccggcggggtgaccctgttcttcctctccggccgggggctgggcaagaccagcatcggcctgctctgcgtcatggcctccagcgtgctgctgtggatggcctccgtggagccccactggatcgccgcgagcatcatcctcgagttcttcctgatggtcctgctcatccccgagccggaccgccagcggacgccccaggacaaccagctggcctacgtggtgatcgggctcctcttcatgatcctgacggtcgccgccaacgagatgggcctgctcgagaccaccaagaaggacctggggatcggccacgtggccgtggagaaccaccaccacgcgaccatgctggacgtcgacctccaccccgcctccgcctggacgctgtacgccgtggccaccaccatcatcaccccgatgatgcgccacacgatcgagaacaccaccgcgaacatcagcctgaccgccatcgccaaccaggccgccatcctcatggggctggacaagggctggcccatctccaagatggacatcggcgtgcccctgctcgcgctggggtgctacagccaggtcaaccccctgacgctcaccgccgccgtgctgatgctggtggcccactacgcgatcatcggcccggggctccaggccaaggccacccgggaggcccagaagcgcaccgccgcgggcatcatgaagaaccccacggtcgacgggatcgtggccatcgacctggaccccgtggtctacgacgccaagttcgagaagcagctgggccagatcatgctcctgatcctgtgcacctcccagatcctcctgatgcgcaccacctgggccctgtgcgagagcatcacgctcgccaccggccccctgaccaccctgtgggaggggtccccgggcaagttctggaacacgaccatcgcggtgagcatggccaacatcttccgggggtcctacctcgccggcgccggcctggccttcagcctgatgaagtccctcgggggcgggcgccggggcaccggggcgcagggcgagaccctgggcgagaagtggaagcgccagctgaaccagctctccaagagcgagttcaacatctacaagcggtccgggatcatggaggtggaccgcagcgaggccaaggagggcctgaagcgcggggagacgacccgccacgccgtctcccggggcaccgccaagctgcgctggttcgtggagcggaacctggtgaagcccgaggggaaggtcatcgacctcggctgcggccgcgggggctggagctactactgcgcggggctgaagaaggtgaccgaggtgaagggctacacgaagggcgggcccggccacgaggagcccatcccgatggccacctacgggtggaacctggtcaagctccactccggcaaggacgtgttcttcacgccgcccgagaagtgcgacaccctgctgtgcgacatcggggagagctcccccaacccgacgatcgaggagggccggaccctccgcgtgctgaagatggtcgagccctggctgcgggggaaccagttctgcatcaagatcctcaacccctacatgcccagcgtggtggagaccctggagcagatgcagcgcaagcacggcggcatgctggtccggaacccgctctcccgcaacagcacccacgagatgtactgggtgtcctgcgggaccggcaacatcgtgagcgccgtcaacatgacgtcccggatgctgctgaaccgcttcaccatggcccaccgcaagcccacctacgagcgggacgtggacctcggggccggcacccgccacgtggcggtcgagcccgaggtggccaacctggacatcatcggccagcggatcgagaacatcaagcacgagcacaagagcacgtggcactacgacgaggacaacccctacaagacctgggcctaccacgggtcctacgaggtcaagccgagcggctccgccagcagcatggtgaacggggtggtcaagctgctcaccaagccctgggacgtgatccccatggtgacccagatcgccatgacggacaccacccccttcggccagcagcgcgtcttcaaggagaaggtggacacccggacgccgaaggcgaagcgcgggaccgcccagatcatggaggtgaccgcccggtggctgtggggcttcctgtcccgcaacaagaagccccggatctgcacccgcgaggagttcacgcggaaggtccgcagcaacgccgccatcggcgcggtgttcgtggacgagaaccagtggaactccgccaaggaggccgtcgaggacgagcggttctgggacctcgtgcagaaggagcgcgagctgcacaagcaggggaagtgcgcgacctgcgtgtacaacatgatgggcaagcgggagaagaagctgggggagttcggcaaggcgaaggggagccgcgccatctggtacatgtggctcggcgcccggttcctggagttcgaggccctgggcttcatgaacgaggaccactggttctcccgcgagaacagcctctccggggtcgagggcgaggggctgcacaagctgggctacatcctccgggacatcagcaagatccccgggggcaacatgtacgccgacgacaccgcgggctgggacacccgcatcacggaggacgacctgcagaacgaggccaagatcaccgacatcatggagccggagcacgccctgctcgccacctccatcttcaagctgacctaccagaacaaggtggtgcgggtccagcgccccgccaagaacgggacggtgatggacgtgatcagccgccgggaccagcgcggctccgggcaggtcggcacctacggcctgaacaccttcaccaacatggaggcgcagctcatccggcagatggagagcgaggggatcttcctgccctccgagctggagacgcccaacctcgccgagcgcgtgctggactggctggagaagtacggcgtggagcggctcaagcgcatggccatcagcggggacgactgcgtcgtgaagccgatcgacgaccggttcgccaccgccctgaccgcgctgaacgacatgggcaaggtgcgcaaggacatcccccagtgggagccctccaaggggtggaacgactggcagcaggtccccttctgcagccaccacttccaccagctcatcatgaaggacggccgggagatcgtggtgccgtgccgcaaccaggacgagctggtcggccgggcccgcgtgtcccagggggccggctggagcctgcgggagaccgcctgcctcggcaagagctacgcccagatgtggcagctgatgtacttccaccgccgggacctgcgcctcgcggccaacgccatctgctccgccgtgcccgtcgactgggtgcccacgagccggaccacctggtccatccacgcgcaccaccagtggatgaccacggaggacatgctgagcgtgtggaaccgcgtctggatcgaggagaacccctggatggaggacaagacccacgtgtccagctggggcgacgtgccgtacctggggaagcgggaggaccagtggtgcggctccctcatcggcctgaccgcccgcgccacctgggccagcaacatccaggtcgccatcaaccaggtgcgccggctgatcgggaacgagaactacctcgactacatgacctccatgaagcgcttcaagaacgagggcgaccccgagggggcgctgtggtga

SEQ ID NO: 8430 - RNA, 9879 nt, synthetic construct
  misc_feature 1..9879: note = derived and/or modified CDS sequence (opt1) from DENV-1__FJ410265__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgagaccgagcccgacgacgtggactgctggtgcaacgccacggacacctgggtcacctacgggacctgcagccagacgggcgagcaccggcgcgacaagcggtccgtggccctcgcgccccacgtgggcctggggctggagacccgcaccgagacctggatgagctccgagggcgcctggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtcgggaagctggtgcaccagatcttcggcaccgcctacggggtgctgttctccggcgtcagctggacgatgaagatcgggatcggcgtgctgctgacctggctcggcctgaactcccgcagcacctccctgagcatgacctgcatcgccgtggggctcgtcacgctgtacctgggcgtgatggtgcaggccgactccgggtgcgtcatcaactggaagggccgggagctcaagtgcgggagcggcatcttcgtgaccaacgaggtgcacacctggaccgagcagtacaagttccaggccgacagcccgaagcgcctgtccgcggccatcggcaaggcctgggaggagggggtctgcggcatccggagcgccacccgcctggagaacatcatgtggaagcagatctccaacgagctcaaccacatcctgctggagaacgacatgaagttcacggtggtggtcggggacgtggccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtcgaggactacggcttcgggatcttcacgaccaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacgtgcatctggcccaagtcccacaccctgtggagcaacggcgtgctcgagtccgagatgatcatccccaagatctacgggggcccgatcagccagcacaactaccgccccgggtacttcacccaggccgccggcccctggcacctggggaagctggagctcgacttcgacctgtgcgagggcaccacggtggtcgtggacgagcactgcggcaaccgggggccgtccctgcgcaccaccaccgtgacgggcaagatcatccacgagtggtgctgccggagctgcaccctgccgcccctccgcttccgcggggaggacggctgctggtacgggatggagatccgccccgtcaaggagaaggaggagaacctggtgaagtccatggtgagcgccggcagcggcgaggtcgactccttcagcctcgggctgctgtgcacctccatcatgatcgaggaggtgatgcggagccgctggtcccggcgcatgctcatgaccggcacgctggccgtgttcttcctgctcatcatggggcagctgacctggaacgacctgatccgcctctgcatcatggtcggcgcgaacgccagcgaccggatggggatgggcaccacctacctggccctgatggccacgttcaagatgcgcccgatgttcgccgtgggcctcctgttccggcgcctgacctcccgggaggtgctcctgctgaccatcgggctcagcctggtcgcgtccgtggagctgcccaacagcctcgaggagctgggcgacgggctggccatgggcatcatgatcctcaagctgctgaccgacttccagtcccaccagctctgggccacgctgctgagcctcaccttcatcaagaccaccttctccctgcactacgcctggaagacgatggcgatggtcctgagcatcgtgtccctcttccccctgtgcctgagcaccacctcccagaagaccacgtggctccccgtgctgctgggcagcctcgggtgcaagccgctgaccatgttcctgatcgccgagaacaagatctggggccgccggtcctggcccctcaacgaggggatcatggccgtcggcatcgtgagcatcctgctgagctccctcctgaagaacgacgtgcccctggccgggcccctcatcgccggcggcatgctgatcgcgtgctacgtcatcagcgggtccagcgccgacctgtccctcgagaaggccgccgaggtgagctgggaggaggaggccgagcactccggcgcgagccacaacatcctggtggaggtccaggacgacgggaccatgaagatcaaggacgaggagcgcgacgacaccctgaccatcctcctgaaggccacgctgctcgccgtgtccggcgtgtacccgctgagcatccccgccaccctgttcgtctggtacttctggcagaagaagaagcagcggtccggggtgctctgggacacccccagcccgcccgaggtggagcgcgccgtcctggacgacggcatctaccggatcatgcagcgcggcctgctggggcggtcccaggtgggcgtgggggtcttccaggagaacgtgttccacaccatgtggcacgtgacgcgcggcgcggtcctcatgtaccaggggaagcggctggagcccagctgggcctccgtgaagaaggacctgatcagctacggcggcgggtggcgcctccagggctcctggaacaccggggaggaggtgcaggtcatcgccgtggagcccggcaagaaccccaagaacgtgcagaccgcccccgggaccttcaagacgcccgagggcgaggtcggcgccatcgcgctggacttcaagcccgggaccagcggctcccccatcgtgaaccgggaggggaagatcgtgggcctgtacggcaacggggtcgtgaccaccagcggcacgtacgtgagcgccatcgcccaggccaaggcgtcccaggaggggccgctccccgagatcgaggacgaggtcttccgcaagcggaacctgaccatcatggacctgcaccccggcagcgggaagacccgccggtacctcccggccatcgtgcgcgaggccatcaagcgcaagctgcggaccctgatcctcgcccccacgcgcgtggtcgcctccgagatggcggaggccctgaagggcatgcccatccggtaccagaccaccgccgtcaagagcgagcacaccggcaaggagatcgtggacctgatgtgccacgccacgttcaccatgcgcctcctgtcccccgtccgggtgccgaactacaacatgatcatcatggacgaggcccacttcaccgaccccagctccatcgcggcccgcgggtacatcagcacccgggtgggcatgggggaggccgccgccatcttcatgacggcgacgccgcccggctccgtcgaggccttcccgcagagcaacgccgtgatccaggacgaggagcgcgacatccccgagcggtcctggaacagcgggtacgagtggatcaccgacttccccggcaagaccgtgtggttcgtcccctccatcaagagcggcaacgacatcgccaactgcctgcgcaagaacgggaagcgggtgatccagctctcccgcaagacgttcgacaccgagtaccagaagaccaagaacaacgactgggactacgtggtcaccacggacatcagcgagatgggcgcgaacttccgggccgaccgcgtgatcgacccgcggcgctgcctgaagcccgtgatcctgaaggacgggcccgagcgggtcatcctcgccggccccatgccggtgaccgtcgcctccgccgcgcagcgccgggggcgcatcggccgcaaccacaacaaggagggcgaccagtacatctacatggggcagcccctgaacaacgacgaggaccacgcccactggaccgaggccaagatgctgctcgacaacatcaacacccccgagggcatcatccccgccctgttcgagccggagcgggagaagtccgccgcgatcgacggggagtaccgcctgcggggcgaggcccgcaagacgttcgtggagctcatgcggcgcggggacctgcccgtgtggctgtcctacaaggtcgccagcgagggcttccagtacagcgaccggcgctggtgcttcgacggcgagcggaacaaccaggtgctcgaggagaacatggacgtggagatctggaccaaggagggggagcgcaagaagctgcggccccgctggctggacgcccggacctactccgaccccctcgccctgcgcgagttcaaggagttcgcggccggccggcgcagcgtctccggggacctgatcctcgagatcggcaagctgccgcagcacctgacccagcgggcccagaacgccctcgacaacctggtgatgctgcacaacagcgagcagggcgggcgcgcgtaccggcacgccatggaggagctccccgacacgatcgagaccctgatgctgctcgccctgatcgccgtgctgaccggcggggtcaccctcttcttcctgtccggccgcgggctgggcaagaccagcatcggcctcctgtgcgtgatggcctccagcgtgctgctctggatggcgtccgtcgagccccactggatcgccgccagcatcatcctggagttcttcctgatggtgctcctgatccccgagccggaccggcagcgcacgccccaggacaaccagctggcctacgtggtcatcgggctcctgttcatgatcctgaccgtggccgcgaacgagatgggcctcctggagaccaccaagaaggacctggggatcggccacgtggccgtcgagaaccaccaccacgccgccatgctcgacgtggacctgcaccccgcctccgcgtggacgctgtacgccgtggccaccaccatcatcaccccgatgatgcgccacacgatcgagaacaccaccgccaacatcagcctcaccgccatcgcgaaccaggccgccatcctgatggggctggacaagggctggcccatctccaagatggacatcggcgtccccctcctggccctggggtgctacagccaggtgaaccccctcacgctgaccgcggccgtgctgatgctcgtcgcccactacgccatcatcggcccggggctgcaggccaaggcgacccgggaggcccagaagcgcaccgccgccggcatcatgaagaaccccacggtggacgggatcgtggccatcgacctggaccccgtcgtgtacgacgcgaagttcgagaagcagctcggccagatcatgctgctgatcctctgcacctcccagatcctgctgatgcggaccacctgggccctctgcgagagcatcacgctggccaccggccccctgaccaccctctgggaggggtccccgggcaagttctggaacacgaccatcgccgtgagcatggccaacatcttccgcgggtcctacctggcgggcgccggcctggccttcagcctcatgaagtccctcgggggcgggcggcgcgggaccggggcccagggcgagaccctgggcgagaagtggaagcggcagctcaaccagctgtccaagagcgagttcaacacgtacaagcgctccgggatcatggaggtcgaccggagcgaggcgaaggagggcctgaagcgcggggagaccaccaagcacgccgtgtcccggggcaccgccaagctccgctggttcgtggagcggaacctggtcaagcccgaggggaaggtgatcgacctgggctgcggccgcgggggctggagctactactgcgccgggctgaagaaggtgacggaggtcaagggctacaccaagggcggccccggccacgaggagcccatcccgatggccacctacgggtggaacctcgtgaagctgcactccggcaaggacgtgttcttcatcccgcccgagaagtgcgacaccctgctctgcgacatcggggagagctcccccaacccgacgatcgaggagggccggaccctgcgcgtcctgaagatggtggagccctggctccgggggaaccagttctgcatcaagatcctgaacccctacatgcccagcgtggtcgagaccctggagcagatgcagcgcaagcacggcggcatgctcgtgcggaacccgctgtcccgcaacagcacccacgagatgtactgggtgtcctgcgggaccggcaacatcgtcagcgcggtgaacatgacgtcccgcatgctgctcaaccggttcaccatggcccaccgcaagcccacctacgagcgggacgtggacctgggggccggcacccgccacgtcgccgtggagcccgaggtggccaacctggacatcatcggccagcggatcgagaacatcaagcacgagcacaagagcacgtggcactacgacgaggacaacccctacaagacctgggcgtaccacgggtcctacgaggtcaagccgagcggctccgccagcagcatggtgaacggggtcgtgaagctcctgaccaagccctgggacgtgatccccatggtcacccagatcgccatgacggacaccacccccttcggccagcagcgcgtgttcaaggagaaggtggacacccggacgccgaaggccaagcgcgggaccgcccagatcatggaggtcaccgcgaagtggctgtggggcttcctctcccggaacaagaagccccgcatctgcacccgggaggagttcacgcgcaaggtgcggagcaacgccgccatcggcgccgtgttcgtcgacgagaaccagtggaactccgcgaaggaggccgtggaggacgagcgcttctgggacctggtgcaccgggagcgcgagctgcacaagcaggggaagtgcgcgacctgcgtctacaacatgatgggcaagcgggagaagaagctcggggagttcggcaaggccaaggggagccgcgccatctggtacatgtggctgggcgcgcggttcctggagttcgaggccctcggcttcatgaacgaggaccactggttctcccgcgagaacagcctgtccggggtggagggcgaggggctgcacaagctcggctacatcctgcgggacatcagcaagatccccgggggcaacatgtacgccgacgacaccgccggctgggacacccgcatcacggaggacgacctgcagaacgaggccaagatcaccgacatcatggagccggagcacgcgctcctggccaagtccatcttcaagctgacctaccagaacaaggtggtccgcgtgcagcggcccgccaagaacgggaccgtgatggacgtcatcagccgccgggaccagcgcggctccggccaggtggggacgtacggcctcaacaccttcaccaacatggaggcccagctgatccggcagatggagagcgaggggatcttctcccccagcgagctggagacccccaacctcgccgagcgcgcgctggactggctggagaagtacggcgtggagcggctcaagcgcatggccatctccggggacgactgcgtcgtgaagccgatcgacgaccggttcgccacggccctgaccgccctgaacgacatgggcaaggtgcgcaaggacatcccccagtgggagcccagcaaggggtggaacgactggcagcaggtccccttctgctcccaccacttccaccagctcatcatgaaggacggccgggagatcgtggtgccgtgccgcaaccaggacgagctggtcggccgggcgcgcgtgagccagggggccggctggagcctgcgggagaccgcctgcctcgggaagtcctacgcccagatgtggcagctgatgtacttccaccgccgggacctgcgcctcgcggccaacgccatctgcagcgccgtgcccgtcgactggatccccacctcccggacgacctggagcatccacgcccaccaccagtggatgaccaccgaggacatgctgtccgtgtggaaccgcgtgtggatcgaggagaacccctggatggaggacaagacgcacatcagctcctggggcgacgtcccgtacctggggaagcgcgaggaccagtggtgcggcagcctcatcggcctgaccgcgcgggccacctgggccaccaacatccaggtggccatcaaccaggtgcgccggctgatcgggaacgagaactacctcgactacatgacctccatgaagcgcttcaagaacgagagcgaccccgagggcgccctgtggtga

SEQ ID NO: 8431 - RNA, 9879 nt, synthetic construct
  misc_feature 1..9879: note = derived and/or modified CDS sequence (opt1) from DENV-1__FJ461336__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagacctccgccggggtgaacatgtgcaccctcatcgccatggacctgggcgagctgtgcgaggacaccatgacctacaagtgcccccgcatcaccgagaccgagcccgacgacgtggactgctggtgcaacgccacggacacctgggtgacctacgggacctgcagccagacgggcgagcaccggcgcgacaagcggtccgtggccctcgcgccccacgtgggcctggggctggagacccgcaccgagacctggatgagctccgagggcgcgtggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcaaccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgccgtgctgcggaagctctgcatcgaggcgaagatcagcaacaccacgaccgactcccgctgcccgacccagggcgaggccaccctggtggaggagcaggacgccaacttcgtctgccggcgcacgttcgtggaccggggctgggggaacggctgcgggctgttcggcaaggggagcctcatcacgtgcgccaagttcaagtgcgtgaccaagctggagggcaagatcgtccagtacgagaacctgaagtactccgtgatcgtgaccgtccacacgggcgaccagcaccaggtggggaacgagagcaccgagcacggcaccaccgccaccatcacgccccaggcgcccaccaccgagatccagctcaccgactacggggccctgacgctggactgcagcccccggaccggcctcgacttcaacgagatggtcctgctgaccatgaaggagaagtcctggctcgtgcacaagcagtggttcctggacctgcccctcccctggacctccggggccagcacgagccaggagacctggaaccggcaggacctgctggtgaccttcaagaccgcccacgccaagaagcaggaggtcgtggtgctcggctcccaggagggcgcgatgcacacggccctgaccggggccaccgagatccagaccagcggcacgaccaccatcttcgccgggcacctgaagtgccgcctcaagatggacaagctgaccctgaagggcatgtcctacgtcatgtgcacggggagcttcaagctcgagaaggaggtggccgagacccagcacggcaccgtgctggtccagatcaagtacgagggcaccgacgcgccctgcaagatccccttctccacgcaggacgagaagggggtgacccagaacggccggctgatcaccgccaacccgatcgtgaccgacaaggagaagcccgtcaacatcgaggccgagccgcccttcggggagagctacatcgtgatcggcgccggcgagaaggcgctgaagctctcctggttcaagaaggggagctccatcggcaagatgttcgaggccacggcccgcggggcccggcgcatggccatcctgggcgacaccgcgtgggacttcgggagcatcggcggcgtgctgacctccgtcgggaagctcgtgcaccagatcttcggcaccgcctacggggtgctgttcagcggcgtctcctggacgatgaagatcgggatcggcgtgctgctcacctggctgggcctgaacagccgctccaccagcctctccatgacctgcatcgccgtggggctggtcacgctgtacctcggcgtgatggtgcaggccgacagcgggtgcgtcatcaactggaagggccgggagctgaagtgcgggtccggcatcttcgtgaccaacgaggtgcacacctggaccgagcagtacaagttccaggccgacagcccgaagcgcctgagcgcggccatcggcaaggcctgggaggagggggtctgcggcatccggtccgccacccgcctcgagaacatcatgtggaagcagatcagcaacgagctgaaccacatcctgctcgagaacgacatgaagttcacggtggtggtcggggacgtggccggcatcctggcgcaggggaagaagatgatccggccccagcccatggagtacaagtactcctggaagtcctggggcaaggccaagatcatcggcgccgacgtgcagaacaccaccttcatcatcgacgggcccaacaccccggagtgccccgacgaccagcgcgcctggaacatctgggaggtcgaggactacggcttcgggatcttcacgaccaacatctggctgaagctccgggactcctacacccaggtgtgcgaccaccgcctgatgagcgcggccatcaaggactccaaggccgtgcacgccgacatgggctactggatcgagagcgagaagaacgagacctggaagctggcccgggcgtccttcatcgaggtcaagacgtgcatctggcccaagagccacaccctctggtccaacggcgtgctggagagcgagatgatcatccccaagatctacgggggcccgatctcccagcacaactaccgccccgggtacttcacccagaccgccggcccctggcacctggggaagctcgagctggacttcgacctgtgcgagggcacgaccgtggtcgtggacgagcactgcggcaaccgggggccgagcctccgcaccaccacggtgaccggcaagatcatccacgagtggtgctgccggtcctgcaccctgccgcccctgcgcttccgcggggaggacggctgctggtacgggatggagatccgccccgtcaaggagaaggaggagaacctcgtcaagagcatggtgtccgccggcagcggcgaggtcgacagcttctccctggggctgctctgcatcagcatcatgatcgaggaggtgatgcggtcccgctggagccggaagatgctgatgaccggcacgctggccgtgttcttcctcctgatcatggggcagctgacctggaacgacctcatccgcctgtgcatcatggtcggcgccaacgcgtccgaccgcatggggatgggcaccacctacctggccctcatggccacgttcaagatgcggccgatgttcgccgtggggctgctgttccgccggctcaccagccgcgaggtgctgctgctcaccatcgggctgtccctggtcgccagcgtggagctccccaactccctggaggagctgggcgacgggctcgcgatgggcatcatgatcctgaagctgctcaccgacttccagagccaccagctgtgggccacgctgctctccctgaccttcatcaagaccaccttcagcctgcactacgcctggaagacgatggccatggtcctctccatcgtgagcctgttccccctgtgcctctccaccaccagccagaagaccacgtggctgcccgtgctgctcggctccctggggtgcaagccgctgaccatgttcctcatcgcggagaacaagatctggggccggcgcagctggcccctgaacgaggggatcatggccgtcggcatcgtgtccatcctgctcagcagcctgctgaagaacgacgtgcccctcgccgggcccctgatcgccggcggcatgctgatcgcctgctacgtcatctccgggagctccgcggacctcagcctggagaaggccgccgaggtgtcctgggaggaggaggccgagcacagcggcgcctcccacaacatcctggtggaggtccaggacgacgggaccatgaagatcaaggacgaggagcgggacgacaccctcaccatcctgctgaaggcgacgctcctggccgtgagcggcgtgtacccgctgtccatccccgccaccctcttcgtctggtacttctggcagaagaagaagcagcgcagcggggtgctgtgggacacccccagcccgcccgaggtgggccgggccgtcctggacgacggcatctaccgcatcatgcagcgggggctgctcggccgcagccaggtgggggtgggcgtcttccaggagaacgtgttccacaccatgtggcacgtgacgcgcggggccgtcctgatgtaccagggcaagcgcctggagccctcctgggcgagcgtgaagaaggacctcatctcctacggcgggggctggcggctgcaggggagctggaacaccggcgaggaggtgcaggtcatcgccgtggagcccgggaagaaccccaagaacgtgcagaccgcccccggcaccttcaagacgcccgagggcgaggtcggggccatcgccctggacttcaagcccggcacctccgggagccccatcgtgaaccgcgagggcaagatcgtgggcctctacgggaacggcgtcgtgaccacctccgggacgtacgtgagcgcgatcgcccaggccaaggccagccaggagggcccgctgcccgagatcgaggacgaggtcttccggaagcgcaacctgaccatcatggacctccaccccgggtccggcaagacccggcgctacctgccggcgatcgtgcgggaggccatcaagcgcaagctgcgcaccctcatcctggcccccacgcgggtggtcgccagcgagatggccgaggcgctgaagggcatgcccatccgctaccagaccaccgccgtgaagtccgagcacaccgggaaggagatcgtggacctcatgtgccacgccacgttcaccatgcggctgctgagccccgtccgcgtgccgaactacaacatgatcatcatggacgaggcccacttcaccgacccctccagcatcgccgcgcggggctacatctccacccgcgtggggatgggcgaggccgccgccatcttcatgacggccacgccgcccgggagcgtcgaggcgttcccgcagtccaacgccgtgatccaggacgaggagcgggacatccccgagcgcagctggaactccggctacgagtggatcaccgacttccccggcaagaccgtgtggttcgtccccagcatcaagtccgggaacgacatcgccaactgcctccggaagaacggcaagcgcgtgatccagctgagccggaagacgttcgacaccgagtaccagaagaccaagaacaacgactgggactacgtggtcaccacggacatctccgagatgggggccaacttccgcgcggaccgggtgatcgacccgcgccggtgcctgaagcccgtgatcctcaaggacggccccgagcgcgtcatcctggccgggcccatgccggtgaccgtcgccagcgccgcccagcggcgcggccggatcggccgcaaccacaacaaggagggggaccagtacatctacatgggccagcccctgaacaacgacgaggaccacgcgcactggaccgaggccaagatgctcctggacaacatcaacacccccgaggggatcatccccgccctgttcgagccggagcgcgagaagtccgccgccatcgacggcgagtaccggctccgcggggaggcgcggaagacgttcgtggagctgatgcgccggggcgacctgcccgtgtggctcagctacaaggtcgcctccgagggcttccagtacagcgaccgccggtggtgcttcgacggggagcgcaacaaccaggtgctggaggagaacatggacgtggagatctggaccaaggagggcgagcggaagaagctgcgcccccggtggctcgacgcccgcacctacagcgaccccctggccctgcgggagttcaaggagttcgccgcggggcgccggtccgtcagcggcgacctcatcctggagatcggcaagctgccgcagcacctcacccagcgcgcccagaacgccctggacaacctggtgatgctccacaactccgagcagggcgggcgggcctaccgccacgcgatggaggagctgcccgacacgatcgagaccctgatgctcctggccctgatcgccgtgctcaccgggggcgtcaccctgttcttcctgagcgggcggggcctcggcaagacctccatcgggctgctgtgcgtgatggccagctccgtgctcctgtggatggccagcgtcgagccccactggatcgcggcctccatcatcctggagttcttcctcatggtgctgctgatccccgagccggaccgccagcggacgccccaggacaaccagctcgcctacgtggtcatcggcctgctgttcatgatcctcaccgtggccgccaacgagatggggctgctggagaccaccaagaaggacctcggcatcgggcacgtggcggtcgagaaccaccaccacgccgccatgctggacgtggacctgcaccccgccagcgcctggacgctctacgcggtggccaccaccatcatcaccccgatgatgcgccacacgatcgagaacaccaccgccaacatctccctgaccgccatcgccaaccaggcggccatcctgatgggcctcgacaagggctggcccatcagcaagatggacatcggggtccccctgctggccctcggctgctactcccaggtgaaccccctgacgctgaccgccgcggtgctcatgctggtcgcccactacgccatcatcgggccgggcctgcaggccaaggccacccgcgaggcgcagaagcggaccgccgccgggatcatgaagaaccccacggtggacggcatcgtggccatcgacctcgaccccgtcgtgtacgacgccaagttcgagaagcagctgggccagatcatgctgctcatcctgtgcaccagccagatcctgctcatgcgcaccacctgggcgctgtgcgagtccatcacgctggccaccgggcccctcaccaccctgtgggagggcagcccggggaagttctggaacacgaccatcgccgtgtccatggccaacatcttccggggcagctacctggccggcgcggggctcgccttctccctgatgaagtccctgggcgggggccgccgggggaccggcgcccagggcgagaccctcggggagaagtggaagcgccagctgaaccagctgagcaagtccgagttcaacacgtacaagcggagcggcatcatggaggtcgaccgctccgaggccaaggaggggctcaagcggggcgagaccaccaagcacgcggtgagccgcgggaccgccaagctgcggtggttcgtggagcgcaacctggtcaagcccgagggcaaggtgatcgacctgggctgcgggcggggcgggtggtcctactactgcgccggcctcaagaaggtgacggaggtcaaggggtacaccaagggcggccccgggcacgaggagcccatcccgatggccacctacggctggaacctggtgaagctgcacagcgggaaggacgtgttcttcatcccgcccgagaagtgcgacaccctcctgtgcgacatcggcgagtccagccccaacccgacgatcgaggaggggcgcaccctgcgggtcctcaagatggtggagccctggctgcgcggcaaccagttctgcatcaagatcctgaacccctacatgccctccgtggtcgagaccctcgagcagatgcagcggaagcacggcgggatgctggtgcgcaacccgctgagccggaactccacccacgagatgtactgggtgagctgcggcaccgggaacatcgtctccgccgtgaacatgacgagccgcatgctcctgaaccgcttcaccatggcgcaccggaagcccacctacgagcgcgacgtggacctgggcgccggcacccggcacgtcgccgtggagcccgaggtggccaacctcgacatcatcgggcagcgcatcgagaacatcaagcacgagcacaagtccacgtggcactacgacgaggacaacccctacaagacctgggcctaccacggcagctacgaggtcaagccgtccgggagcgcgtccagcatggtgaacggcgtcgtgaagctgctgaccaagccctgggacgtgatccccatggtcacccagatcgccatgacggacaccacccccttcgggcagcagcgggtgttcaaggagaaggtggacacccgcacgccgaaggccaagcggggcaccgcccagatcatggaggtcaccgccaagtggctctggggcttcctgagccgcaacaagaagccccggatctgcacccgcgaggagttcacgcggaaggtgcgctccaacgcggccatcggggccgtgttcgtcgacgagaaccagtggaacagcgccaaggaggcggtggaggacgagcggttctgggacctggtgcaccgcgagcgggagctccacaagcagggcaagtgcgcgacctgcgtctacaacatgatggggaagcgcgagaagaagctgggcgagttcgggaaggccaagggctcccgggccatctggtacatgtggctgggcgcccgcttcctcgagttcgaggcgctggggttcatgaacgaggaccactggttcagccgggagaactccctgagcggcgtggagggggagggcctccacaagctggggtacatcctgcgcgacatctccaacatccccggcggcaacatgtacgccgacgacaccgccgggtgggacacccggatcacggaggacgacctccagaacgaggcccgcatcaccgacatcatggagccggagcacgccctgctggccaagagcatcttcaagctcacctaccagaacaaggtggtccgcgtgcagcggcccgccaagaacggcaccgtgatggacgtcatctcccgccgggaccagcgcgggagcggccaggtgggcacgtacgggctgaacaccttcaccaacatggaggcccagctgatccggcagatggagtccgagggcatcttcagcccctccgagctcgagacccccaacctggccgagcgcgtgctggactggctcgagaagtacggggtcgagcggctgaagcgcatggccatcagcggcgacgactgcgtggtgaagccgatcgacgaccggttcgcgacggccctgaccgccctcaacgacatggggaaggtccgcaaggacatcccccagtgggagccctccaagggctggaacgactggcagcaggtccccttctgcagccaccacttccaccagctgatcatgaaggacggccgggagatcgtggtcccgtgccgcaaccaggacgagctggtggggcgggcccgcgtgtcccagggcgccgggtggagcctccgggagaccgcgtgcctgggcaagagctacgcccagatgtggcagctgatgtacttccaccgccgggacctccgcctggccgccaacgcgatctgctccgccgtccccgtggactggatccccaccagccggacgacctggtccatccacgcccaccaccagtggatgaccaccgaggacatgctgagcgtgtggaaccgcgtctggatcgaggagaacccctggatggaggacaagacgcacatctccagctggggcgacgtgccgtacctcggcaagcgcgaggaccagtggtgcggctccctgatcgggctgaccgcccgggccacctgggcgaccaacatccaggtggccatcaaccaggtccgccggctcatcggcaacgagaactacctggactacatgaccagcatgaagcgcttcaagaacgagtccgaccccgagggggccctgtggtga

SEQ ID NO: 8432 - RNA, 9879 nt, synthetic construct
  misc_feature 1..9879: note = derived and/or modified CDS sequence (opt1) from DENV-1__FJ410266__SS-prME
  source 1..9879: mol_type = other RNA
agcgtgaccatgctgctcatgctgatgcccaccgccctggccttccacctcaccacccgcggcggggagccccacatgatcgtgaccaagcaggagcggggcaagagcctgctgttcaagaccagcgcgggggtgaacatgtgcaccctcatcgccatggacctgggcgagctgtgcgaggacaccatgacctacaagtgcccccggatcaccgaggccgagcccgacgacgtggactgctggtgcaacgccacggacacctgggtgacctacgggacctgcagccagacgggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtggggaagctggtccaccagatcttcggcaccgcctacggggtgctgttctccggcgtgagctggaccatgaagatcgggatcggcgtcctgctgacgtggctcggcctgaactcccgcagcacctccctgagcatgacctgcatcgccgtggggctcgtgaccctgtacctgggcgtcatggtgcaggccgactccgggtgcgtgatcaactggaagggccgggagctcaagtgcgggagcggcatcttcgtcacgaacgaggtgcacacctggaccgagcagtacaagttccaggcggacagcccgaagcgcctgtccgccgccatcggcaaggcctgggaggagggggtgtgcggcatccggagcgccacccgcctggagaacatcatgtggaagcagatctccaacgagctcaaccacatcctgctggagaacgacatgaagttcaccgtcgtggtgggggacgtcgtgggcatcctcgcgcaggggaagaagatgatccggccccagcccatggagcacaagtacagctggaagtcctggggcaaggccaagatcatcggcgccgacgtgcagaacacgaccttcatcatcgacgggcccaacaccccggagtgccccgacgaccagcgcgcctggaacatctgggaggtcgaggactacggcttcgggatcttcaccacgaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacctgcatctggcccaagtcccacacgctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcaccacggtggtcgtggacgagcactgcggcaaccgggggccgtccctgcgcaccaccaccgtgacgggcaagatcatccacgagtggtgctgccggagctgcaccctgccgcccctccgcttcaagggggaggacggctgctggtacgggatggagatccggcccgtcaaggagaaggaggagaacctggtgaagtccatggtgagcgccggcagcggcgaggtcgactccttcagcctcgggctgctgtgcatctccatcatgatcgaggaggtgatgcgcagccggtggtccaagaagatgctcatgaccggcaccctggccgtgttcctgctcctgatcatggggcagctgacgtggaacgacctcatccgcctgtgcatcatggtcggcgccaacgcgagcgaccggatggggatgggcaccacctacctggccctcatcgccaccttcaagatgcgcccgatgttcgccgtgggcctgctgttccgccggctcacgtcccgcgaggtgctgctgctcaccatcgggctgagcctggtcgcctccgtggagctccccaacagcctggaggagctgggcgacgggctcgcgatgggcatcatgatcctgaagctgctcaccgacttccagtcccaccagctgtgggccaccctgctcagcttcacgttcatcaagaccaccctgtccctgcactacgcctggaagaccatggccatggtcctcagcatcgtgtccctgttccccctgtgcctcagcacgacctcccagaagaccacctggctgcccgtgctgctcggcagcctggggtgcaagccgctgacgatgttcctcatcgcggagaacaagatctggggccggaagtcctggcccctgaacgaggggatcatggccgtcggcgtggtgagcatcctgctcagctccctgctgaagaacgacgtccccctcgccgggcccctgatcgccggcggcatgctgatcgcctgctacgtgatcagcgggtccagcgcggacctctccctggagaaggccgccgaggtgagctgggaggaggaggccgagcactccggcgccagccacaacatcctggtcgaggtgcaggacgacgggaccatgaagatcaaggacgaggagcgcgacgacaccctcaccatcctgctgaaggcgaccctcctggccgtgtccggcgtctacccgctgagcatccccgccaccctcttcgtgtggcacttctggcagaagaagaagcagcggtccggggtgctgtgggacacccccagcccgcccgaggtcgagcgcgccgtgctggacgacggcatctaccggatcatgcagcgcggcctgctcgggcggtcccaggtgggcgtcggggtgttccaggagaacgtgttccacaccatgtggcacgtcacccgcggcgccgtgctgatgtaccaggggaagcggctggagcccagctgggcgtccgtgaagaaggacctcatcagctacggcggcgggtggcgcctgcagggctcctggaacacgggggaggaggtccaggtgatcgccgtggagcccggcaagaaccccaagaacgtccagaccgcccccgggaccttcaagacccccgagggcgaggtgggcgccatcgccctggacttcaagcccgggacgagcggctcccccatcgtgaaccgggaggggaagatcgtcggcctctacggcaacggggtggtgaccaccagcggcacctacgtcagcgcgatcgcccaggccaaggcctcccaggaggggccgctgcccgagatcgaggacgaggtgttccgcaagcggaacctgacgatcatggacctccaccccggcagcgggaagacccgccggtacctgccggcgatcgtgcgcgaggccatcaagcggaagctgcgcaccctcatcctggcccccacccgggtcgtggcctccgagatggccgaggcgctgaagggcatgcccatccgctaccagacgaccgccgtcaagagcgagcacaccggcaaggagatcgtcgacctcatgtgccacgccaccttcacgatgcgcctgctgtcccccgtgcgggtgccgaactacaacatgatcatcatggacgaggcccacttcaccgaccccagctccatcgccgcgcgcgggtacatcagcacccgggtcggcatgggggaggccgccgccatcttcatgaccgccacgccgcccggctccgtggaggcgttcccgcagagcaacgccgtgatccaggacgaggagcgcgacatccccgagcggtcctggaacagcgggtacgagtggatcaccgacttccccggcaagaccgtctggttcgtgccctccatcaagagcggcaacgacatcgccaactgcctccgcaagaacgggaagcgggtgatccagctgtcccgcaagaccttcgacacggagtaccagaagaccaagaacaacgactgggactacgtcgtgaccaccgacatcagcgagatgggcgccaacttccgggcggaccgcgtgatcgacccgcggcgctgcctgaagcccgtcatcctcaaggacgggcccgagcgggtgatcctggccggccccatgccggtcacggtggcctccgccgcccagcgccgggggcgcatcggccggaaccacaacaaggagggcgaccagtacatctacatggggcagcccctgaacaacgacgaggaccacgcgcactggaccgaggccaagatgctcctggacaacatcaacacccccgagggcatcatccccgccctgttcgagccggagcgcgagaagtccgccgccatcgacggggagtaccggctccgcggcgaggcgcgcaagaccttcgtggagctgatgcggcgcggggacctgcccgtctggctctcctacaaggtggccagcgagggcttccagtacagcgaccggcgctggtgcttcgacggcgagcggaacaaccaggtgctggaggagaacatggacgtcgagatctggacgaaggagggggagcgcaagaagctgcggccccgctggctcgacgcccggacctactccgaccccctggccctgcgcgagttcaaggagttcgccgcgggccggcgcagcgtgtccggggacctcatcctggagatcggcaagctgccgcagcacctcacccagcgggcccagaacgccctggacaacctggtgatgctccacaacagcgagcagggcgggcgcgcctaccggcacgcgatggaggagctgcccgacaccatcgagacgctgatgctcctggccctgatcgccgtcctcaccggcggggtgaccctgttcttcctgtccggccgcgggctcggcaagaccagcatcggcctgctgtgcgtgatggcctccagcgtcctcctgtggatggcctccgtggagccccactggatcgcggccagcatcatcctggagttcttcctcatggtgctgctgatccccgagccggaccggcagcgcacgccccaggacaaccagctcgcctacgtcgtgatcgggctgctgttcatgatcctcacggtggccgccaacgagatgggcctgctggagaccaccaagaaggacctcgggatcggccacgtcgcggtggagaaccaccaccacgccaccatgctggacgtggacctgcaccccgcctccgcctggacgctctacgccgtcgcgaccaccatcatcaccccgatgatgcggcacacgatcgagaacaccaccgccaacatcagcctgaccgccatcgccaaccaggccgcgatcctgatggggctcgacaagggctggcccatctccaagatggacatcggcgtgcccctgctggccctcgggtgctacagccaggtgaaccccctgacgctgaccgccgccgtcctcatgctggtggcgcactacgccatcatcggcccggggctgcaggccaaggccacccgcgaggcccagaagcggaccgcggccggcatcatgaagaaccccacggtggacgggatcgtcgccatcgacctcgaccccgtggtgtacgacgccaagttcgagaagcagctgggccagatcatgctgctcatcctgtgcacctcccagatcctgctcatgcgcaccacctgggccctgtgcgagagcatcacgctggcgaccggccccctcaccaccctgtgggaggggtccccgggcaagttctggaacacgaccatcgccgtcagcatggccaacatcttccgcgggtcctacctggccggcgccggcctcgcgttcagcctgatgaagtccctcgggggcgggcggcgcgggaccggggcccagggcgagaccctcggcgagaagtggaagcggcagctgaaccagctgtccaagagcgagttcaacacgtacaagcgctccgggatcatggaggtggaccggagcgaggccaaggagggcctcaagcgcggggagaccacccggcacgccgtgtcccgcggcaccgcgaagctgcggtggttcgtcgagcgcaacctggtgaagcccgaggggaaggtgatcgacctgggctgcggccgcggcgggtggagctactactgcgccgggctcaagaaggtcacggaggtgaaggggtacaccaagggcgggcccggccacgaggagcccatcccgatggccacctacgggtggaacctggtgaagctgcactccggcaaggacgtcttcttcacgccgcccgagaagtgcgacacgctcctgtgcgacatcggggagagctcccccaacccgaccatcgaggagggccgcaccctgcgggtgctcaagatggtggagccctggctgcgcgggaaccagttctgcatcaagatcctgaacccctacatgcccagcgtcgtggagaccctcgagcagatgcagcggaagcacggcggcatgctggtgcgcaacccgctgtcccggaacagcacccacgagatgtactgggtctcctgcgggacgggcaacatcgtgagcgccgtgaacatgacctcccgcatgctcctgaaccggttcaccatggcccaccgcaagcccacctacgagcgcgacgtcgacctgggggcgggcacgcggcacgtggccgtggagcccgaggtcgccaacctcgacatcatcggccagcgcatcgagaacatcaagcacgagcacaagagcacctggcactacgacgaggacaacccctacaagacctgggcctaccacgggtcctacgaggtgaagccgagcggctccgccagcagcatggtcaacggggtggtgaagctgctgaccaagccctgggacgtcatccccatggtgacgcagatcgcgatgaccgacaccacccccttcggccagcagcgggtgttcaaggagaaggtcgacacgcgcaccccgaaggccaagcgggggaccgcccagatcatggaggtgaccgccaagtggctctggggcttcctgtcccgcaacaagaagccccggatctgcacgcgcgaggagttcacccggaaggtgcgcagcaacgccgcgatcggcgccgtcttcgtggacgagaaccagtggaactccgccaaggaggccgtggaggacgagcggttctgggacctggtccagaaggagcgcgagctccacaagcaggggaagtgcgcgacctgcgtgtacaacatgatgggcaagcgggagaagaagctgggggagttcggcaaggccaaggggagccgcgccatctggtacatgtggctgggcgcccggttcctcgagttcgaggccctgggcttcatgaacgaggaccactggttctcccgcgagaacagcctgtccggggtggagggcgaggggctccacaagctgggctacatcctgcgggacatcagcaagatccccgggggcaacatgtacgcggacgacaccgccggctgggacacgcgcatcaccgaggacgacctccagaacgaggccaagatcaccgacatcatggagccggagcacgccctgctggccacctccatcttcaagctcacgtaccagaacaaggtcgtgcgggtgcagcgccccgcgaagaacgggaccgtcatggacgtgatcagccggcgcgaccagcgcggctccggccaggtgggcacctacggcctgaacaccttcacgaacatggaggcccagctgatccggcagatggagagcgaggggatcttcctccccggcgagctggagacccccaacctggccgagcgcgtcctcgactggctggagaagtacggggtggagcggctgaagcgcatggccatctccggcgacgactgcgtggtcaagccgatcgacgaccggttcgccaccgcgctcaccgccctgaacgacatggggaaggtgcgcaaggacatcccccagtgggagcccagcaagggctggaacgactggcagcaggtccccttctgctcccaccacttccaccagctgatcatgaaggacggccgggagatcgtcgtgccgtgccgcaaccaggacgagctcgtggggcgggcccgcgtcagccagggcgccgggtggtccctgcgggagacggcctgcctgggcaagagctacgcgcagatgtggcagctcatgtacttccaccgccgggacctgcgcctggccgccaacgccatctgcagcgcggtgcccgtggactgggtccccacctcccggaccacctggagcatccacgcccaccaccagtggatgacgaccgaggacatgctctccgtgtggaaccgcgtgtggatcgaggagaacccctggatggaggacaagacccacgtcagctcctggggcgacgtgccgtacctgggcaagcgggaggaccagtggtgcggcagcctgatcgggctcaccgcccgcgccacctgggcctccaacatccaggtggcgatcaaccaggtccggcgcctgatcggcaacgagaactacctggactacatgacgagcatgaagcgcttcaagaacgagggggaccccgagggcgccctctggtga

SEQ ID NO: 8433 - RNA, 9879 nt, synthetic construct
  misc_feature 1..9879: note = derived and/or modified CDS sequence (opt1) from DENV-1__FJ410269__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgcgggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtgacctacgggacctgcagccagaccggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcatccagaacggccggctgatcacggccaacccgatcgtgaccgacaaggagaagcccgtgaacatcgaggccgagccgcccttcggggagtcctacatcgtcatcggcgtgggcgagaaggcgctgaagctcagctggttcaagaaggggtccagcatcggcaagatgttcgaggccaccgcccgcggggcccggcgcatggccatcctgggcgacaccgcgtgggacttcgggtccatcggcggcgtgttcacgagcgtcgggaagctggtgcaccagatcttcggcaccgcctacggggtgctgttctccggcgtcagctggaccatgaagatcgggatcggcgtgctgctgacctggctcggcctgaactcccgcagcacgtccctgagcatgacctgcatcgccgtggggctcgtcaccctgtacctgggcgtgatggtgcaggccgactccgggtgcgtcatcaactggaagggccgggagctcaagtgcgggagcggcatcttcgtgaccaacgaggtgcacacgtggaccgagcagtacaagttccaggccgacagcccgaagcgcctgtccgcggccatcggcaaggcctgggaggagggggtctgcggcatccggagcgtgacccgcctggagaacatcatgtggaagcagatctccaacgagctcaaccacatcctgctggagaacgacatgaagttcaccgtggtcgtgggggacgtggtcggcatcctcgcccaggggaagaagatgatccggccccagcccatggagcacaagtacagctggaagtcctggggcaaggccaagatcatcggcgcggacgtgcagaacaccacgttcatcatcgacgggcccaacaccccggagtgccccgacgaccagcgcgcctggaacatctgggaggtggaggactacggcttcgggatcttcaccaccaacatctggctgaagctgcgggacagctacacgcaggcctgcgaccaccgcctcatgtccgccgcgatcaaggacagcaaggccgtccacgccgacatgggctactggatcgagtccgagaagaacgagacctggaagctggcccgggccagcttcatcgaggtgaagacctgcatctggcccaagtcccacaccctgtggagcaacggcgtgctcgagtccgagatggtcatccccaagatctacgggggcccgatcagccagcacaactaccgccccgggtacttcacgcagaccgcgggcccctggcacctggggaagctggagctcgacttcgacctgtgcgagggcaccaccgtggtggtcgacgagcactgcggcaaccgggggccgtccctgcgcacgaccaccgtgaccggcaagatcatccacgagtggtgctgccggagctgcacgctgccgcccctccgcttcaagggggaggacggctgctggtacgggatggagatccggcccgtgaaggagaaggaggagaacctggtcaagtccatggtgagcgccggcagcggcgaggtggactccttcagcctcgggctgctgtgcatctccatcatgatcgaggaggtcatgcgcagccggtggtcccgcaagatgctcatgaccggcaccctggccgtgttcctgctcctgatcatggggcagctgacctggaacgacctcatccggctgtgcatcatggtgggcgccaacgccagcgaccgcatggggatgggcacgacctacctggcgctcatggccaccttcaagatgcgcccgatgttcgccgtcgggctgctgttccggcgcctcacctcccgggaggtgctgctgctcacgatcgggctgagcctggtcgcctccgtggagatccccaacagcctcgaggagctgggcgacgggctggccatgggcatcatgatcctcaagctgctgaccgacttccagtcccaccagctctgggcgaccctgctgagcctcaccttcatcaagacgaccctgtccctgcactacgcctggaagaccatggccatggtgctcagcatcgtctccctgttccccctgtgcctcagcaccacgtcccagaagaccacctggctgcccgtgctgctcggcagcctggggtgcaagccgctgaccatgttcctcatcgccgagaacaagatctggggccgcaagtcctggcccctgaacgaggggatcatggcggtgggcgtcgtgagcatcctgctcagctccctgctgaagaacgacgtgcccctcgccgggcccctgatcgccggcggcatgctgatcgcctgctacgtcatcagcgggtccagcgccgacctctccctggagaaggcggccgaggtgagctgggaggaggaggccgagcactccggcgccagccacaacatcctggtggaggtccaggacgacgggacgatgaagatcaaggacgaggagcgggacgacaccctcaccatcctgctgaaggccaccctcctggcggtgtccggcgtgtacccgctgagcatccccgccaccctcttcgtctggtacttctggcagaagaagaagcagcgctccggggtgctgtgggacacgcccagcccgcccgaggtggagcgggccgtcctggacgacggcatctaccgcatcatgcagcggggcctgctcgggcgctcccaggtgggcgtgggggtcttccaggagaacgtgttccacaccatgtggcacgtgacccggggcgccgtcctgatgtaccaggggaagcgcctggagcccagctgggcctccgtgaagaaggacctcatcagctacggcggcgggtggcggctgcagggctcctggaacaccggggaggaggtgcaggtcatcgcggtggagcccggcaagaaccccaagaacgtgcagacggcccccgggaccttcaagacccccgagggcgaggtcggcgccatcgccctggacttcaagcccgggaccagcggctcccccatcgtgaaccgcgaggggaagatcgtgggcctctacggcaacggggtcgtgacgaccagcggcacctacgtgagcgccatcgcgcaggccaaggcctcccaggaggggccgctgcccgagatcgaggacgaggtcttccggaagcgcaacctgaccatcatggacctccaccccggcagcgggaagacgcggcgctacctgccggccatcgtgcgggaggcgatcaagcgcaagctgcggaccctcatcctggcccccacccgcgtggtcgcctccgagatggccgaggccctgaagggcatgcccatccgctaccagaccacggcggtcaagagcgagcacaccggcaaggagatcgtggacctcatgtgccacgccaccttcaccatgcggctgctgtcccccgtccgcgtgccgaactacaacatgatcatcatggacgaggcccacttcacggaccccagctccatcgccgcccgggggtacatcagcacccgcgtgggcatgggggaggcggccgccatcttcatgaccgccacgccgcccggctccgtcgaggccttcccgcagagcaacgcggtgatccaggacgaggagcgggacatccccgagcgctcctggaacagcgggtacgagtggatcacggacttccccggcaagaccgtgtggttcgtcccctccatcaagagcggcaacgacatcgccaactgcctccggaagaacgggaagcgcgtgatccagctgtcccggaagaccttcgacaccgagtaccagaagacgaagaacaacgactgggactacgtggtcaccaccgacatcagcgagatgggcgccaacttccgcgccgaccgggtgatcgacccgcgccggtgcctgaagcccgtcatcctcaaggacgggcccgagcgcgtgatcctggcgggccccatgccggtgaccgtcgcctccgccgcccagcggcgcgggcggatcggccgcaaccacaacaaggagggcgaccagtacatctacatggggcagcccctgaacaacgacgaggaccacgcccactggacggaggcgaagatgctcctggacaacatcaacacccccgagggcatcatccccgccctgttcgagccggagcgggagaagtccgccgccatcgacggggagtaccgcctccgcggcgaggcccggaagaccttcgtggagctgatgcgccgcggggacctgcccgtgtggctctcctacaaggtcgcgagcgagggcttccagtacagcgaccgccggtggtgcttcgacggcgagcgcaacaaccaggtgctggaggagaacatggacgtggagatctggaccaaggagggggagcggaagaagctgcgcccccggtggctcgacgcccgcacgtactccgaccccctggccctgcgggagttcaaggagttcgccgccggccgccggagcgtctccggggacctcatcctggagatcggcaagctgccgcagcacctcacccagcgcgcgcagaacgccctggacaacctggtgatgctccacaacagcgagcagggcgggcgggcctaccgccacgccatggaggagctgcccgacaccatcgagaccctgatgctcctggcgctgatcgccgtgctcacgggcggggtcaccctgttcttcctgtccggccgggggctcggcaagaccagcatcggcctgctgtgcgtgatggcctccagcgtgctcctgtggatggcctccgtcgagccccactggatcgccgcgagcatcatcctggagttcttcctcatggtgctgctgatccccgagccggaccgccagcggacgccccaggacaaccagctcgcctacgtggtcatcgggctgctgttcatgatcctcaccgtggccgccaacgagatgggcctgctggagacgaccaagaaggacctcgggatcggccacgtggccgtcgagaaccaccaccacgcgaccatgctggacgtggacctgcaccccgcctccgcctggaccctctacgccgtggccacgaccatcatcaccccgatgatgcgccacaccatcgagaacacgaccgcgaacatcagcctgaccgccatcgccaaccaggccgccatcctgatggggctcgacaagggctggcccatctccaagatggacatcggcgtccccctgctggcgctcgggtgctacagccaggtgaaccccctgaccctgacggccgccgtgctcatgctggtcgcccactacgcgatcatcggcccggggctgcaggccaaggccacccgggaggcccagaagcgcaccgccgcgggcatcatgaagaaccccaccgtggacgggatcgtggccatcgacctcgaccccgtcgtgtacgacgccaagttcgagaagcagctgggccagatcatgctgctcatcctgtgcacgtcccagatcctgctcatgcgcaccacctgggccctgtgcgagagcatcaccctggccacgggccccctcaccaccctgtgggaggggtccccgggcaagttctggaacaccacgatcgcggtgagcatggccaacatcttccgggggtcctacctggccggcgccggcctcgccttcagcctgatgaagtccctcgggggcgggcgccgggggaccggggcgcagggcgagaccctcggcgagaagtggaagcgccagctgaaccagctgtccaagagcgagttcaacatctacaagcggtccgggatcatggaggtcgaccgcagcgaggccaaggagggcctcaagcgcggggagaccacgcgccacgccgtgtcccggggcaccgccaagctgcgctggttcgtggagcggaacctggtcaagcccgaggggaaggtgatcgacctgggctgcggccgcgggggctggagctactactgcgcggggctcaagaaggtgaccgaggtcaagggctacaccaagggcgggcccggccacgaggagcccatcccgatggccacgtacgggtggaacctggtgaagctgcactccggcaaggacgtgttcttcacgccgcccgagaagtgcgacaccctcctgtgcgacatcggggagagctcccccaacccgaccatcgaggagggccggacgctgcgcgtcctcaagatggtggagccctggctgcgggggaaccagttctgcatcaagatcctgaacccctacatgcccagcgtggtcgagaccctcgagcagatgcagcgcaagcacggcggcatgctggtgcggaacccgctgtcccgcaacagcacccacgagatgtactgggtgtcctgcgggaccggcaacatcgtcagcgccgtgaacatgacctcccggatgctcctgaaccgcttcacgatggcccaccgcaagcccacctacgagcgggacgtggacctgggggccggcacccgccacgtcgcggtggagcccgaggtcgccaacctcgacatcatcggccagcggatcgagaacatcaagcacgagcacaagagcacctggcactacgacgaggacaacccctacaagacgtgggcctaccacgggtcctacgaggtgaagccgagcggctccgccagcagcatggtgaacggggtcgtgaagctgctgaccaagccctgggacgtgatccccatggtcacccagatcgccatgaccgacacgacccccttcggccagcagcgcgtgttcaaggagaaggtggacacccggaccccgaaggcgaagcgcgggacggcccagatcatggaggtcaccgcccggtggctctggggcttcctgtcccgcaacaagaagccccggatctgcacccgcgaggagttcacccggaaggtgcgcagcaacgccgccatcggcgcggtgttcgtcgacgagaaccagtggaactccgccaaggaggccgtggaggacgagcggttctgggacctggtgcagaaggagcgcgagctccacaagcaggggaagtgcgccacgtgcgtctacaacatgatgggcaagcgggagaagaagctgggggagttcggcaaggcgaaggggagccgcgccatctggtacatgtggctgggcgcccggttcctcgagttcgaggccctgggcttcatgaacgaggaccactggttctcccgcgagaacagcctgtccggggtggagggcgaggggctccacaagctgggctacatcctgcgggacatcagcaagatccccgggggcaacatgtacgccgacgacaccgcgggctgggacacccgcatcaccgaggacgacctccagaacgaggccaagatcacggacatcatggagccggagcacgccctgctggccacctccatcttcaagctcacctaccagaacaaggtggtccgggtgcagcgccccgccaagaacgggaccgtgatggacgtcatcagccgccgggaccagcgcggctccggccaggtgggcacgtacggcctgaacaccttcaccaacatggaggcgcagctgatccggcagatggagagcgaggggatcttcctcccctccgagctggagacccccaacctggccgagcgcgtgctcgactggctggagaagcacggcgtcgagcggctgaagcgcatggccatcagcggggacgactgcgtggtgaagccgatcgacgaccggttcgccacggccctcaccgcgctgaacgacatgggcaaggtccgcaaggacatcccccagtgggagccctccaaggggtggaacgactggcagcaggtccccttctgcagccaccacttccaccagctgatcatgaaggacggccgggagatcgtggtcccgtgccgcaaccaggacgagctcgtgggccgggcccgcgtgtcccagggggccggctggagcctgcgggagaccgcctgcctgggcaagagctacgcccagatgtggcagctcatgtacttccaccgccgggacctgcgcctggcggccaacgccatctgctccgccgtccccgtggactgggtgcccaccagccggacgacctggtccatccacgcgcaccaccagtggatgaccaccgaggacatgctcagcgtctggaaccgcgtgtggatcgaggagaacccctggatggaggacaagacgcacgtgtccagctggggcgacgtcccgtacctggggaagcgggaggaccagtggtgcggctccctgatcggcctcaccgcccgcgccacctgggccagcaacatccaggtggccatcaaccaggtgcgccggctgatcgggaacgagaactacctggactacatgacctccatgaagcgcttcaagaacgagggcgaccccgagggggcgctctggtga

SEQ ID NO: 8434 - RNA, 9879 nt, synthetic construct
  misc_feature 1..9879: note = derived and/or modified CDS sequence (opt1) from DENV-1__FJ410273__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagaccagcgcgggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctcgcgccccacgtgggcctggggctggagacgcgcaccgagacctggatgagctccgagggcgcctggaagcagatccagcgggtggagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctcaccgactacggggccctgaccctggactgcagcccccggaccggcctcgacttcaacgagatggtcctgctgacgatgaaggagaagtcctggctcgtgcacaagcagtggttcctggacctgccgctcccctggaccagcggggcctccaccagccaggagacctggaaccggcaggacctgctggtgacgttcaagaccgcccacgcgaagaagcaggaggtcgtggtgctcggctcccaggagggcgccatgcacaccgccctgaccggggccacggagatccagaccagcggcaccaccacgatcttcgccgggcacctgaagtgccgcctcaagatggacaagctgaccctgaagggcatgtcctacgtcatgtgcaccgggagcttcaagctcgagaaggaggtggcggagacccagcacggcacggtgctggtccagatcaagtacgagggcaccgacgccccctgcaagatccccttctccacccaggacgagaagggggtgacccagaacggccggctgatcacggccaacccgatcgtgaccgacaaggagaagcccgtcaacatcgaggccgagccgcccttcggggagagctacatcgtgatcggcgcgggcgagaaggccctgaagctctcctggttcaagaaggggagctccatcggcaagatgttcgtggccaccgcccgcggggcccggcgcatggcgatcctgggcgacaccgcctgggacttcgggagcatcggcggcgtcttcacgtccgtggggaagctggtgcaccagatcttcggcaccgcctacggggtcctcttcagcggcgtgtcctggaccatgaagatcgggatcggcgtgctgctgacctggctcggcctgaacagccgctccacgagcctgtccatgacctgcatcgccgtcgggctcgtgaccctgtacctgggcgtgatggtccaggccgacagcgggtgcgtgatcaactggaagggccgggagctcaagtgcgggagcggcatcttcgtgaccaacgaggtccacacgtggaccgagcagtacaagttccaggcggactccccgaagcgcctgagcgccgccatcggcaaggcctgggaggagggggtgtgcggcatccggtccgccacccgcctggagaacatcatgtggaagcagatcagcaacgagctcaaccacatcctgctggagaacgacatgaagttcaccgtggtcgtgggggacgtggcgggcatcctcacccaggggaagaagatgatccggccccagcccatggagtacaagtactcctggaagtcctggggcaaggccaagatcatcggcgccgacgtccagaacacgaccttcatcatcgacgggcccaacaccccggagtgccccgacgaccagcgcgcctggaacatctgggaggtggaggactacggcttcgggatcttcaccacgaacatctggctgaagctgcgggactcctacacccaggtgtgcgaccaccgcctcatgagcgcggccatcaaggactccaaggccgtccacgccgacatgggctactggatcgagagcgagaagaacgagacctggaagctggcccgggcgtccttcatcgaggtgaagacctgcatctggcccaagagccacacgctgtggtccaacggcgtgctcgagagcgagatgatcatccccaagatctacgggggcccgatctcccagcacaactaccgccccgggtacttcacccagaccgccggcccctggcacctggggaagctggagctcgacttcaacctgtgcgagggcaccacggtcgtggtggacgagcactgcggcaaccgggggccgagcctgcgcaccaccaccgtcacgggcaagatcatccacgagtggtgctgccggtcctgcaccctgccgcccctccgcttcaagggggaggacggctgctggtacgggatggagatccggcccgtgaaggagaaggaggagaacctggtcaagagcatggtcagcgccggctccggcgaggtggacagcttctccctcgggctgctgtgcatcagcatcatgatcgaggaggtgatgcgctcccggtggagccgcaagatgctcatgaccggcaccctggccgtcttcttcctgctcatcatggggcagctgacgtggaacgacctgatccggctctgcatcatggtgggcgccaacgcgtccgaccgcatggggatgggcaccacctacctggccctgatggccaccttcaagatgcgcccgatgctcgccgtgggcctgctgttccggcgcctcacgagccgggaggtcctgctgctcaccatcgggctgtccctggtggccagcgtcgagctccccaactccctggaggagctgggcgacgggctcgcgatgggcatcatgatcctgaagctgctcaccgacttccagagccaccagctgtgggccaccctgctctccctgacgttcatcaagaccacctacagcctgcactacgcctggaagaccatggccatggtgctctccatcgtgagcctgttccccctgtgcctctccacgaccagccagaagaccacctggctgcccgtcctgctcggctccctggggtgcaagccgctgacgatgttcctcatcgcggagaacaagatctggggccgcaagagctggcccctgaacgaggggatcatggccgtgggcatcgtgagcatcctgctctccagcctgctgaagaacgacgtccccctcgccgggcccctgatcgccggcggcatgctgatcgcctgctacgtgatctccgggagctccgcggacctcagcctggagaaggccgccgaggtgtcctgggaggaggaggccgagcacagcggcgcctcccacaacatcctggtcgaggtgcaggacgacgggaccatgaagatcaaggacgaggagcgggacgacaccctcaccatcctgctgaaggcgaccctcctggccgtgagcggcgtctacccgctgtccatccccgccaccctgttcgtgtggtacttctggcagaagaagaagcagcgcagcggggtgctgtgggacacccccagcccgcccgaggtcgagcgggccgtgctggacgacggcatctaccgcatcatgcagcggggcctgctcgggcgcagccaggtgggcgtcggggtgttccaggagaacgtgttccacaccatgtggcacgtcacccggggcgccgtgctgatgtaccaggggaagcgcctggagccctcctgggcgagcgtgaagaaggacctcatctcctacggcggcgggtggcggctgcagggcagctggaacacgggggaggaggtccaggtgatcgccgtggagcccggcaagaaccccaagaacgtccagaccgcccccgggaccttcaagacctccgagggcgaggtgggcgccatcgccctggacttcaagcccgggacgagcggcagccccatcgtgaaccgcgaggggaagatcgtcggcctctacggcaacggggtggtgaccacctccggcacctacgtcagcgcgatcgcccaggccaaggcctcccaggaggggcccctgccggagatcgagaacgaggtgttccggaagcgcaacctgacgatcatggacctccaccccggcagcgggaagacccggcgctacctgcccgcgatcgtgcgggaggccatcaagcgcaagctgcggaccctcatcctggccccgacccgcgtcgtggcctccgagatggccgaggcgctgaagggcatgcccatccgctaccagacgaccgccgtcaagagcgagcacaccggcaaggagatcgtcgacctcatgtgccacgccaccttcacgatgcggctgctgtcccccgtgcgcgtgcccaactacaacatgatcatcatggacgaggcccacttcaccgacccgagctccatcgccgcgcgggggtacatcagcacccgcgtcggcatgggggaggccgccgccatcttcatgaccgccacgccgcccggctccgtggaggcgttcccccagagcaacgccgtgatccaggacgaggagcgggacatcccggagcgctcctggaacagcgggtacgagtggatcaccgacttccccggcaagaccgtctggttcgtgccctccatcaagagcggcaacgacatcgccaactgcctccggaagaacgggaagcgcgtgatccagctgtcccggaagaccttcgacacggagtaccagaagaccaagaacaacgactgggactacgtcgtgaccaccgacatcagcgagatgggcgccaacttccgcgcggaccgggtgatcgacccccgccggtgcctgaagccggtcatcctcaaggacgggcccgagcgcgtgatcctggccggccccatgcccgtcacggtggcctccgccgcccagcggcgcgggcggatcggccgcaaccacaacaaggagggcgaccagtacatctacatggggcagccgctgaacaacgacgaggaccacgcgcactggaccgaggccaagatgctcctggacaacatcaacacccccgagggcatcatccccgccctgttcgagcccgagcgggagaagtccgccgccatcgacggggagtaccgcctccgcggcgaggcgcggaagaccttcgtggagctgatgcgccgcggggacctgccggtctggctcagctacaaggtggcctccgagggcttccagtacagcgaccgccggtggtgcttcgacggcgagcgcaacaaccaggtgctggaggagaacatggacgtcgagatctggacgaaggagggggagcggaagaagctgcgcccccggtggctcgacgcccgcacctactccgaccccctggccctgcgggagttcaaggagttcgccgcgggccgccggagcgtgtccggggacctcatcctggagatcggcaagctgccccagcacctcacccagcgcgcccagaacgccctggacaacctggtgatgctccacaacagcgagcagggcgggcgggcctaccgccacgcgatggaggagctgccggacaccatcgagacgctgatgctcctggccctgatcgccgtcctcaccggcggggtgaccctgttcttcctgtccggccgggggctcggcaagaccagcatcggcctgctgtgcgtgatggcctccagcgtcctcctgtggatggcctccgtggagccccactggatcgcggccagcatcatcctggagttcttcctcatggtgctgctgatccccgagcccgaccgccagcggaccccgcaggacaaccagctcgcctacgtcgtgatcgggctgctgttcatgatcctcacggtggccgccaacgagatgggcctgctggagaccaccaagaaggacctcgggatcggccacgtcgcggtggagaaccaccaccacgccgccatgctggacgtggacctgcaccccgcctccgcctggaccctctacgcggtcgccacgaccatcatcacccccatgatgcgccacaccatcgagaacacgaccgccaacatcagcctgaccgccatcgccaaccaggcggccatcctgatggggctcgacaagggctggccgatctccaagatggacatcggcgtgcccctgctggccctcgggtgctacagccaggtgaaccccctgaccctgacggccgcggtcctcatgctggtggcccactacgccatcatcggccccgggctgcaggccaaggccacccgggaggcgcagaagcgcaccgccgccggcatcatgaagaacccgaccgtggacgggatcgtcgccatcgacctcgaccccgtggtgtacgacgccaagttcgagaagcagctgggccagatcatgctgctcatcctgtgcacgtcccagatcctgctcatgcgcaccacctgggcgctgtgcgagagcatcaccctggccacgggccccctcaccaccctgtgggaggggtcccccggcaagttctggaacaccacgatcgccgtcagcatggccaacatcttccgggggagctacctggccggcgcgggcctcgccttctccctgatgaagtccctcgggggcgggcgccgggggaccggggcccagggcgagaccctcggcgagaagtggaagcgccagctgaaccagctgtccaagagcgagttcaacacctacaagcggtccgggatcatggaggtggaccgcagcgaggccaaggagggcctcaagcgcggggagacgaccaagcacgcggtgtcccgcggcaccgccaagctgcggtggttcgtcgagcgcaacctggtgaagccggaggggaaggtgatcgacctgggctgcggccgcggcgggtggagctactactgcgccgggctcaagaaggtcaccgaggtgaaggggtacacgaagggcgggcccggccacgaggagcccatccccatggccacctacgggtggaacctggtgaagctgcactccggcaaggacgtcttcttcatcccgcccgagaagtgcgacaccctcctgtgcgacatcggggagagctcccccaaccccaccatcgaggagggccgcacgctgcgggtgctcaagatggtggagccgtggctgcgcgggaaccagttctgcatcaagatcctgaacccctacatgcccagcgtcgtggagaccctcgagcagatgcagcggaagcacggcggcatgctggtgcgcaaccccctgtcccggaacagcacccacgagatgtactgggtctcctgcgggaccggcaacatcgtgagcgccgtgaacatgacctcccgcatgctcctgaaccggttcacgatggcgcaccgcaagccgacctacgagcgcgacgtcgacctgggggccggcacccggcacgtggccgtggagcccgaggtcgccaacctcgacatcatcggccagcgcatcgagaacatcaagcacgagcacaagagcacctggcactacgacgaggacaacccctacaagacgtgggcctaccacgggtcctacgaggtgaagcccagcggcagcgcgtccagcatggtcaacggggtggtgaagctgctgaccaagccgtgggacgtcatccccatggtgacccagatcgccatgaccgacacgacccccttcggccagcagcgggtgttcaaggagaaggtcgacacccgcacccccaaggccaagcgggggacggcccagatcatggaggtgaccgccaagtggctctggggcttcctgtcccgcaacaagaagccgcggatctgcacccgcgaggagttcacccggaaggtgcgcagcaacgcggccatcggcgccgtcttcgtggacgagaaccagtggaactccgccaaggaggcggtggaggacgagcggttctgggacctggtccaccgcgagcgggagctccacaagcaggggaagtgcgccacgtgcgtgtacaacatgatgggcaagcgcgagaagaagctgggggagttcggcaaggccaaggggagccgggccatctggtacatgtggctgggcgcccgcttcctcgagttcgaggcgctgggcttcatgaacgaggaccactggttctcccgggagaacagcctgtccggggtggagggcgaggggctccacaagctgggctacatcctgcgcgacatcagcaagatccccgggggcaacatgtacgccgacgacaccgccggctgggacacccggatcaccgaggacgacctccagaacgaggccaagatcacggacatcatggagcccgagcacgccctgctggcgaagtccatcttcaagctcacctaccagaacaaggtcgtgcgcgtgcagcggccggccaagaacgggaccgtcatggacgtgatcagccgccgcgaccagcggggctccggccaggtgggcacctacggcctgaacacgttcaccaacatggaggcccagctgatccgccagatggagagcgaggggatcttctcccccagcgagctcgagacccccaacctggccggccgggtcctggactggctcgagaagcacggggtggagcgcctgaagcggatggccatctccggcgacgactgcgtggtcaagcccatcgacgaccgcttcgcgaccgccctgacggccctcaacgacatggggaaggtgcggaaggacatcccgcagtgggagcccagcaagggctggaacgactggcagcaggtccccttctgcagccaccacttccaccagctgatcatgaaggacggccgcgagatcgtcgtgccctgccggaaccaggacgagctggtggggcgcgcccgggtctcccagggcgccgggtggagcctccgcgagaccgcgtgcctgggcaagtcctacgcccagatgtggcagctgatgtacttccaccggcgcgacctccggctggccgccaacgcgatctgcagcgccgtgccggtggactgggtccccacctcccgcaccacgtggagcatccacgcccaccaccagtggatgaccaccgaggacatgctgtccgtgtggaaccgggtgtggatcgaggagaacccctggatggaggacaagacccacatcagctcctggggcgacgtcccctacctcggcaagcgcgaggaccagtggtgcggcagcctgatcgggctgacggcccgggccacctgggcgaccaacatccaggtggccatcaaccaggtgcgccgcctcatcggcaacgagaactacctggactacatgacctccatgaagcggttcaagaacgagagcgacccggagggggccctgtggtga

SEQ ID NO: 8435 - RNA, 9879 nt, synthetic construct
  misc_feature 1..9879: note = derived and/or modified CDS sequence (opt1) from DENV-1__FJ410276__SS-prME
  source 1..9879: mol_type = other RNA
agcgtgaccatgttcctgatgctgatgcccaccgccctggccttccacctgaccacccggggcggggagccccacatgatcgtgagcaagcaggagcggggcaagagcctcctgttcaagacctccgccggggtgaacatgtgcaccctgatcgccatggacctcggcgagctgtgcgaggacaccatgacctacaagtgcccccgcatcaccgagaccgagcccgacgacgtggactgctggtgcaacgccacggacacctgggtcacctacgggacctgcagccagacgggcgagcaccggcgcgacaagcggtccgtggccctggcgccccacgtgggcctcgggctggagacccgcaccgagacctggatgagctccgagggcgcgtggaagcagatccagcgggtcgagacgtgggccctgcgccaccccgggttcaccgtgatcgccctcttcctggcccacgcgatcggcaccagcatcacccagaaggggatcatcttcatcctgctcatgctggtgacgccctccatggccatgcggtgcgtcggcatcggcagccgcgacttcgtggaggggctgtccggcgccacctgggtggacgtcgtgctcgagcacgggagctgcgtgaccaccatggccaaggacaagcccacgctggacatcgagctgctcaagaccgaggtcaccaaccccgccgtgctgcggaagctgtgcatcgaggcgaagatctccaacaccacgaccgacagccgctgcccgacccagggcgaggccaccctcgtggaggagcaggacgccaacttcgtctgccggcgcacgttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctgaccgactacggggccctcacgctggactgcagcccccgcaccggcctggacttcaacgagatggtcctcctgaccatgaaggagaagtcctggctggtgcacaagcagtggttcctcgacctgcccctgccctggaccagcggggccagcacgtcccaggagacctggaaccggcaggacctcctggtgaccttcaagaccgcccacgccaagaagcaggaggtcgtggtgctgggcagccaggagggcgcgatgcacacggccctcaccggggccaccgagatccagacctccggcacgaccaccatcttcgccgggcacctgaagtgccgcctgaagatggacaagctcaccctgaagggcatgagctacgtcatgtgcacggggtccttcaagctggagaaggagctcgccgagacccagcacggcaccgtgctggtgcagatcaagtacgagggcaccgacgcgccctgcaagatccccttcctgacgcaggacgagaagggggtcacccagaacggccggctgatcaccgccaacccgatcgtgaccgacaaggagaagcccgtgaacatcgaggccgagccgcccttcggggagagctacatcgtcatcggcgccggcgagaaggcgctcaagctgtcctggttcaagaaggggagctccatcggcaagatgttcgaggccacggcccgcggggcccggcgcatggccatcctgggcgacaccgcgtgggacttcgggagcatcggcggcgtgttcacctccgtggggaagctcgtccaccagatcttcggcaccgcctacggggtgctgttcagcggcgtgtcctggacgatgaagatcgggatcggcgtcctgctcacctggctgggcctgaacagccgctccaccagcctctccatgacctgcatcgccgtggggctggtgacgctgtacctcggcgtcatggtgcaggccgacagcgggtgcgtgatcaactggaagggccgggagctgaagtgcgggtccggcatcttcgtcaccaacgaggtgcacacctggaccgagcagtacaagttccaggccgacagcccgaagcgcctgagcgcggccatcggcaaggcctgggaggagggggtgtgcggcatccggtccgccacccgcctcgagaacatcatgtggaagcagatcagcaacgagctgaaccacatcctgctcgagaacgacatgaagttcacggtcgtggtgggggacgtcgccggcatcctggcgcaggggaagaagatgatccggccccagcccatggagtacaagtactcctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctgaagctccgggactcctacacccaggtctgcgaccaccgcctgatgagcgcggccatcaaggactccaaggccgtgcacgccgacatgggctactggatcgagagcgagaagaacgagacctggaagctggcccgggcgtccttcatcgaggtgaagacgtgcatctggcccaagagccacaccctctggtccaacggcgtcctggagagcgagatgatcatccccaagatctacgggggcccgatctcccagcacaactaccgccccgggtacttcacccagaccgccggcccctggcacctggggaagctcgagctggacttcgacctgtgcgagggcacgaccgtggtggtcgacgagcactgcggcaaccgggggccgagcctccgcaccaccacggtgaccggcaagatcatccacgagtggtgctgccggtcctgcaccctgccgcccctgcgcttccgcggggaggacggctgctggtacgggatggagatccgccccgtgaaggagaaggaggagaacctcgtcaagagcatggtgtccgccggcagcggcgaggtggacagcttctccctggggctgctctgcatcagcatcatgatcgaggaggtcatgcggtcccgctggagccggaagatgctgatgaccggcacgctggccgtgttcttcctcctgatcatggggcagctgacctggaacgacctcatccgcctgtgcatcatggtgggcgccaacgcgtccgaccgcatggggatgggcaccacctacctggccctcatggccacgttcaagatgcggccgatgttcgccgtcggcctgctgttccgccggctcaccagccgcgaggtgctgctgctcaccatcgggctgtccctggtggccagcgtcgagctccccaactccctggaggagctgggcgacgggctcgcgatgggcatcatgatcctgaagctgctcaccgacttccagagccaccagctgtgggccacgctgctctccctgaccttcatcaagaccaccttcagcctgcactacgcctggaagacgatggccatggtgctctccatcgtcagcctgttccccctgtgcctctccaccaccagccagaagaccacgtggctgcccgtgctgctcggctccctggggtgcaagccgctgaccatgttcctcatcgcggagaacaagatctggggccggcgcagctggcccctgaacgaggggatcatggccgtgggcatcgtctccatcctgctcagcagcctgctgaagaacgacgtgcccctcgccgggcccctgatcgccggcggcatgctgatcgcctgctacgtgatctccgggagctccgcggacctcagcctggagaaggccgccgaggtctcctgggaggaggaggccgagcacagcggcgcctcccacaacatcctggtggaggtgcaggacgacgggaccatgaagatcaaggacgaggagcgggacgacaccctcaccatcctgctgaaggcgacgctcctggccgtcagcggcgtgtacccgctgtccatccccgccaccctcttcgtgtggtacttctggcagaagaagaagcagcgcagcggggtcctgtgggacacccccagcccgcccgaggtggagcgggccgtgctggacgacggcatctaccgcatcatgcagcggggcctgctcgggcgcagccaggtcggcgtgggggtgttccaggagaacgtcttccacaccatgtggcacgtgacgcggggcgccgtgctgatgtaccaggggaagcgcctggagccctcctgggcgagcgtcaagaaggacctcatctcctacggcggcgggtggcggctgcagggcagctggaacaccggggaggaggtccaggtgatcgccgtcgagcccggcaagaaccccaagaacgtgcagaccgcccccgggaccttcaagacgcccgagggcgaggtgggcgccatcgccctggacttcaagcccgggacctccggcagccccatcgtcaaccgcgaggggaagatcgtgggcctctacggcaacggggtggtcaccacctccggcacgtacgtgagcgcgatcgcccaggcccgggccagccaggaggggccgctgcccgagatcgaggacgaggtgttccgcaagcggaacctgaccatcatggacctccaccccggctccgggaagacccgccggtacctgccggcgatcgtccgcgaggccatcaagcgcaagctgcggaccctcatcctggcccccacgcgcgtggtggccagcgagatggccgaggcgctgaagggcatgcccatccggtaccagaccaccgccgtcaagtccgagcacaccggcaaggagatcgtggacctcatgtgccacgccacgttcaccatgcgcctgctgagccccgtgcgggtcccgaactacaacatgatcatcatggacgaggcccacttcaccgacccctccagcatcgccgcgcgcgggtacatctccacccgggtgggcatgggggaggccgccgccatcttcatgacggccacgccgcccggcagcgtggaggcgttcccgcagtccaacgccgtcatccaggacgaggagcgcgacatccccgagcggagctggaactccgggtacgagtggatcaccgacttccccggcaagaccgtgtggttcgtgcccagcatcaagtccggcaacgacatcgccaactgcctccgcaagaacgggaagcgggtcatccagctgagccgcaagacgttcgacaccgagtaccagaagaccaagaacaacgactgggactacgtggtgaccacggacatctccgagatgggcgccaacttccgggcggaccgcgtcatcgacccgcggcgctgcctgaagcccgtgatcctcaaggacgggcccgagcgggtgatcctggccggccccatgccggtcaccgtggccagcgccgcccagcgccgggggcgcatcggccgcaaccacaacaaggagggcgaccagtacatctacatggggcagcccctgaacaacgacgaggaccacgcgcactggaccgaggccaagatgctcctggacaacatcaacacccccgagggcatcatccccgccctgttcgagccggagcgggagaagtccgccgccatcgacggggagtaccgcctccggggcgaggcgcgcaagacgttcgtcgagctgatgcggcgcggggacctgcccgtgtggctcagctacaaggtggcctccgagggcttccagtacagcgaccggcgctggtgcttcgacggcgagcggaacaaccaggtcctggaggagaacatggacgtggagatctggaccaaggagggggagcgcaagaagctgcggccccgctggctcgacgcccggacctacagcgaccccctggccctgcgcgagttcaaggagttcgccgcgggccggcgctccgtgagcggggacctcatcctggagatcggcaagctgccgcagcacctcacccagcgggcccagaacgccctggacaacctggtcatgctccacaactccgagcagggcgggcgcgcctaccggcacgcgatggaggagctgcccgacacgatcgagaccctgatgctcctggccctgatcgccgtgctcaccggcggggtgaccctgttcttcctgagcggccgcgggctcggcaagacctccatcggcctgctgtgcgtcatggccagctccgtgctcctgtggatggccagcgtggagccccactggatcgcggcctccatcatcctggagttcttcctcatggtcctgctgatccccgagccggaccggcagcgcacgccccaggacaaccagctcgcctacgtggtgatcgggctgctgttcatgatcctcaccgtcgccgccaacgagatgggcctgctggagaccaccaagaaggacctcgggatcggccacgtggcggtggagaaccaccaccacgccgccatgctggacgtcgacctgcaccccgccagcgcctggacgctctacgcggtggccaccaccatcatcaccccgatgatgcgccacacgatcgagaacaccaccgccaacatctccctgaccgccatcgccaaccaggcggccatcctgatggggctcgacaagggctggcccatcagcaagatggacatcggcgtgcccctgctggccctcgggtgctactcccaggtcaaccccctgacgctgaccgccgcggtgctcatgctggtggcccactacgccatcatcggcccggggctgcaggccaaggccacccgggaggcgcagaagcgcaccgccgccggcatcatgaagaaccccacggtcgacgggatcgtggccatcgacctcgaccccgtggtctacgacgccaagttcgagaagcagctgggccagatcatgctgctcatcctgtgcaccagccagatcctgctcatgcggaccacctgggcgctgtgcgagtccatcacgctggccaccggccccctcaccaccctgtgggaggggagcccgggcaagttctggaacacgaccatcgccgtgtccatggccaacatcttccgcgggagctacctggccggcgcgggcctcgccttctccctgatgaagtccctcgggggcgggcggcgcgggaccggggcccagggcgagaccctcggcgagaagtggaagcggcagctgaaccagctgagcaagtccgagttcaacacgtacaagcgcagcgggatcatggaggtggaccggtccgaggccaaggagggcctcaagcgcggggagaccaccaagcacgcggtcagccggggcaccgccaagctgcgctggttcgtggagcggaacctggtgaagcccgaggggaaggtcatcgacctgggctgcggccgcgggggctggtcctactactgcgccgggctcaagaaggtgacggaggtgaagggctacaccaagggcgggcccggccacgaggagcccatcccgatggccacctacgggtggaacctggtcaagctgcacagcggcaaggacgtgttcttcatcccgcccgagaagtgcgacaccctcctgtgcgacatcggggagtccagccccaacccgacgatcgaggagggccggaccctgcgcgtgctcaagatggtcgagccctggctgcgggggaaccagttctgcatcaagatcctgaacccctacatgccctccgtggtggagaccctcgagcagatgcagcgcaagcacggcggcatgctggtccggaacccgctgagccgcaactccacccacgagatgtactgggtgagctgcgggaccggcaacatcgtgtccgccgtcaacatgacgagccgcatgctcctgaaccggttcaccatggcgcaccgcaagcccacctacgagcgggacgtggacctgggggccggcacccgccacgtggccgtcgagcccgaggtggccaacctcgacatcatcggccagcggatcgagaacatcaagcacgagcacaagtccacgtggcactacgacgaggacaacccctacaagacctgggcctaccacgggagctacgaggtgaagccgtccggcagcgcgtccagcatggtcaacggggtggtcaagctgctgaccaagccctgggacgtgatccccatggtgacccagatcgccatgacggacaccacccccttcggccagcagcgcgtcttcaaggagaaggtggacacccggacgccgaaggccaagcgcgggaccgcccagatcatggaggtgaccgccaagtggctctggggcttcctgagccggaacaagaagccccgcatctgcacccgggaggagttcacgcgcaaggtccggtccaacgcggccatcggcgccgtgttcgtggacgagaaccagtggaacagcgccaaggaggcggtcgaggacgagcgcttctgggacctggtgcaccgggagcgcgagctccacaagcaggggaagtgcgcgacctgcgtgtacaacatgatgggcaagcgggagaagaagctgggggagttcggcaaggccaaggggtcccgcgccatctggtacatgtggctgggcgcccggttcctcgagttcgaggcgctgggcttcatgaacgaggaccactggttcagccgcgagaactccctgagcggggtcgagggcgaggggctccacaagctgggctacatcctgcgggacatctccaagatccccgggggcaacatgtacgccgacgacaccgccggctgggacacccgcatcacggaggacgacctccagaacgaggcccgcatcaccgacatcatggagccggagcacgccctgctggccaagagcatcttcaagctcacctaccagaacaaggtggtgcgggtccagcgccccgccaagaacgggaccgtgatggacgtgatctcccggcgcgaccagcggggcagcgggcaggtcggcacgtacggcctgaacaccttcaccaacatggaggcccagctgatccgccagatggagtccgaggggatcttcagcccctccgagctcgagacccccaacctggccgagcgggtgctggactggctcgagaagtacggcgtggagcgcctgaagcggatggccatcagcggggacgactgcgtcgtgaagccgatcgacgaccgcttcgcgacggccctgaccgccctcaacgacatgggcaaggtgcggaaggacatcccccagtgggagccctccaaggggtggaacgactggcagcaggtccccttctgcagccaccacttccaccagctgatcatgaaggacggccgcgagatcgtggtgccgtgccggaaccaggacgagctggtcggccgcgcccgggtgtcccagggggccggctggagcctccgcgagaccgcgtgcctgggcaagagctacgcccagatgtggcagctgatgtacttccaccggcgcgacctccggctggccgccaacgcgatctgctccgccgtgcccgtcgactggatccccaccagccgcacgacctggtccatccacgcccaccaccagtggatgaccaccgaggacatgctgagcgtgtggaaccgcgtgtggatcgaggagaacccctggatggaggacaagacgcacatctccagctggggcgacgtcccgtacctcgggaagcgggaggaccagtggtgcggctccctgatcggcctgaccgcccgcgccacctgggcgaccaacatccaggtggccatcaaccaggtgcggcgcctcatcgggaacgagaactacctggactacatgaccagcatgaagcggttcaagaacgagtccgaccccgagggcgccctgtggtga

SEQ ID NO: 8436 - RNA, 9879 nt, synthetic construct
  misc_feature 1..9879: note = derived and/or modified CDS sequence (opt1) from DENV-1__FJ410278__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtcacctacgggacctgcagccagacgggcgagcaccggcgggacaagcggtccgtggccctcgcgccccacgtgggcctggggctggagacccgcaccgagacctggatgagctccgagggcgcgtggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtcgggaagctggtgcaccagatcttcggcaccgcctacggggtgctgttctccggcgtcagctggacgatgaagatcgggatcggcgtgctgctgacctggctcggcctgaactcccgcagcacctccctgagcatgacctgcatcgccgtggggctcatcacgctgtacctgggcgtcatggtgcaggccgactccgggtgcgtgatcaactggaagggccgggagctcaagtgcgggagcggcatcttcgtcaccaacgaggtgcacacctggaccgagcagtacaagttccaggccgacagcccgaagcgcctgtccgcggccatcggcaaggcctgggaggagggggtgtgcggcatccggagcgccacccgcctggagaacatcatgtggaagcagatctccaacgagctcaaccacatcctgctggagaacgacatgaagttcacggtcgtggtgggggacgtcgccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctgaagctgcgggacagctacacccaggtctgcgaccaccgcctcatgtccgcggccatcaaggacagcaaggccgtgcacgccgacatgggctactggatcgagtccgagaagaacgagacctggaagctggcccgggcgagcttcatcgaggtgaagacgtgcatctggcccaagtcccacaccctgtggagcaacggcgtcctcgagtccgagatgatcatccccaagatctacgggggcccgatcagccagcacaactaccgccccgggtacttcacccaggccgccggcccctggcacctggggaagctggagctcgacttcgacctgtgcgagggcaccacggtggtggtcgacgagcactgcggcaaccgggggccgtccctgcgcaccaccaccgtgacgggcaagatcatccacgagtggtgctgccggagctgcaccctgccgcccctccgcttccgcggggaggacggctgctggtacgggatggagatccgccccgtgaaggagaaggaggagaacctggtcaagtccatggtgagcgccggcagcggcgaggtggactccttcagcctcgggctgctgtgcatctccatcatgatcgaggaggtcatgcggagccgctggtcccggcgcatgctcatgaccggcaccctggccgtgttcttcctgctcatcatggggcagctgacgtggaacgacctgatccgcctctgcatcatggtgggcgcgaacgccagcgaccggatggggatgggcaccacctacctggccctgatggccaccttcaagatgcgcccgatgttcgccgtcggcctcctgttccggcgcctgacgtcccgggaggtgctcctgctgaccatcgggctcagcctggtggcgtccgtcgagctgcccaacagcctcgaggagctgggcgacgggctggccatgggcatcatgatcctcaagctgctgaccgacttccagtcccaccagctctgggccaccctgctgagcctcacgttcatcaagaccaccttctccctgcactacgcctggaagaccatggcgatggtgctgagcatcgtctccctcttccccctgtgcctgagcacgacctcccagaagaccacctggctccccgtgctgctgggcagcctcgggtgcaagccgctgacgatgttcctgatcgccgagaacaagatctggggccgccggtcctggcccctcaacgaggggatcatggccgtgggcatcgtcagcatcctgctgagctccctcctgaagaacgacgtgcccctggccgggcccctcatcgccggcggcatgctgatcgcgtgctacgtgatcagcgggtccagcgccgacctgtccctcgagaaggccgccgaggtcagctgggaggaggaggccgagcactccggcgcgagccacaacatcctggtggaggtgcaggacgacgggaccatgaagatcaaggacgaggagcgcgacgacaccctgaccatcctcctgaaggccaccctgctcgccgtctccggcgtgtacccgctgagcatccccgccacgctgttcgtgtggtacttctggcagcggaagaagcagcgctccggggtcctctgggacacccccagcccgcccgaggtggagcgggccgtgctggacgacggcatctaccgcatcatgcagcggggcctgctggggcgctcccaggtcggcgtgggggtgttccaggagaacgtcttccacaccatgtggcacgtgacccggggcgcggtgctcatgtaccaggggaagcgcctggagcccagctgggcctccgtcaagaaggacctgatcagctacggcggcgggtggcggctccagggctcctggaacacgggggaggaggtccaggtgatcgccgtcgagcccggcaagaaccccaagaacgtgcagaccgcccccgggaccttcaagacccccgagggcgaggtgggcgccatcgcgctggacttcaagcccgggacgagcggctcccccatcgtcaaccgcgaggggaagatcgtgggcctgtacggcaacggggtggtcaccaccagcggcacctacgtgagcgccatcgcccaggccaaggcgtcccaggaggggccgctccccgagatcgaggacgaggtgttccggaagcgcaacctgacgatcatggacctgcaccccggcagcgggaagacccggcgctacctcccggccatcgtccgcgaggccatcaagcggaagctgcgcaccctgatcctcgcccccacccgggtggtggcctccgagatggcggaggccctgaagggcatgcccatccgctaccagacgaccgccgtcaagagcgagcacaccggcaaggagatcgtggacctgatgtgccacgccaccttcacgatgcggctcctgtcccccgtgcgcgtcccgaactacaacatgatcatcatggacgaggcccacttcaccgaccccagctccatcgcggcccgggggtacatcagcacccgcgtgggcatgggggaggccgccgccatcttcatgaccgcgacgccgcccggctccgtggaggccttcccgcagagcaacgccgtcatccaggacgaggagcgggacatccccgagcgctcctggaacagcgggtacgagtggatcaccgacttccccggcaagaccgtgtggttcgtgccctccatcaagagcggcaacgacatcgccaactgcctgcggaagaacgggaagcgcgtcatccagctctcccggaagaccttcgacacggagtaccagaagaccaagaacaacgactgggactacgtggtgaccaccgacatcagcgagatgggcgcgaacttccgcgccgaccgggtcatcgacccgcgccggtgcctgaagcccgtgatcctgaaggacgggcccgagcgcgtgatcctcgccggccccatgccggtcacggtggcctccgccgcgcagcggcgcgggcgcatcggccggaaccacaacaaggagggcgaccagtacatctacatggggcagcccctgaacaacgacgaggaccacgcccactggaccgaggccaagatgctgctcgacaacatcaacacccccgagggcatcatccccgccctgttcgagccggagcgcgagaagtccgccgcgatcgacggggagtaccggctgcgcggcgaggcccggaagaccttcgtcgagctcatgcgccgcggggacctgcccgtgtggctgtcctacaaggtggccagcgagggcttccagtacagcgaccgccggtggtgcttcgacggcgagcgcaacaaccaggtcctcgaggagaacatggacgtggagatctggacgaaggagggggagcggaagaagctgcgcccccggtggctggacgcccgcacctactccgaccccctcgccctgcgggagttcaaggagttcgcggccggccgccggagcgtgtccggggacctgatcctcgagatcggcaagctgccgcagcacctgacccagcgcgcccagaacgccctcgacaacctggtcatgctgcacaacagcgagcagggcgggcgggcgtaccgccacgccatggaggagctccccgacaccatcgagacgctgatgctgctcgccctgatcgccgtgctgaccggcggggtgaccctcttcttcctgtccggccgggggctgggcaagaccagcatcggcctcctgtgcgtcatggcctccagcgtgctgctctggatggcgtccgtggagccccactggatcgccgccagcatcatcctggagttcttcctgatggtcctcctgatccccgagccggaccgccagcgcacgccccaggacaaccagctggcctacgtggtgatcgggctcctgttcatgatcctgacggtcgccgcgaacgagatgggcctcctggagaccaccaagaaggacctggggatcggccacgtggccgtggagaaccaccaccacgccgccatgctcgacgtcgacctgcaccccgcctccgcgtggaccctgtacgccgtggccacgaccatcatcaccccgatgatgcggcacaccatcgagaacacgaccgccaacatcagcctcaccgccatcgcgaaccaggccgccatcctgatggggctggacaagggctggcccatctccaagatggacatcggcgtgcccctcctggccctggggtgctacagccaggtcaaccccctcaccctgacggcggccgtgctgatgctcgtggcccactacgccatcatcggcccggggctgcaggccaaggcgacccgcgaggcccagaagcggaccgccgccggcatcatgaagaaccccaccgtcgacgggatcgtggccatcgacctggaccccgtggtctacgacgcgaagttcgagaagcagctcggccagatcatgctgctgatcctctgcacgtcccagatcctgctgatgcgcaccacctgggccctctgcgagagcatcaccctggccacgggccccctgaccaccctctgggaggggtccccgggcaagttctggaacaccacgatcgccgtgagcatggccaacatcttccgggggtcctacctggcgggcgccggcctggccttcagcctcatgaagtccctcgggggcgggcgccgggggaccggggcccagggcgagaccctgggcgagaagtggaagcgccagctcaaccagctgtccaagagcgagttcaacacctacaagcggtccgggatcatggaggtggaccgcagcgaggcgaaggagggcctgaagcgcggggagacgaccaagcacgccgtctcccgcggcaccgccaagctccggtggttcgtggagcgcaacctggtgaagcccgaggggaaggtcatcgacctgggctgcggccgcgggggctggagctactactgcgccgggctgaagaaggtgaccgaggtgaagggctacacgaagggcggccccggccacgaggagcccatcccgatggccacctacgggtggaacctcgtcaagctgcactccggcaaggacgtgttcttcatcccgcccgagaagtgcgacaccctgctctgcgacatcggggagagctcccccaacccgaccatcgaggagggccgcacgctgcgggtgctgaagatggtcgagccctggctccgcgggaaccagttctgcatcaagatcctgaacccctacatgcccagcgtggtggagaccctggagcagatgcagcggaagcacggcggcatgctcgtccgcaacccgctgtcccgcaacagcacccacgagatgtactgggtgtcctgcgggaccggcaacatcgtgagcgcggtcaacatgacctcccggatgctgctcaaccgcttcacgatggcccaccggaagcccacctacgagcgcgacgtggacctgggggccggcacccggcacgtggccgtcgagcccgaggtggccaacctggacatcatcggccagcgcatcgagaacatcaagcacgagcacaagagcacctggcactacgacgaggacaacccctacaagacgtgggcgtaccacgggtcctacgaggtgaagccgagcggctccgccagcagcatggtcaacggggtggtcaagctcctgaccaagccctgggacgtgatccccatggtgacccagatcgccatgaccgacacgacccccttcggccagcagcgggtcttcaaggagaaggtggacacccgcaccccgaaggccaagcgggggacggcccagatcatggaggtgaccgcgaagtggctgtggggcttcctctcccgcaacaagaagccccggatctgcacccgcgaggagttcacccggaaggtccgcagcaacgccgccatcggcgccgtgttcgtggacgagaaccagtggaactccgcgaaggaggccgtcgaggacgagcggttctgggacctggtgcaccgcgagcgggagctgcacaagcaggggaagtgcgccacgtgcgtgtacaacatgatgggcaagcgcgagaagaagctcggggagttcggcaaggccaaggggagccgggccatctggtacatgtggctgggcgcgcgcttcctggagttcgaggccctcggcttcatgaacgaggaccactggttctcccgggagaacagcctgtccggggtcgagggcgaggggctgcacaagctcggctacatcctgcgcgacatcagcaagatccccgggggcaacatgtacgccgacgacaccgccggctgggacacccgcatcaccgaggacgacctgcagaacgaggcccggatcacggacatcatggagccggagcacgcgctcctggccaagtccatcttcaagctgacctaccagaacaaggtggtgcgcgtccagcggcccgccaagaacgggaccgtgatggacgtgatcagccgccgggaccagcgcggctccgggcaggtcggcacctacggcctcaacacgttcaccaacatggaggcccagctgatccggcagatggagagcgaggggatcttctcccccagcgagctggagacccccaacctcgccgagcgcgtgctggactggctggagaagtacggcgtggagcggctcaagcgcatggcgatctccggggacgactgcgtcgtgaagccgatcgacgaccggttcgccaccgccctgacggccctgaacgacatgggcaaggtgcgcaaggacatcccccagtgggagcccagcaaggggtggaacgactggcagcaggtccccttctgctcccaccacttccaccagctcatcatgaaggacggccgggagatcgtggtgccgtgccgcaaccaggacgagctggtcggccgggcccgcgtgagccagggggcgggctggagcctgcgggagaccgcctgcctcgggaagtcctacgcccagatgtggcagctgatgtacttccaccgccgggacctgcgcctcgccgcgaacgccatctgcagcgccgtgcccgtcgactggatccccacctcccgcaccacgtggagcatccacgcccaccaccagtggatgaccaccgaggacatgctgtccgtgtggaaccgggtgtggatcgaggagaacccctggatggaggacaagacccacatcagctcctggggcgacgtcccgtacctggggaagcgcgaggaccagtggtgcggcagcctcatcggcctgacggcccgggcgacctgggccaccaacatccaggtggccatcaaccaggtgcgccggctgatcgggaacgagaactacctcgactacatgacctccatgaagcgcttcaagaacgagagcgaccccgagggcgccctgtggtga

SEQ ID NO: 8437 - RNA, 9879 nt, synthetic construct
  misc_feature 1..9879: note = derived and/or modified CDS sequence (opt1) from DENV-1__FJ410279__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagttctgcgaggacacgatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggaccagcggggcctccaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctcgtccagatcaagtacgagggcaccgacgccccctgcaagatccccttctccacccaggacgagaagggggtgacccagaacggccggctgatcacggccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacaccgcctgggacttcgggagcatcggcggcgtgttcacgtccgtcgggaagctggtgcaccagatcttcggcaccgcctacggggtgctgttcagcggcgtctcctggaccatgaagatcgggatcggcgtgctcctgacctggctgggcctcaacagccgctccacgagcctgtccatgacctgcatcgccgtggggctggtcaccctctacctgggcgtgatggtgcaggccgacagcgggtgcgtcatcaactggaagggccgggagctgaagtgcgggagcggcatcttcgtgaccaacgaggtgcacacgtggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagttcaccgtggtggtcggggacgtggcgggcatcctggcccaggggaagaagatgatccggccccagcccatggagtacaagtactcctggaagtcctggggcaaggccaagatcatcggcgccgacgtgcagaacaccacgttcatcatcgacgggcccaacaccccggagtgccccgacgaccagcgcgcgtggaacatctgggaggtcgaggactacggcttcgggatcttcaccaccaacatctggctcaagctgcgggactcctacacccaggtgtgcgaccaccgcctgatgagcgccgccatcaaggactccaaggccgtgcacgccgacatgggctactggatcgagagcgagaagaacgagacctggaagctcgcgcgggcctccttcatcgaggtcaagacctgcatctggcccaagagccacaccctgtggtccaacggcgtgctggagagcgagatgatcatccccaagatctacgggggcccgatctcccagcacaactaccgccccgggtacttcacgcagaccgccggcccctggcacctcgggaagctggagctggacttcgacctctgcgagggcaccaccgtggtcgtggacgagcactgcggcaaccgggggccgagcctgcgcacgaccaccgtgaccggcaagatcatccacgagtggtgctgccggtcctgcacgctgccgcccctgcgcttcaagggggaggacggctgctggtacgggatggagatccggcccgtcaaggagaaggaggagaacctggtcaagagcatggtgagcgccggctccggcgaggtcgacagcttctccctggggctcctgtgcatcagcatcatgatcgaggaggtgatgcgctcccggtggagccgcaagatgctgatgaccggcaccctcgccgtgttcttcctgctgatcatggggcagctcacctggaacgacctgatccggctgtgcatcatggtcggcgcgaacgcctccgaccgcatggggatgggcacgacctacctcgccctgatggccaccttcaagatgcgcccgatgttcgccgtgggcctcctgttccggcgcctgaccagccgggaggtgctgctcctgacgatcgggctgtccctcgtcgcgagcgtggagctgcccaactccctggaggagctcggcgacgggctggccatgggcatcatgatcctgaagctcctgaccgacttccagagccaccagctgtgggccaccctcctgtccctgaccttcatcaagacgaccttcagcctccactacgcctggaagaccatggcgatggtcctgtccatcgtgagcctgttccccctctgcctgtccaccacgagccagaagaccacctggctgcccgtgctcctgggctccctggggtgcaagccgctcaccatgttcctgatcgccgagaacaagatctggggccgcaagagctggcccctgaacgaggggatcatggccgtcggcatcgtgagcatcctcctgtccagcctgctcaagaacgacgtgcccctggccgggcccctgatcgccggcggcatgctcatcgcgtgctacgtcatctccgggagctccgccgacctgagcctggagaaggccgccgaggtgtcctgggaggaggaggccgagcacagcggcgcgtcccacaacatcctcgtggaggtccaggacgacgggacgatgaagatcaaggacgaggagcgggacgacaccctgaccatcctgctcaaggccaccctgctggccgtgagcggcgtgtacccgctctccatccccgccaccctgttcctgtggtacttctggcagaagaagaagcagcgcagcggggtcctctgggacacgcccagcccgcccgaggtggagcgggccgtgctggacgacggcatctaccgcatcatgcagcggggcctgctggggcgcagccaggtcggcgtgggggtgttccaggagaacgtcttccacaccatgtggcacgtgacccggggcgcggtgctcatgtaccaggggaagcgcctggagccctcctgggccagcgtcaagaaggacctgatctcctacggcggcgggtggcggctccagggcagctggaacaccggggaggaggtccaggtgatcgccgtcgagcccggcaagaaccccaagaacgtgcagacggcccccgggaccttcaagacctccgagggcgaggtgggcgccatcgcgctggacttcaagcccgggaccagcggcagccccatcgtcaaccgcgaggggaagatcgtgggcctgtacggcaacggggtggtcacgacctccggcacctacgtgagcgccatcgcccaggccaaggcgtcccaggaggggcccctcccggagatcgaggacgaggtgttccggaagcgcaacctgaccatcatggacctgcaccccggcagcgggaagacgcggcgctacctccccgccatcgtccgggaggccatcaagcgcaagctgcggaccctgatcctcgccccgacccgcgtggtggcctccgagatggcggaggccctgaagggcatgcccatccgctaccagaccacggccgtcaagagcgagcacaccggcaaggagatcgtggacctgatgtgccacgccaccttcaccatgcggctcctgtcccccgtgcgcgtccccaactacaacatgatcatcatggacgaggcccacttcacggacccgagctccatcgcggcccgggggtacatcagcacccgcgtgggcatgggggaggccgccgccatcttcatgaccgcgacgccgcccggctccgtggaggccttcccccagagcaacgccgtcatccaggacgaggagcgggacatcccggagcgctcctggaacagcgggtacgagtggatcacggacttccccggcaagaccgtgtggttcgtgccctccatcaagagcggcaacgacatcgccaactgcctgcggaagaacgggaagcgcgtcatccagctctcccggaagaccttcgacaccgagtaccagaagacgaagaacaacgactgggactacgtggtgaccaccgacatcagcgagatgggcgcgaacttccgcgccgaccgggtcatcgacccccgccggtgcctgaagccggtgatcctgaaggacgggcccgagcgcgtgatcctcgccggccccatgcccgtcaccgtggcctccgccgcgcagcggcgcgggcggatcggccgcaaccacaacaaggagggcgaccagtacatctacatggggcagccgctgaacaacgacgaggaccacgcccactggacggaggccaagatgctgctcgacaacatcaacacccccgagggcatcatccccgccctgttcgagcccgagcgggagaagtccgccgcgatcgacggggagtaccgcctgcgcggcgaggcccggaagaccttcgtcgagctcatgcgccgcggggacctgccggtgtggctgagctacaaggtggcctccgagggcttccagtacagcgaccgccggtggtgcttcgacggcgagcgcaacaaccaggtcctcgaggagaacatggacgtggagatctggaccaaggagggggagcggaagaagctgcgcccccggtggctggacgcccgcgtgtactccgaccccctcgccctgcgggagttcaaggagttcgcggccggccgccggagcgtctccggggacctgatcctcgagatcggcaagctgccccagcacctgacgcagcgcgcccagaacgccctcgacaacctggtgatgctgcacaacagcgagcagggcgggcgggcgtaccgccacgccatggaggagctcccggacaccatcgagaccctgatgctgctcgccctgatcgccgtgctgaccggcggggtcaccctcttcttcctgtccggccgggggctgggcaagacgagcatcggcctcctgtgcgtgatggcctccagcgtgctgctctggatggcgtccgtcgagccccactggatcgccgccagcatcatcctggagttcttcctgatggtgctcctgatccccgagcccgaccgccagcggaccccgcaggacaaccagctggcctacgtggtcatcgggctcctgttcatgatcctgaccgtggccgcgaacgagatgggcctcctggagaccacgaagaaggacctggggatcggccacgtggccgtcgagaaccaccaccacgccgccatgctcgacgtggacctgcaccccgcctccgcgtggaccctgtacgccgtggccaccaccatcatcacgcccatgatgcgccacaccatcgagaacaccaccgccaacatcagcctcacggccatcgcgaaccaggccgccatcctgatggggctggacaagggctggccgatctccaagatggacatcggcgtccccctcctggccctggggtgctacagccaggtgaaccccctcaccctgaccgcggccgtgctgatgctcgtcgcccactacgccatcatcggccccgggctgcaggccaaggcgacccgggaggcccagaagcgcacggccgccggcatcatgaagaacccgaccgtggacgggatcgtggccatcgacctggaccccgtcgtgtacgacgcgaagttcgagaagcagctcggccagatcatgctgctgatcctctgcacctcccagatcctgctgatgcgcaccacgtgggccctctgcgagagcatcaccctggccaccggccccctgaccacgctctgggaggggtcccccggcaagttctggaacaccaccatcgccgtgagcatggccaacatcttccgggggagctacctggcgggcgccggcctggccttctccctcatgaagtccctcgggggcgggcgccgggggaccggggcccagggcgagacgctgggcgagaagtggaagcgccagctcaaccagctgtccaagagcgagttcaacacctacaagcggtccgggatcatggaggtcgaccgcagcgaggcgaaggagggcctgaagcgcggggagaccaccaagcacgccgtgtcccgcggcacggccaagctccggtggttcgtggagcgcaacctggtcaagccggaggggaaggtgatcgacctgggctgcggccgcggcgggtggagctactactgcgccgggctgaagaaggtgaccgaggtcaaggggtacaccaagggcgggcccggccacgaggagcccatccccatggccacctacgggtggaacctcgtgaagctgcactccggcaaggacgtgttcttcatcccgcccgagaagtgcgacacgctgctctgcgacatcggggagagctcccccaaccccaccatcgaggagggccgcaccctgcgggtcctgaagatggtggagccgtggctccgcgggaaccagttctgcatcaagatcctgaacccctacatgcccagcgtggtcgagaccctggagcagatgcagcggaagcacggcggcatgctcgtgcgcaaccccctgtcccggaacagcacgcacgagatgtactgggtgtcctgcgggaccggcaacatcgtcagcgcggtgaacatgacctcccgcatgctgctcaaccggttcaccatggcccaccgcaagccgacctacgagcgcgacgtggacctgggggccggcacgcggcacgtcgccgtggagcccgaggtggccaacctggacatcatcggccagcgcatcgagaacatcaagcacgagcacaagagcacctggcactacgacgaggacaacccctacaagacctgggcgtaccacgggtcctacgaggtcaagcccagcggcagcgcctccagcatggtgaacggggtcgtgaagctcctgaccaagccgtgggacgtgatccccatggtcacgcagatcgccatgaccgacaccacccccttcggccagcagcgggtgttcaaggagaaggtggacacgcgcacccccaaggccaagcgggggaccgcccagatcatggaggtcaccgcgaagtggctgtggggcttcctctcccgcaacaagaagccgcggatctgcacgcgcgaggagttcacccggaaggtgcgcagcaacgccgccatcggcgccgtgttcgtcgacgagaaccagtggaactccgcgaaggaggccgtggaggacgagcggttctgggacctggtgcaccgcgagcgggagctgcacaagcaggggaagtgcgcgacctgcgtctacaacatgatgggcaagcgcgagaagaagctcggggagttcggcaaggccaaggggagccgggccatctggtacatgtggctgggcgcgcgcttcctggagttcgaggccctcggcttcatgaacgaggaccactggttctcccgggagaacagcctgtccggggtggagggcgaggggctgcacaagctcggctacatcctgcgcgacatcagcaagatccccgggggcaacatgtacgccgacgacaccgccggctgggacacgcggatcaccgaggacgacctgcagaacgaggccaagatcaccgacatcatggagcccgagcacgcgctcctggccaagtccatcttcaagctgacctaccagaacaaggtggtccgcgtgcagcggccggccaagaacgggacggtgatggacgtcatcagccgccgcgaccagcggggctccggccaggtgggcacctacggcctcaacaccttcaccaacatggaggcccagctgatccgccagatggagagcgaggggatcttctcccccagcgagctggagacgcccaacctcgccggccgggtgctggactggctggagaagcacggggtcgagcgcctcaagcggatggcgatctccggcgacgactgcgtggtgaagcccatcgacgaccgcttcgccaccgccctgaccgccctgaacgacatggggaaggtccggaaggacatcccgcagtgggagcccagcaagggctggaacgactggcagcaggtccccttctgcagccaccacttccaccagctcatcatgaaggacggccgcgagatcgtggtcccctgccggaaccaggacgagctggtggggcgcgcccgggtgtcccagggcgcggggtggagcctgcgcgagaccgcctgcctcggcaagtcctacgcccagatgtggcagctgatgtacttccaccggcgcgacctgcggctcgccgcgaacgccatctgcagcgccgtcccggtggactgggtgcccacgtcccgcaccacctggagcatccacgcccaccaccagtggatgaccacggaggacatgctgtccgtctggaaccgggtgtggatcgaggagaacccctggatggaggacaagacccacatcagctcctggggcgacgtgccctacctgggcaagcgcgaggaccagtggtgcggcagcctcatcgggctgaccgcccgggcgacctgggccacgaacatccaggtcgccatcaaccaggtgcgccgcctgatcggcaacgagaactacctcgactacatgacctccatgaagcggttcaagaacgagagcgacccggagggggccctgtggtga

SEQ ID NO: 8438 - RNA, 9879 nt, synthetic construct
  misc_feature 1..9879: note = derived and/or modified CDS sequence (opt1) from DENV-1__FJ410283__SS-prME
  source 1..9879: mol_type = other RNA
agcgtgaccatgctgctgatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgggacaagcggtccgtggccctcgcgccccacgtgggcctggggctggagacccgcaccgagacctggatgagctccgagggcgcctggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggagctggccgagacccagcacggcaccgtgctggtgcagatcaagtacgagggcaccgacgcgccctgcaagatccccttcagcacgcaggacgagaagggggtcacccagaacggccggctgatcaccgccaacccgatcgtgaccgacaaggagaagcccgtgaacatcgaggccgagccgcccttcggggagtcctacatcgtcatcggcgccggcgagaaggcgctcaagctgagctggttcaagaaggggtccagcatcggcaagatgttcgaggccacggcccgcggggcccggcgcatggccatcctgggcgacaccgcgtgggacttcgggtccatcggcggcgtgttcaccagcgccgggaagctcgtgcaccagatcttcggcaccgcctacggggtcctgttctccggcgtgagctggacgatgaagatcgggatcggcgtgctgctcacctggctgggcctgaactcccgcagcacctccctcagcatgacctgcatcgccgtcgggctggtgacgctgtacctcggcgtgatggtccaggccgactccgggtgcgtgatcaactggaagggccgggagctgaagtgcgggagcggcatcttcgtgaccaacgaggtccacacctggaccgagcagtacaagttccaggcggacagcccgaagcgcctgtccgccgccatcggcaaggcctgggaggagggggtgtgcggcatccggagcgccacccgcctcgagaacatcatgtggaagcagatctccaacgagctgaaccacatcctgctcgagaacgacatgaagttcacggtggtcgtgggggacgtggcgggcatcctggcccaggggaagaagatgatccggccccagcccatggagtacaagtacagctggaagtcctggggcaaggccaagatcatcggcgccgacgtccagaacaccaccttcatcatcgacgggcccaacaccccggagtgccccgacgaccagcgcgcgtggaacatctgggaggtggaggactacggcttcgggatcttcacgaccaacatctggctgaagctccgggacagctacacccaggtgtgcgaccaccgcctgatgtccgccgccatcaaggacagcaaggccgtccacgccgacatgggctactggatcgagtccgagaagaacgagacctggaagctggcgcgggccagcttcatcgaggtgaagacgtgcatctggcccaagtcccacaccctctggagcaacggcgtgctggagtccgagatgatcatccccaagatctacgggggcccgatcagccagcacaactaccgccccgggtacttcacccagaccgccggcccctggcacctggggaagctcgagctggacttcgacctgtgcgagggcacgaccgtcgtggtggacgagcactgcggcaaccgggggccgtccctccgcaccaccacggtcaccggcaagatcatccacgagtggtgctgccggagctgcaccctgccgcccctgcgcttccgcggggaggacggctgctggtacgggatggagatccgccccgtgaaggagaaggaggagaacctcgtgaagtccatggtcagcgccggcagcggcgaggtggactccttcagcctggggctgctctgcatctccatcatgatcgaggaggtgatgcggagccgctggtcccggaagatgctgatgaccggcacgctggccgtcttcttcctcctgatcatggggcagctgacctggaacgacctcatccgcctgtgcatcatggtgggcgcgaacgccagcgaccgcatggggatgggcaccacctacctggccctcatggccacgttcaagatgcggccgatgttcgccgtgggcctgctgttccgccggctcacctcccgcgaggtcctgctgctcaccatcgggctgagcctggtggcgtccgtggagctccccaacagcctggaggagctgggcgacgggctcgccatgggcatcatgatcctgaagctgctcaccgacttccagtcccaccagctgtgggccacgctgctcagcctgaccttcatcaagaccaccttctccctgcactacgcctggaagacgatggcgatggtcctcagcatcgtgtccctgttccccctgtgcctcagcaccacctcccagaagaccacgtggctgcccgtcctgctcggcagcctggggtgcaagccgctgaccatgttcctcatcgccgagaacaagatctggggccggcgctcctggcccctgaacgaggggatcatggccgtgggcatcgtgagcatcctgctcagctccctgctgaagaacgacgtccccctcgccgggcccctgatcgccggcggcatgctgatcgcgtgctacgtgatcagcgggtccagcgccgacctctccctggagaaggccgccgaggtgagctgggaggaggaggccgagcactccggcgcgagccacaacatcctggtcgaggtgcaggacgacgggaccatgaagatcaaggacgaggagcgggacgacaccctcaccatcctgctgaaggccacgctcctggccgtgtccggcgtctacccgctgagcatccccgccaccctcttcgtgtggtacttctggcagaagaagaagcagcgctccggggtgctgtgggacacccccagcccgcccgaggtcgagcgggccgtgctggacgacggcatctaccgcatcatgcagcggggcctgctcgggcgctcccaggtgggcgtcggggtgttccaggagaacgtgttccacaccatgtggcacgtcacgcggggcgcggtgctgatgtaccaggggaagcgcctggagcccagctgggcctccgtgaagaaggacctcatcagctacggcggcgggtggcggctgcagggctcctggaacaccggggaggaggtccaggtgatcgccgtggagcccggcaagaaccccaagaacgtccagaccgcccccgggaccttcaagacgcccgagggcgaggtgggcgccatcgcgctggacttcaagcccgggaccagcggctcccccatcgtgaaccgcgaggggaagatcgtcggcctctacggcaacggggtggtgaccaccagcggcacgtacgtcagcgccatcgcccaggccaaggcgtcccaggaggggccgctgcccgagatcgaggacgaggtgttccggaagcgcaacctgaccatcatggacctccaccccggcagcgggaagacccggcgctacctgccggccatcgtgcgggaggccatcaagcgcaagctgcgcaccctcatcctggcccccacgcgggtcgtggcctccgagatggcggaggccctgaagggcatgcccatccgctaccagaccaccgccgtcaagagcgagcacaccggcaaggagatcgtcgacctcatgtgccacgccacgttcaccatgcggctgctgtcccccgtgcgcgtgccgaactacaacatgatcatcatggacgaggcccacttcaccgaccccagctccatcgcggcccgggggtacatcagcacccgcgtcggcatgggggaggccgccgccatcttcatgacggcgacgccgcccggctccgtggaggccttcccgcagagcaacgccgtgatccaggacgaggagcgggacatccccgagcgctcctggaacagcgggtacgagtggatcaccgacttccccggcaagaccgtctggttcgtgccctccatcaagagcggcaacgacatcgccaactgcctccggaagaacgggaagcgcgtgatccagctgtcccggaagacgttcgacaccgagtaccagaagaccaagaacaacgactgggactacgtcgtgaccacggacatcagcgagatgggcgcgaacttccgcgccgaccgggtgatcgacccgcgccggtgcctgaagcccgtcatcctcaaggacgggcccgagcgcgtgatcctggccggccccatgccggtgaccgtcgcctccgccgcgcagcggcgcgggcggatcggccgcaaccacaacaaggagggcgaccagtacatctacatggggcagcccctgaacaacgacgaggaccacgcccactggaccgaggccaagatgctcctggacaacatcaacacccccgagggcatcatccccgccctgttcgagccggagcgcgagaagtccgccgcgatcgacggggagtaccggctccgcggcgaggcccggaagacgttcgtggagctgatgcgccgcggggacctgcccgtctggctctcctacaaggtggccagcgagggcttccagtacagcgaccgccggtggtgcttcgacggcgagcgcaacaaccaggtgctggaggagaacatggacgtcgagatctggaccaaggagggggagcggaagaagctgcgcccccggtggctcgacgcccgcacctactccgaccccctggccctgcgggagttcaaggagttcgcggccggccgccggagcgtgtccggggacctcatcctggagatcggcaagctgccgcagcacctcacccagcgcgcccagaacgccctggacaacctggtgatgctccacaacagcgagcagggcgggcgggcgtaccgccacgccatggaggagctgcccgacacgatcgagaccctgatgctcctggccctgatcgccgtcctcaccggcggggtgaccctgttcttcctgtccggccgggggctcggcaagaccagcatcggcctgctgtgcgtgatggcctccagcgtcctcctgtggatggcgtccgtggagccccactggatcgccgccagcatcatcctggagttcttcctcatggtgctgctgatccccgagccggaccgccagcggacgccccaggacaaccagctcgcctacgtcgtgatcgggctgctgttcatgatcctcaccgtggccgcgaacgagatgggcctgctggagaccaccaagaaggacctcgggatcggccacgtcgccgtggagaaccaccaccacgccgccatgctggacgtggacctgcaccccgcctccgcgtggacgctctacgccgtcgccaccaccatcatcaccccgatgatgcgccacacgatcgagaacaccaccgccaacatcagcctgaccgccatcgcgaaccaggccgccatcctgatggggctcgacaagggctggcccatctccaagatggacatcggcgtgcccctgctggccctcgggtgctacagccaggtgaaccccctgacgctgaccgcggccgtcctcatgctggtggcccactacgccatcatcggcccggggctgcaggccaaggcgacccgcgaggcccagaagcggaccgccgccggcatcatgaagaaccccacggtggacgggatcgtcgccatcgacctcgaccccgtggtgtacgacgcgaagttcgagaagcagctgggccagatcatgctgctcatcctgtgcacctcccagatcctgctcatgcgcaccacctgggccctgtgcgagagcatcacgctggccaccggccccctcaccaccctgtgggaggggtccccgggcaagttctggaacacgaccatcgccgtcagcatggccaacatcttccgggggtcctacctggcgggcgccggcctcgccttcagcctgatgaagtccctcgggggcgggcgccgggggaccggggcccagggcgagaccctcggcgagaagtggaagcgccagctgaaccagctgtccaagagcgagttcaacacgtacaagcggtccgggatcatggaggtggaccgcagcgaggcgaaggagggcctcaagcgcggggagaccaccaagcacgccgtgtcccgcggcaccgccaagctgcggtggttcgtcgagcgcaacctggtgaagcccgaggggaaggtgatcgacctgggctgcggccgcggcgggtggagctactactgcgccgggctcaagaaggtcacggaggtgaaggggtacaccaagggcggccccggccacgaggagcccatcccgatggccacctacgggtggaacctggtgaagctgcactccggcaaggacgtcttcttcatcccgcccgagaagtgcgacaccctcctgtgcgacatcggggagagctcccccaacccgacgatcgaggagggccgcaccctgcgggtgctcaagatggtggagccctggctgcgcgggaaccagttctgcatcaagatcctgaacccctacatgcccagcgtcgtggagaccctcgagcagatgcagcggaagcacggcggcatgctggtgcgcaacccgctgtcccggaacagcacccacgagatgtactgggtctcctgcgggaccggcaacatcgtgagcgcggtgaacatgacgtcccgcatgctcctgaaccgcttcaccatggcccaccggaagcccacctacgagcgcgacgtcgacctgggggccggcacccggcacgtggccgtggagcccgaggtcgccaacctcgacatcatcggccagcgcatcgagaacatcaagcacgagcacaagagcacgtggcactacgacgaggacaacccctacaagacctgggcgtaccacgggtcctacgaggtgaagccgagcggctccgccagcagcatggtgaacggggtcgtgaagctgctgaccaagccctgggacgtcatccccatggtgacccagatcgccatgacggacaccacccccttcggccagcagcgggtgttcaaggagaaggtcgacacccgcacgccgaaggccaagcgggggaccgcccagatcatggaggtgaccgcgaagtggctctggggcttcctgtcccgcaacaagaagccccggatctgcacccgcgaggagttcacgcggaaggtgcgcagcaacgccgccatcggcgccgtcttcgtggacgagaaccagtggaactccgcgaaggaggccgtggaggacgagcggttctgggacctggtccaccgcgagcgggagctccacaagcaggggaagtgcgcgacctgcgtgtacaacatgatgggcaagcgcgagaagaagctgggggagttcggcaaggccaaggggagccgggccatctggtacatgtggctgggcgcgcgcttcctcgagttcgaggccctgggcttcatgaacgaggaccactggttctcccgggagaacagcctgtccggggtggagggcgaggggctccacaagctgggctacatcctgcgcgacatcagcaagatccccgggggcaacatgtacgccgacgacaccgccggctgggacacccggatcacggaggacgacctccagaacgaggcccgcatcaccgacatcatggagccggagcacgcgctgctggccaagtccatcttcaagctcacctaccagaacaaggtcgtgcgcgtgcagcggcccgccaagaacgggaccgtcatggacgtgatcagccgccgggaccagcgcggctccggccaggtggggacgtacggcctgaacaccttcaccaacatggaggcccagctgatccggcagatggagagcgaggggatcttctcccccagcgagctcgagacccccaacctggccgagcgcgtcctggactggctcggcaagtacggggtggagcggctgaagcgcatggcgatctccggcgacgactgcgtggtcaagccgatcgacgaccggttcgccacggccctgaccgccctcaacgacatggggaaggtgcgcaaggacatcccccagtgggagcccagcaagggctggaacgactggcagcaggtccccttctgctcccaccacttccaccagctgatcatgaaggacggccgggagatcgtcgtgccgtgccgcaaccaggacgagctggtggggcgggcccgcgtcagccagggcgcggggtggagcctccgggagaccgcctgcctgggcaagtcctacgcccagatgtggcagctgatgtacttccaccgccgggacctccgcctggccgcgaacgccatctgcagcgccgtgcccgtggactggatccccacctcccggacgacctggagcatccacgcccaccaccagtggatgaccaccgaggacatgctgtccgtctggaaccgcgtgtggatcgaggagaacccctggatggaggacaagacgcacatcagctcctggggcgacgtgccgtacctcggcaagcgcgaggaccagtggtgcggcagcctgatcgggctgaccgcccgggcgacctgggccaccaacatccaggtcgccatcaaccaggtgcgccggctcatcggcaacgagaactacctggactacatgacctccatgaagcgcttcaagaacgagagcgaccccgagggggccctgtggtga

SEQ ID NO: 8439 - RNA, 9879 nt, synthetic construct
  misc_feature 1..9879: note = derived and/or modified CDS sequence (opt1) from DENV-1__FJ410284__SS-prME
  source 1..9879: mol_type = other RNA
agcgtgaccatgctgctcatgctgatgcccaccgccctggccttccacctcaccacccgcggcggggagccccacatgatcgtgaccaagcaggagcggggcaagagcctgctgttcaagaccagcgcgggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtgacctacgggacctgcagccagacgggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcatccagaacggccggctgatcacggccaacccgatcgtgaccgacaaggagaagcccgtgaacatcgaggccgagccgcccttcggggagtcctacatcgtcatcggcgtgggcgagaaggcgctgaagctcagctggttcaagaaggggtccagcatcggcaagatgttcgaggccaccgcccgcggggcccggcgcatggccatcctgggcgacaccgcgtgggacttcgggtccatcggcggcgtgttcacgagcgtcgggaagctggtgcaccagatcttcggcaccgcctacggggtcctgttctccggcgtcagctggaccatgaagatcgggatcggcgtgctgctgacctggctcggcctgaactcccgcagcacgtccctgagcatgacctgcatcgccgtggggctcgtcaccctgtacctgggcgtgatggtgcaggccgactccgggtgcgtcatcaactggaagggccgggagctcaagtgcgggagcggcatcttcgtgaccaacgaggtgcacacgtggaccgagcagtacaagttccaggccgacagcccgaagcgcctgtccgcggccatcggcaaggcctgggaggagggggtctgcggcatccggagcgccacccgcctggagaacatcatgtggaagcagatctccaacgagctcaaccacatcctgctggagaacgacatgaagttcaccgtggtggtcggggacgtggtgggcatcctcgcccaggggaagaagatgatccggccccagcccatggagcacaagtacagctggaagtcctggggcaaggcgaagatcatcggcgccgacgtccagaacaccacgttcatcatcgacgggcccaacaccccggagtgccccgacgaccagcgcgcctggaacatctgggaggtggaggactacggcttcgggatcttcaccaccaacatctggctgaagctgcgggacagctacacgcaggcctgcgaccaccgcctcatgtccgcggccatcaaggacagcaaggccgtgcacgccgacatgggctactggatcgagtccgagaagaacgagacctggaagctggcccgggcgagcttcatcgaggtcaagacctgcatctggcccaagtcccacaccctgtggagcaacggcgtgctcgagtccgagatggtgatccccaagatctacgggggcccgatcagccagcacaactaccgccccgggtacttcacgcagaccgccggcccctggcacctggggaagctggagctcgacttcgacctgtgcgagggcaccaccgtcgtggtggacgagcactgcggcaaccgggggccgtccctgcgcacgaccaccgtcaccggcaagatcatccacgagtggtgctgccggagctgcacgctgccgcccctccgcttcaagggggaggacggctgctggtacgggatggagatccggcccgtgaaggagaaggaggagaacctggtgaagtccatggtcagcgccggcagcggcgaggtggactccttcagcctcgggctgctgtgcatctccatcatgatcgaggaggtgatgcgcagccggtggtcccgcaagatgctcatgaccggcaccctggccgtcttcctgctcctgatcatggggcagctgacctggaacgacctcatccggctgtgcatcatggtgggcgccaacgcgagcgaccgcatggggatgggcacgacctacctggccctcatggccaccttcaagatgcgcccgatgttcgccgtgggcctgctgttccggcgcctcacctcccgggaggtcctgctgctcacgatcgggctgagcctggtggcctccgtcgagctccccaacagcctggaggagctgggcgacgggctcgcgatgggcatcatgatcctgaagctgctcaccgacttccagtcccaccagctgtgggccaccctgctcagcctgaccttcatcaagacgaccctgtccctccactacgcctggaagaccatggccatggtgctgagcatcgtgtccctgttccccctctgcctgagcaccacgtcccagaagaccacctggctgcccgtcctcctgggcagcctggggtgcaagccgctcaccatgttcctgatcgcggagaacaagatctggggccgcaagtcctggcccctgaacgaggggatcatggccgtgggcgtggtcagcatcctcctgagctccctgctcaagaacgacgtgcccctggccgggcccctgatcgccggcggcatgctcatcgcctgctacgtgatcagcgggtccagcgcggacctgtccctggagaaggccgccgaggtcagctgggaggaggaggccgagcactccggcgccagccacaacatcctcgtggaggtgcaggacgacgggacgatgaagatcaaggacgaggagaaggacgacaccctgaccatcctgctcaaggcgaccctgctggccgtctccggcgtgtacccgctcagcatccccgccaccctgttcgtgtggtacttctggcagaagaagaagcagcggtccggggtcctgtgggacacgcccagcccgcccgaggtggagcgcgccgtgctggacgacggcatctaccggatcatgcagcgcggcctcctggggcggtcccaggtcggcgtgggggtgttccaggagaacgtcttccacaccatgtggcacgtgacccgcggcgccgtgctgatgtaccaggggaagcggctcgagcccagctgggcgtccgtcaagaaggacctgatcagctacggcggcgggtggcgcctgcagggctcctggaacaccggggaggaggtccaggtgatcgccgtcgagcccggcaagaaccccaagaacgtgcagacggcccccgggaccttcaagacccccgagggcgaggtgggcgccatcgccctcgacttcaagcccgggaccagcggctcccccatcgtcaaccgggaggggaagatcgtgggcctgtacggcaacggggtggtcacgaccagcggcacctacgtgagcgcgatcgcccaggccaaggcctcccaggaggggccgctgcccgagatcgaggacgaggtgttccgcaagcggaacctcaccatcatggacctgcaccccggcagcgggaagacgcgccggtacctgccggcgatcgtccgcgaggccaccaagcggaagctccgcaccctgatcctggcccccacccgggtggtggcctccgagatggccgaggcgctcaagggcatgcccatccgctaccagacgaccgccgtcaagagcgagcacaccggcaaggagatcgtggacctgatgtgccacgccaccttcacgatgcgcctgctctcccccgtgcgggtcccgaactacaacatgatcatcatggacgaggcccacttcaccgaccccagctccatcgccgcgcgcgggtacatcagcacccgggtgggcatgggggaggccgccgccatcttcatgaccgccacgccgcccggctccgtggaggcgttcccgcagagcaacgccgtcatccaggacgaggagcgcgacatccccgagcggtcctggaacagcgggtacgagtggatcaccgacttccccggcaagaccgtgtggttcgtgccctccatcaagagcggcaacgacatcgccaactgcctgcgcaagaacgggaagcgggtcatccagctgtcccgcaagaccttcgacacggagtaccagaagaccaagaacaacgactgggactacgtggtgaccaccgacatcagcgagatgggcgccaacttccgggcggaccgcgtcatcgacccgcggcgctgcctcaagcccgtgatcctgaaggacgggcccgagcgggtcatcctggccggccccatgccggtgacggtggcctccgccgcccagcgccgggggcgcatcggccggaaccacaacaaggagggcgaccagtacatctacatggggcagcccctcaacaacgacgaggaccacgcgcactggaccgaggccaagatgctgctggacaacatcaacacccccgagggcatcatccccgccctcttcgagccggagcgcgagaagtccgccgccatcgacggggagtaccggctgcgcggcgaggcgcgcaagaccttcgtcgagctgatgcggcgcggggacctccccgtgtggctgtcctacaaggtggccagcgagggcttccagtacagcgaccggcgctggtgcttcgacggcgagcggaacaaccaggtcctggaggagaacatggacgtggagatctggacgaaggagggggagcgcaagaagctccggccccgctggctggacgcccggacctactccgaccccctggccctccgcgagttcaaggagttcgccgcgggccggcgcagcgtgtccggggacctgatcctggagatcggcaagctcccgcagcacctgacccagcgggcccagaacgccctggacaacctcgtcatgctgcacaacagcgagcagggcgggcgcgcctaccggcacgcgatggaggagctgcccgacaccatcgagacgctcatgctgctggccctcatcgccgtgctgaccggcggggtgaccctgttcttcctctccggccgcgggctgggcaagaccagcatcggcctgctctgcgtcatggcctccagcgtgctgctgtggatggcctccgtggagccccactggatcgcggccagcatcatcctcgagttcttcctgatggtcctgctcatccccgagccggaccggcagcgcacgccccaggacaaccagctggcctacgtggtgatcgggctcctcttcatgatcctgacggtcgccgccaacgagatgggcctgctcgagaccaccaagaaggacctggggatcggccacgtggcggtggagaaccaccaccacgccaccatgctggacgtcgacctccaccccgcctccgcctggacgctgtacgccgtggcgaccaccatcatcaccccgatgatgcggcacacgatcgagaacaccaccgccaacatcagcctgaccgccatcgccaaccaggccgcgatcctcatggggctggacaagggctggcccatctccaagatggacatcggcgtgcccctgctcgccctggggtgctacagccaggtcaaccccctgacgctcaccgccgccgtgctgatgctggtggcgcactacgccatcatcggcccggggctccaggccaaggccacccgcgaggcccagaagcggaccgcggccggcatcatgaagaaccccacggtcgacgggatcgtggccatcgacctggaccccgtggtctacgacgccaagttcgagaagcagctgggccagatcatgctcctgatcctgtgcacctcccagatcctcctgatgcgcaccacctgggccctgtgcgagagcatcacgctcgcgaccggccccctgaccaccctgtgggaggggtccccgggcaagttctggaacacgaccatcgccgtgagcatggccaacatcttccgcgggtcctacctcgccggcgccggcctggcgttcagcctgatgaagtccctcgggggcgggcggcgcggcaccggggcccagggcgagaccctgggcgagaagtggaagcggcagctgaaccagctctccaagagcgagttcaacatctacaagcgctccgggatcatggaggtggaccggagcgaggccaaggagggcctgaagcgcggggagacgacccggcacgccgtctcccgcggcaccgcgaagctgcggtggttcgtggagcgcaacctggtgaagcccgaggggaaggtcatcgacctcggctgcggccgcggcgggtggagctactactgcgccgggctgaagaaggtgaccgaggtgaaggggtacacgaagggcgggcccggccacgaggagcccatcccgatggccacctacgggtggaacctggtcaagctccactccggcaaggacgtgttcttcacgccgcccgagaagtgcgacaccctgctgtgcgacatcggggagagctcccccaacccgacgatcgaggagggccgcaccctccgggtgctgaagatggtcgagccctggctgcgcgggaaccagttctgcatcaagatcctcaacccctacatgcccagcgtggtggagaccctggagcagatgcagcggaagcacggcggcatgctggtccgcaacccgctctcccggaacagcacccacgagatgtactgggtgtcctgcgggaccggcaacatcgtgagcgccgtcaacatgacgtcccgcatgctgctgaaccggttcaccatggcccaccgcaagcccacctacgagcgcgacgtggacctcggggcgggcacccggcacgtggccgtcgagcccgaggtggccaacctggacatcatcggccagcgcatcgagaacatcaagcacgagcacaagagcacgtggcactacgacgaggacaacccctacaagacctgggcctaccacgggtcctacgaggtcaagccgagcggctccgccagcagcatggtgaacggggtggtcaagctgctcaccaagccctgggacgtgatccccatggtgacccagatcgcgatgacggacaccacccccttcggccagcagcgggtcttcaaggagaaggtggacacccgcacgccgaaggccaagcgggggaccgcccagatcatggaggtgaccgcccgctggctgtggggcttcctgtcccggaacaagaagccccgcatctgcacccgggaggagttcacgcgcaaggtccggagcaacgccgcgatcggcgccgtgttcgtggacgagaaccagtggaactccgccaaggaggccgtcgaggacgagcgcttctgggacctcgtgcagaaggagcgggagctgcacaagcaggggaagtgcgcgacctgcgtgtacaacatgatgggcaagcgcgagaagaagctgggggagttcggcaaggccaaggggagccgggccatctggtacatgtggctcggcgcccgcttcctggagttcgaggccctgggcttcatgaacgaggaccactggttctcccgggagaacagcctctccggggtcgagggcgaggggctgcacaagctgggctacatcctccgcgacatcagcaagatccccgggggcaacatgtacgcggacgacaccgccggctgggacacccggatcacggaggacgacctgcagaacgaggccaagatcaccgacatcatggagccggagcacgccctgctcgccacctccatcttcaagctgacctaccagaacaaggtggtgcgcgtccagcggcccgcgaagaacgggacggtgatggacgtgatcagccgccgcgaccagcggggctccgggcaggtcggcacctacggcctgaacaccttcaccaacatggaggcccagctcatccgccagatggagagcgaggggatcttcctgccctccgagctggagacgcccaacctcgccgagcgggtgctggactggctggagaagcacggcgtggagcgcctcaagcggatggccatcagcggggacgactgcgtcgtgaagccgatcgacgaccgcttcgccaccgcgctgaccgccctgaacgacatgggcaaggtgcggaaggacatcccccagtgggagccctccaaggggtggaacgactggcagcaggtccccttctgcagccaccacttccaccagctcatcatgaaggacggccgcgagatcgtggtgccgtgccggaaccaggacgagctggtcggccgcgcccgggtgtcccagggggccggctggagcctgcgcgagaccgcctgcctcggcaagagctacgcgcagatgtggcagctgatgtacttccaccggcgcgacctgcggctcgccgccaacgccatctgctccgcggtgcccgtcgactgggtgcccacgagccgcaccacctggtccatccacgcccaccaccagtggatgaccacggaggacatgctgagcgtgtggaaccgggtctggatcgaggagaacccctggatggaggacaagacccacgtgtccagctggggcgacgtgccgtacctggggaagcgcgaggaccagtggtgcggctccctcatcggcctgaccgcccgggccacctgggccagcaacatccaggtcgcgatcaaccaggtgcgccgcctgatcgggaacgagaactacctcgactacatgacctccatgaagcggttcaagaacgagggcgaccccgagggggccctgtggtga

SEQ ID NO: 8440 - RNA, 9879 nt, synthetic construct
  misc_feature 1..9879: note = derived and/or modified CDS sequence (opt1) from DENV-1__FJ410285__SS-prME
  source 1..9879: mol_type = other RNA
agcgtgaccatgctgctcatgctgatgcccaccgccctggccttccacctcaccacccgcggcggggagccgcacatgatcgtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgagaccgagcccgacgacgtggactgctggtgcaacgccaccgacacctgggtgacctacgggacctgcagccagacgggcgagcaccggcgcgacaagcggagcgtggccctcgcgccccacgtgggcctggggctggagacccgcaccgagacctggatgagctccgagggcgcctggaagcagatccagcgggtggagacgtgggccctccgccaccccgggttcaccgtgatcgccctgttcctggcccacgtgatcggcaccagcatcacccagaaggggatcatcttcatcctcctgatgctggtcacgccctccatggcgatgcggtgcgtgggcatcggcagccgcgacttcgtggaggggctctccggcgccacctgggtcgacgtggtgctggagcacgggagctgcgtcaccaccatggccaaggacaagcccacgctggacatcgagctcctgaagaccgaggtgaccaaccccgccgtgctgcggaagctctgcatcgaggccaagatctccaacaccacgaccgacagccgctgcccgacccagggcgaggcgaccctggtcgaggagcaggacgccaacttcgtgtgccggcgcacgttcgtggaccggggctgggggaacggctgcgggctgttcggcaaggggtccctcatcacgtgcgccaagttcaagtgcgtcaccaagctggagggcaagatcgtgcagcacgagaacctgaagtacagcgtgatcgtcaccgtgcacacgggcgaccagcaccaggtcgggaacgagtccaccgagcacggcaccaccgccaccatcacgccccaggcccccaccaccgagatccagctcaccgactacggggcgctgagcctggactgcagcccccggacgggcctcgacttcaacgagatggtgctgctgaccatgaaggagaagtcctggctcgtgcacaagcagtggttcctggacctgccgctcccctggaccagcggggcctccaccagccaggagacgtggaaccggcaggacctgctggtcaccttcaagaccgcccacgccaagaagcaggaggtggtggtcctcggctcccaggagggcgccatgcacaccgcgctgacgggggccaccgagatccagaccagcggcaccacgaccatcttcgccgggcacctgaagtgccgcctcaagatggacaagctgaccctgaagggcatgtcctacgtgatgtgcaccgggagcttcaagctcgagaaggaggtggccgagacgcagcacggcaccgtcctggtgcagatcaagtacgagggcaccgacgccccctgcaagatccccttctccacccaggacgagaagggggtgacgcagaacggccggctgatcaccgcgaacccgatcgtcaccgacaaggagaagcccgtgaacatcgaggccgagccgcccttcggggagagctacatcatcatcggcgccggcgagaaggccctgaagctctcctggttcaagaaggggagctccatcggcaagatgttcgaggcgaccgcccgcggggcccggcgcatggccatcctgggcgacacggcctgggacttcgggagcatcggcggcgtgttcacctccgtcgggaagctggtgcaccagatcttcggcaccgcgtacggggtgctgttcagcggcgtctcctggaccatgaagatcgggatcggcgtgctgctgacgtggctcggcctgaacagccgctccaccagcctgtccatgacctgcatcgccgtggggctcgtcaccctgtacctgggcgtgatggtgcaggccgacagcgggtgcgtcatcaactggaagggccgggagctcaagtgcgggagcggcatcttcgtgacgaacgaggtgcacacctggaccgagcagtacaagttccaggccgactccccgaagcgcctgagcgccgcgatcggcaaggcctgggaggagggggtctgcggcatccggtccgccacccgcctggagaacatcatgtggaagcagatcagcaacgagctcaaccacatcctgctggagaacgacatgaagttcaccgtggtggtcggggacgtggccggcatcctcgcccaggggaagaagatgatccggccccagcccatggagtacaagtactcctggaagtcctggggcaaggcgaagatcatcggcgccgacgtgcagaacacgaccttcatcatcgacgggcccaacaccccggagtgccccgacgaccagcgcgcctggaacatctgggaggtcgaggactacggcttcgggatcttcaccacgaacatctggctgaagctgcgggactcctacacccaggtgtgcgaccaccgcctcatgagcgccgcgatcaaggactccaaggccgtgcacgccgacatgggctactggatcgagagcgagaagaacgagacctggaagctggcccgggcctccttcatcgaggtcaagacctgcatctggcccaagagccacacgctgtggtccaacggcgtgctcgagagcgagatgatcatccccaagatctacgggggcccgatctcccagcacaactaccgccccgggtacttcacccagaccgcgggcccctggcacctggggaagctggagctcgacttcgacctgtgcgagggcaccacggtggtcgtggacgagcactgcggcaaccgggggccgagcctgcgcaccaccaccgtgacgggcaagatcatccacgagtggtgctgccggtcctgcaccctgccgcccctccgcttccgcggggaggacggctgctggtacgggatggagatccgccccgtcaaggagaaggaggagaacctggtcaagagcatggtgagcgccggcccgggcgaggtcgactccttcagcctcgggctgctgtgcatctccatcatgatcgaggaggtgatgcggagccgctggtcccggaagatgctcatgaccggcaccctggccgtgttcttcctgctcatcatggggcagctgacgtggaacgacctgatccgcctctgcatcatggtcggcgccaacgccagcgaccgcatggggatgggcaccacctacctggcgctgatggccaccttcaagatgcggcccatgttcgccgtgggcctcctgttccgccggctgacgtcccgcgaggtgctcctgctgaccatcgggctcagcctggtcgcctccgtggagctgcccaacagcctcgaggagctgggcgacgggctggccatgggcatcatgatcctcaagctgctggcggacttccagtcccaccagctctgggccaccctgctgagcctcaccttcatcaagacgaccttctccctgcactacgcctggaagaccatggccatggtcctgagcatcgtgtccctcttccccctgtgcctgagcaccacgtcccagaagaccacctggctcccggtgctgctgggcagcctcgggtgcaagcccctgaccatgttcctgatcgcggagaacaagatctggggccggcgctcctggcccctcaacgaggggatcatggccgtcggcatcgtgagcatcctgctgagctccctcctgaagaacgacgtgcccctggccgggccgctcatcgccggcggcatgctgatcgcctgctacgtcatcagcgggtccagcgcggacctgtccctcgagaaggccgccgaggtgagctgggaggaggaggccgagcactccggcgccagccacaacatcctggtggaggtccaggacgacgggacgatgaagatcaaggacgaggagcgggacgacaccctgaccatcctcctgaaggcgaccctgctcgccgtgtccggcgtgtaccccctgagcatccccgccaccctgttcgtctggtacttctggcagaagaagaagcagcgctccggggtgctctgggacacgcccagcccgcccgaggtggagcgggccgtcctggacgacggcatctaccgcatcatgcagcggggcctgctggggcgctcccaggtgggcgtgggggtcttccaggagaacgtgttccacaccatgtggcacgtgacccggggcgccgtcctcatgtaccaggggaagcgcctggagcccagctgggcgtccgtgaagaaggacctgatcagctacggcggcgggtggcggctccagggctcctggaacaccggggaggaggtgcaggtcatcgccgtggagcccggcaagaacccgaagaacgtgcagacggcccccgggaccttcaagacccccgagggcgaggtcggcgccatcgccctggacttcaagcccgggaccagcggctccccgatcgtgaaccgcgaggggaagatcgtgggcctgtacggcaacggggtcgtgacgaccagcggcacctacgtgagcgcgatcgcccaggccaaggcctcccaggaggggcccctccccgagatcgaggacgaggtcttccggaagcgcaacctgaccatcatggacctgcacccgggcagcgggaagacgcggcgctacctccccgcgatcgtgcgggaggccatcaagcgccgcctgcggaccctgatcctcgcccccacccgcgtggtcgcctccgagatggccgaggcgctgaagggcatgcccatccggtaccagaccacggccgtcaagagcgagcacaccggcaaggagatcgtggacctgatgtgccacgccaccttcaccatgcgcctcctgtccccggtccgggtgcccaactacaacatgatcatcatggacgaggcccacttcacggaccccagctccatcgccgcgcgcgggtacatcagcacccgggtgggcatgggggaggccgccgccatcttcatgaccgccacgccgcccggctccgtcgaggcgttcccccagagcaacgccgtgatccaggacgaggagcgcgacatccccgagcggtcctggaacagcgggtacgagtggatcacggacttccccggcaagaccgtgtggttcgtcccctccatcaagagcggcaacgacatcgccaactgcctgcgcaagaacgggaagcgggtgatccagctctcccgcaagaccttcgacaccgagtaccagaagacgaagaacaacgactgggactacgtggtcaccaccgacatcagcgagatgggcgccaacttccgggcggaccgcgtgatcgacccccggcgctgcctgaagcccgtgatcctgaaggacgggcccgagcgggtcatcctcgccggcccgatgcccgtgaccgtcgcctccgccgcccagcgccgggggcgcatcggccgcaaccacaacaaggagggcgaccagtacatctacatggggcagcccctgaacaacgacgaggaccacgcgcactggacggaggccaagatgctgctcgacaacatcaacacccccgagggcatcatcccggccctgttcgagcccgagcgggagaagtccgccgccatcgacggggagtaccgcctgcggggcgaggcgcgcaagaccttcgtggagctcatgcggcgcggggacctgcccgtgtggctgtcctacaaggtcgccagcgagggcttccagtacagcgaccggcgctggtgcttcgacggcgagcggaacaaccaggtgctcgaggagaacatggacgtggagatctggaccaaggagggggagcgcaagaagctgcggccccgctggctggacgcccggacgtactccgacccgctcgccctgcgcgagttcaaggagttcgccgcgggccggcgcagcgtctccggggacctgatcctcgagatcggcaagctgccccagcacctgacccagcgggcccagaacgccctcgacaacctggtgatgctgcacaacagcgagcagggcgggcgcgcctaccggcacgcgatggaggagctccccgacaccatcgagaccctgatgctgctcgccctgatcgccgtgctgacgggcggggtcaccctcttcttcctgtccggccgcgggctgggcaagaccagcatcggcctcctgtgcgtgatggcctccagcgtgctgctctggatggcctccgtcgagccccactggatcgcggccagcatcatcctggagttcttcctgatggtgctcctgatcccggagcccgaccggcagcgcacgccccaggacaaccagctggcctacgtggtcatcgggctcctgttcatgatcctgaccgtggccgccaacgagatgggcctcctggagacgaccaagaaggacctggggatcggccacgtggcggtcgagaaccaccaccacgccgccatgctcgacgtggacctgcacccggcctccgcctggaccctgtacgcggtggccaccacgatcatcacccccatgatgcgccacaccatcgagaacaccacggccaacatcagcctcaccgccatcgccaaccaggcggccatcctgatggggctggacaagggctggcccatctccaagatggacatcggcgtccccctcctggccctggggtgctacagccaggtgaacccgctcaccctgaccgccgcggtgctgatgctcgtcgcccactacgccatcatcggccccgggctgcaggccaaggccacgcgggaggcgcagaagcgcaccgccgccggcatcatgaagaaccccaccgtggacgggatcgtggccatcgacctggaccccgtcgtgtacgacgccaagttcgagaagcagctcggccagatcatgctgctgatcctctgcacctcccagatcctgctgatgcggacgacctgggcgctctgcgagagcatcaccctggccaccggcccgctgacgaccctctgggaggggtcccccggcaagttctggaacaccaccatcgccgtgagcatggccaacatcttccgcgggtcctacctggccggcgcgggcctggccttcagcctcatgaagtccctcgggggcgggcggcgcgggacgggggcccagggcgagaccctgggcgagaagtggaagcggcagctcaaccagctgtccaagagcgagttcaacacctacaagcgctccgggatcatggaggtcgaccggagcgaggccaaggagggcctgaagcgcggggagaccacgaagcacgcggtgtcccggggcaccgccaagctccgctggttcgtggagcggaacctggtcaagcccgaggggaaggtgatcgacctgggctgcggccgcgggggctggagctactactgcgccgggctgaagaaggtgaccgaggtcaagggctacaccaagggcggccccggccacgaggagccgatccccatggccacgtacgggtggaacctcgtgaagctgcactccggcaaggacgtgttcttcatcccgcccgagaagtgcgacaccctgctctgcgacatcggggagagctccccgaaccccaccatcgaggagggccggaccctgcgcgtcctgaagatggtggagccctggctccgggggaaccagttctgcatcaagatcctgaacccctacatgccgagcgtggtcgagacgctggagcagatgcagcgcaagcacggcggcatgctcgtgcggaaccccctgtcccgcaacagcacccacgagatgtactgggtgtcctgcgggaccggcaacatcgtcagcgccgtgaacatgacctcccgcatgctgctcaaccggttcaccatggcgcaccgcaagcccacgtacgagcgggacgtggacctgggggccggcacccgccacgtcgccgtggagcccgaggtggccaacctggacatcatcggccagcggatcgagaacatcaagcacgagcacaagagcacctggcactacgacgaggacaacccgtacaagacctgggcctaccacgggtcctacgaggtcaagcccagcggctccgcgagcagcatggtgaacggggtcgtgaagctcctgacgaagccctgggacgtgatccccatggtcacccagatcgccatgaccgacaccacgccgttcggccagcagcgcgtgttcaaggagaaggtggacacccggacccccaaggccaagcgcgggaccgcccagatcatggaggtcacggccaagtggctgtggggcttcctctcccggaacaagaagccccgcatctgcacccgggaggagttcacccgcaaggtgcggagcaacgcggccatcggcgccgtgttcgtcgacgagaaccagtggaactccgccaaggaggcggtggaggacgagcgcttctgggacctggtgcaccgggagcgcgagctgcacaagcaggggaagtgcgcgacctgcgtctacaacatgatgggcaagcgggagaagaagctcggggagttcggcaaggccaaggggagccgcgccatctggtacatgtggctgggcgcccggttcctggagttcgaggcgctcggcttcatgaacgaggaccactggttctcccgcgagaacagcctgtccggggtggagggcgaggggctgcacaagctcggctacatcctgcgggacatcagcaagatccccgggggcaacatgtacgccgacgacacggccggctgggacacccgcatcaccgaggacgacctgcagaacgaggcccgcatcaccgacatcatggagcccgagcacgccctcctggcgaagtccatcttcaagctgacgtaccagaacaaggtggtccgggtgcagcgccccgccaagaacgggaccgtgatggacgtcatcagccggcgcgaccagcggggctccggccaggtggggacctacggcctcaacaccttcacgaacatggaggcccagctgatccgccagatggagagcgaggggatcttctcccccagcgagctggagaccccgaacctcgccgagcgggtgctggactggctggagaagtacggcgtcgagcgcctcaagcggatggccatctccggggacgactgcgtggtgaagcccatcgacgaccgcttcgcgaccgccctgaccgccctgaacgacatgggcaaggtccggaaggacatcccccagtgggagcccagcaaggggtggaacgactggcagcaggtcccgttctgctcccaccacttccaccagctcatcatgaaggacggccgcgagatcgtggtcccctgccggaaccaggacgagctggtgggccgcgcccgggtgagccagggggccggctggagcctgcgcgagacggcgtgcctcgggaagtcctacgcccagatgtggcagctgatgtacttccaccggcgcgacctgcggctcgccgccaacgcgatctgcagcgccgtccccgtggactggatccccacctcccgcaccacctggagcatccacgcccaccaccagtggatgacgaccgaggacatgctgtccgtgtggaaccgcgtctggatcgaggagaacccgtggatggaggacaagacccacatcagctcctggggcgacgtgccctacctggggaagcgggaggaccagtggtgcggcagcctcatcggcctgaccgcccgcgccacgtgggcgaccaacatccaggtggccatcaaccaggtccggcgcctgatcgggaacgagaactacctcgactacatgacctccatgaagcggttcaagaacgagagcgaccccgagggcgccctgtggtga

SEQ ID NO: 8441 - RNA, 9879 nt, synthetic construct
  misc_feature 1..9879: note = derived and/or modified CDS sequence (opt1) from DENV-1__FJ410286__SS-prME
  source 1..9879: mol_type = other RNA
agcgtgaccatgctgctcatgctgatgcccaccgccctggccttccacctcaccacccggggcggggagccccacatgatcgtcagcaagcaggagcggggcaagagcctgctgttcaagaccagcgccggggtgaacatgtgcaccctcatcgccatggacctgggcgagctgtgcgaggacacgatgacctacaagtgcccccggatcaccgaggccgagcccgacgacgtggactgctggtgcaacgccaccgacacgtgggtcacctacgggacctgcagccagaccggcgagcaccggcgcgagaagcggtccgtggccctcgcgccccacgtgggcctggggctggagacgcgcaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcctgacgtgcgccaagttcaagtgcgtgaccaagctggagggcaagatcgtccagtacgagaacctcaagtacagcgtgatcgtgaccgtccacaccggcgaccagcaccaggtggggaacgagtccacggagcacggcaccaccgcgaccatcacgccccaggcccccacgaccgagatccagctgaccgactacggggccctgaccctcgactgcagcccccgcacgggcctggacttcaacgagatggtcctgctcaccatgaaggagaagtcctggctggtgcacaagcagtggttcctggacctccccctgccctggaccagcggggccagcacctcccaggagacgtggaaccggcaggacctgctcgtgaccttcaagaccgcccacgcgaagaagcaggaggtcgtggtgctgggcagccaggagggcgccatgcacaccgccctgacgggggccaccgagatccagacctccggcaccacgaccatcttcgccgggcacctcaagtgccgcctgaagatggacaagctgaccctcaagggcatgagctacgtcatgtgcaccgggtccttcaagctggagaaggaggtggcggagacgcagcacggcaccgtgctggtccagatcaagtacgagggcaccgacgccccctgcaagatccccttcagcacccaggacgggaagggcgtgacgcagaacgggcggctgatcaccgccaacccgatcgtgaccgacaaggagaagcccgtcaacatcgaggccgagccgcccttcggcgagtcctacatcgtgatcggcgcgggggagaaggccctcaagctgagctggttcaagaagggctccagcatcgggaagatgttcgaggccaccgcccgcggcgcccggcgcatggcgatcctgggggacacggcctgggacttcggctccatcggcggggtgttcaccagcgtcggcaagctcgtgcaccagatcttcgggaccgcctacggcgtgctgttctccggggtcagctggaccatgaagatcggcatcggcgtgctgctcacgtggctggggctgaactcccgcagcacctccctcagcatgacctgcatcgccgtgggcctggtcaccctgtacctcggggtgatggtgcaggccgactccggctgcgtcatcaactggaaggggcgggagctgaagtgcggcagcggcatcttcgtgacgaacgaggtgcacacctggaccgagcagtacaagttccaggcggacagcccgaagcgcctgtccgccgccatcgggaaggcctgggaggagggcgtctgcgggatccggagcgccacccgcctcgagaacatcatgtggaagcagatctccaacgagctgaaccacatcctgctcgagaacgacatgaagttcaccgtggtggtcggcgacgtggcggggatcctggtgcagggcaagaagatgatccggccccagcccatggagtacaagtacagctggaagtcctggggcaaggccaagatcatcggggccgacgtccagaacagcacgttcatcatcgacggccccaacaccccggagtgccccgacgaccagcgcgcctggaacatctgggaggtggaggactacgggttcggcatcttcaccaccaacatctggctgaagctccgggactcctacacccaggtgtgcgaccaccgcctgatgagcgcggccatcaaggactccaaggccgtccacgccgacatgggctactggatcgagagcgagaagaacgagacctggaagctggcccgggcgtccttcatcgaggtgaagacctgcatctggcccaagagccacaccctctggtccaacggggtgctggagagcgagatgatcatccccaagatccacggcgggccgatctcccagcacaactaccgccccggctacttcacgcagaccgccgggccctggcacctgggcaagctcgagctggacttcgacctgtgcgagggcaccaccgtcgtggtggacgagcactgcgggaaccggggcccgagcctccgcacgaccaccgtcaccgggaagatcatccacgagtggtgctgccggtcctgcacgctgccgcccctgcgcttccggggcgaggacgggtgctggtacggcatggagatccgccccgtgaaggagaaggaggagaacctcgtgaagtccatggtcagcgccggctccggggaggtggacagcttctccctgggcctgctctgcatcagcatcatgatcgaggaggtgatgcggtcccgctggagccggaagatgctgatgaccgggaccctggccgtcttcttcctcctgatcatgggccagctgacctggaacgacctcatccgcctgtgcatcatggtgggggccaacgcgtccgaccgcatgggcatgggcacgacctacctggccctcatggccaccttcaagatgcggccgatgttcgccgtggggctgctgttccgccggctcaccagccgcgaggtcctgctgctcacgatcggcctgtccctggtggccagcgtcgagctccccaactccctggaggagctgggggacggcctcgcgatgggcatcatgatcctgaagctgctcaccgacttccagagctaccagctgtgggccaccctgctctccctgaccttcatcaagacgaccttcagcctgcactacgcctggaagaccatggccatggtgctctccatcgtgagcctgttccccctgtgcctctccaccacgagccagaagaccacctggctgcccgtcctgctcgggtccctgggctgcaagccgctgaccatgttcctcatcgcggagaacaagatctgggggcgcaagagctggcccctgaacgagggcatcatggccgtggggatcgtgagcatcctgctctccagcctgctgaagaacgacgtccccctcgccggccccctgatcgccggcgggatgctgatcgcctgctacgtgatctccggcagctccgcggacctcagcctggagaaggccgccgaggtgtcctgggaggaggaggccgagcacagcggggcctcccacaacatcctggtcgaggtgcaggacgacggcacgatgaagatcaaggacgaggagcgcgacgacaccctcaccatcctgctgaaggcgaccctcctggccgtgagcggggtctacccgctgtccatccccgccaccctcttcgtgtggcacttctggcagaagaagaagcagcggagcggcgtgctgtgggacacgcccagcccgcccgaggtcgagcgcgccgtgctggacgacggcatctaccggatcatgcagcgcgggctgctcggccggagccaggtgggggtcggcgtgttccaggagaacgtgttccacaccatgtggcacgtcacccgcggggccgtgctgatgtaccagggcaagcggctggagccctcctgggcgagcgtgaagaaggacctcatctcctacggcgggggctggcgcttccaggggagctggaacaccggcgaggaggtccaggtgatcgccgtggagcccgggaagaaccccaagaacgtccagacggcccccggcaccttcaagacccccgagggcgaggtgggggccatcgccctggacttcaagcccggcacctccgggagccccatcgtgaaccgggagggcaagatcgtcggcctgtacgggaacggcgtggtgacgaccagcgggacctacgtctccgcgatcgcccaggccaaggccagccaggagggcccgctccccgagatcgaggacgaggtgttccgcaagcggaacctgaccatcatggacctgcaccccgggtccggcaagacgcgccggtacctcccggcgatcgtgcgcgaggccatcaagcggaagctgcgcaccctgatcctcgcccccacccgcgtcgtggccagcgagatggccgaggcgctgaagggcatgcccatccggtaccagaccacggccgtgaagtccgagcacaccgggaaggagatcgtcgacctgatgtgccacgccaccttcaccatgcgcctcctgagccccgtgcgggtgccgaactacaacatgatcatcatggacgaggcccacttcacggacccctccagcatcgccgcgcgcggctacatctccacccgggtcgggatgggcgaggccgccgccatcttcatgaccgccacgccgcccgggagcatggaggcgttcccgcagtccaacgccgtgatccaggacgaggagcgcgacatccccgagcggagctggaactccggctacgagtggatcacggacttccccggcaagaccgtgtggttcgtccccagcatcaaggccgggaacgacatcgccaactgcctgcgcaagaacggcaagcgggtgatccagctctcccgcaagaccttcgacaccgagtaccagaagacgaagaacaacgactgggactacgtggtcaccaccgacatcagcgagatgggggcgaacttccgggccgaccgcgtgatcgacccgcggcgctgcctgaagcccgtgatcctgaaggacggccccgagcgggtcatcctcgccgggcccatgccggtgaccgtcgcctccgccgcgcagcgccggggccgcatcggccggaaccacaacaaggagggggaccagtacatctacatgggccagcccctgaacaacgacgaggaccacgcccactggacggaggccaagatgctgctcgacaacatcaacacccccgaggggatcatccccgccctgttcgagccggagcgcgagaagtccgccgcgatcgacggcgagtaccgcctgcgcggggaggcccgcaagaccttcgtggagctcatgcggcgcggcgacctgcccgtgtggctgtcctacaaggtcgccagcgagggcttccagtacagcgaccggcgctggtgcttcgacggggagcggaacaaccaggtgctcgaggagaacatggacgtggagatctggaccaaggagggcgagcgcaagaagctgcggccccgctggctggacgcccggacgtactccgaccccctcgccctgcgcgagttcaaggagttcgcggccgggcggcgcagcgtctccggcgacctgatcctcgagatcggcaagctgccgcagcacctgacccagcgggcccagaacgccctcgacaacctggtgatgctgcacaacagcgagcagggcgggcgcgcgtaccggcacgccatggaggagctccccgacaccatcgagaccctgatgctgctcgccctgatcgccgtgctgaccggcggggtcaccctcttcttcctgtccgggaaggggctgggcaagaccagcatcgggctcctgtgcgtgatggcctccagcgtgctgctctggatggcgtccgtcgagccccactggatcgccgccagcatcatcctggagttcttcctgatggtgctcctgatccccgagccggaccgccagcggacgccccaggacaaccagctggcctacgtggtcatcggcctcctgttcatgatcctgaccgtggccgcgaacgagatggggctcctggagacgaccaagaaggacctgggcatcgggcacgtggccgtcgagaaccaccaccacgccgccatgctcgacgtggacctgcaccccgcctccgcgtggaccctgtacgccgtggccaccacgatcatcaccccgatgatgcgccacaccatcgagaacaccacggccaacatcagcctcaccgccatcgcgaaccaggccgccatcctgatgggcctggacaagggctggcccatctccaagatggacatcggggtccccctcctggccctgggctgctacagccaggtgaaccccctcaccctgaccgcggccgtgctgatgctcgtcgcccactacgccatcatcgggccgggcctgcaggccaaggcgacgcgggaggcccagaagcgcaccgccgccgggatcatgaagaaccccaccatcgacggcatcgtggccatcgacctggaccccgtggtctacgacgcgaagttcgagaagcagctcggccagatcatgctgctgatcctctgcacctcccagatcctgctgatgcgcacgacctgggccctctgcgagagcatcaccctggccaccgggcccctgacgaccctctgggagggctccccggggaagttctggaacaccaccatcgccgtgagcatggccaacatcttccggggctcctacctggcgggcgccgggctggccttcagcctcatgaagtccctgggcgggggccgccgggggacgggcgcccagggcgagaccctgggggagaagtggaagcgccagctcaaccagctgtccaagagcgagttcaacacctacaagcggtccggcatcatggaggtggaccgcagcgaggcgaaggaggggctgaagcggggcgagaccacgaagcacgccgtctcccgcgggaccgccaagctccggtggttcgtggagcgcaacctggtgaagcccgagggcaaggtcatcgacctgggctgcgggcggggcgggtggagctactactgcgccggcctgaagaaggtgaccgaggtgaaggggtacaccaagggcggccccgggcacgaggagcccatcccgatggccacgtacggctggaacctcgtcaagctgcactccgggaaggacgtgttcttcatcccgcccgagaagtgcgacaccctgctctgcgacatcggcgagagctcccccaacccgaccatcgaggaggggcgcaccctgcgggtgctgaagatggtcgagccctggctccgcggcaaccagttctgcatcaagatcctgaacccctacatgcccagcgtggtggagacgctggagcagatgcagcggaagcacggcgggatgctcgtccgcaacccgctgtcccggaacagcacccacgagatgtactgggtgtcctgcggcaccgggaacatcgtgagcgcggtcaacatgacctcccgcatgctgctcaaccggttcaccatggcccaccgcaagcccacgtacgagcgcgacgtggacctgggcgccggcacccggcacgtggccgtcgagcccgaggtggccaacctggacatcatcgggcagcgcatcgagaacatcaagcacgagcacaagagcacctggcactacgacgaggacaacccctacaagacctgggcgtaccacggctcctacgaggtgaagccgagcgggtccgccagcagcatggtcaacggcgtggtcaagctcctgacgaagccctgggacgtgatccccatggtgacccagatcgccatgaccgacaccacgcccttcgggcagcagcgggtcttcaaggagaaggtggacacccgcaccccgaaggccaagcggggcaccgcccagatcatggaggtgacggcgcgctggctgtggggcttcctctcccggaacaagaagccccgcatctgcacccgggaggagttcacccgcaaggtccggagcaacgccgccatcggggccgtgttcgtggacgagaaccagtggaactccgcgaaggaggccgtcgaggacgaccgcttctgggacctggtgcaccgggagcgcgagctgcacaagcagggcaagtgcgcgacctgcgtgtacaacatgatggggaagcgggagaagaagctcggcgagttcgggaaggccaagggcagccgcgccatctggtacatgtggctgggcgcgcggttcctggagttcgaggccctcgggttcatgaacgaggaccactggttctcccgcgagaacagcctgtccggcgtcgagggggagggcctgcacaagctcgggtacatcctgcgggacatcagcaagatccccggcggcaacatgtacgccgacgacacggccgggtgggacacccgcatcaccgaggacgacctgcagaacgaggccaagatcaccgacatcatggagccggagcacgcgctcctggccaagtccatcttcaagctgacgtaccagaacaaggtggtgcgggtccagcgccccgccaagaacggcaccgtgatggacgtgatcagccgccgggaccagcgcgggtccggccaggtcggcacctacgggctcaacaccttcacgaacatggaggcccagctgatccggcagatggagagcgagggcatcttcctgcccaacgagctcgagacccccaacctggccgggcgcgtgctggactggctcgagaagtacggcgtggagcggctgaagcgcatggcgatctccggggacgactgcgtcgtgaagccgatcgacgaccggttcgccaccgccctgaccgccctcaacgacatgggcaaggtgcgcaaggacatcccccagtgggagcccagcaagggctggaacgactggcagcaggtccccttctgctcccaccacttccaccagctgatcatgaaggacgggcgggagatcgtggtgccgtgccgcaaccaggacgagctggtcggccgggcccgcgtgagccagggggcgggctggtccctccgggagacggcctgcctgggcaagagctacgcccagatgtggcagctgatgtacttccaccgccgggacctccgcctggccgcgaacgccatctgcagcgccgtgcccgtcgactgggtgcccacctcccggaccacctggagcatccacgcccaccaccagtggatgacgaccgaggacatgctgtccgtgtggaaccgcgtctggatcgaggagaacccctggatggaggacaagacccggatcagctcctgggaggacgtgccgtacctcggcaagcgcgaggaccagtggtgcggcagcctgatcgggctgaccgcccgcgcgacgtgggccaccaacatccaggtggccatcaaccaggtccggcgcctcatcggcaacgagaactactccgactacatgaccagcatgaagcggttcaagaacgagtccgagcccgagggggccctgtggtga

SEQ ID NO: 8442 - RNA, 9879 nt, synthetic construct
  misc_feature 1..9879: note = derived and/or modified CDS sequence (opt1) from DENV-1__FJ461339__SS-prME
  source 1..9879: mol_type = other RNA
agcgtgaccatgctgctgatgctgatgcccaccgccctggccttccacctcaccacccggggcggggagccccacatgatcgtgagcaagcaggagcggggcaagagcctgctgttcaagacctccgcgggggtgaacatgtgcaccctcatcgccatggacctgggcgagttctgcgaggacaccatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtcgagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgccccacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggaccagcggggcctccaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctcgtccagatcaagtacgagggcaccgacgccccctgcaagatccccttctccacccaggacgagaagggggtgacccagaacggccggctgatcacggccaaccccatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacaccgcctgggacttcgggagcatcggcggcgtgttcacgtccgtcgggaagctggtgcaccagatcttcggcaccgcctacggggtgctgttcagcggcgtctcctggaccatgaagatcgggatcggcgtgctcctgacctggctgggcctcaacagccgctccacgagcctgtccatgacctgcatcgccgtggggctggtcaccctctacctgggcgtgatggtgcaggccgacagcgggtgcgtcatcaactggaagggccgggagctgaagtgcgggagcggcatcttcgtgaccaacgaggtgcacacgtggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagctgaccgtggtggtcggggacgtggcgggcatcctcgcccaggggaagaagatgatccggccccagcccatggagtacaagtactcctggaagtcctggggcaaggccaagatcatcggcgccgacgtgcagaacaccacgttcatcatcgacgggcccaacaccccggagtgccccgacgaccagcgcgcgtggaacatctgggaggtcgaggactacggcttcgggatcttcaccaccaacatctggctgaagctgcgggactcccacacccaggtgtgcgaccaccgcctcatgagcgccgccatcaaggactccaaggccgtgcacgccgacatgggctactggatcgagagcgagaagaacgagacctggaagctggcgcgggcctccttcatcgaggtcaagacctgcatctggcccaagagccacaccctgtggtccaacggcgtgctcgagagcgagatgatcatccccaagatctacgggggcccgatctcccagcacaactaccgccccgggtacttcacgcagaccgccggcccctggcacctggggaagctggagctcgacttcgacctgtgcgagggcaccaccgtggtcgtggacgagcactgcggcaaccgggggccgagcctgcgcacgaccaccgtgaccggcaagatcatccacgagtggtgctgccggtcctgcacgctgccgcccctccgcttcaagggggaggacggctgctggtacgggatggagatccggcccgtcaaggagaaggaggagaacctggtcaagagcatggtgagcgccggctccggcgaggtcgacagcttctccctcgggctgctgtgcatcagcatcatgatcgaggaggtgatgcgctcccggtggagccgcaagatgctcatgaccggcaccctggccgtgttcttcctgctcatcatggggcagctgacctggaacgacctgatccggctctgcatcatggtcggcgcgaacgcctccgaccgcatggggatgggcacgacctacctggccctgatggccaccttcaagatgcgcccgatgttcgccgtgggcctcctgttccggcgcctgaccagccgggaggtgctcctgctgacgatcgggctctccctggtcgcgagcgtggagctgcccaactccctcgaggagctgggcgacgggctggccatgggcatcatgatcctcaagctgctgaccgacttccagccccaccagctctgggccaccctgctgagcctcaccttcatccgcacgaccttctccctgcactacgcctggaagaccatggcgatggtcctgagcatcgtgtccctcttccccctgtgcctgagcaccacgtcccagaagaccacctggctcccggtgctgctgggcagcctcgggtgcaagcccctgaccatgttcctgatcgccgagaacaagatctggggccggaagtcctggcccctcaacgaggggatcatggccgtcggcatcgtgagcatcctgctgagctccctcctgaagaacgacgtgcccctggccgggccgctcatcgccggcggcatgctgatcgcgtgctacgtcatcagcgggtccagcgccgacctgtccctcgagaaggccgccgaggtgagctgggaggaggaggccgagcactccggcgcgagccacaacatcctggtggaggtccaggacgacgggacgatgaagatcaaggacgaggagcgcgacgacaccctgaccatcctcctgaaggccaccctgctcgccgtgtccggcgtgtaccccctgagcatccccgccaccctgttcgtctggtacttctggcagaagaagaagcagcggtccggggtgctctgggacacgcccagcccgcccgaggtggagcgcgccgtcctggacgacggcatctaccggatcatgcagcgcggcctgctggggcggtcccaggtgggcgtgggggtcttccaggagaacgtgttccacaccatgtggcacgtgacccgcggcgcggtcctcatgtaccaggggaagcggctggagcccagctgggcctccgtgaagaaggacctgatcagctacggcggcgggtggcgcctccagggctcctggaacaccggggaggaggtgcaggtcatcgccgtggagcccggcaagaacccgaagaacgtgcagacggcccccgggaccttcaagaccagcgagggcgaggtcggcgccatcgcgctggacttcaagcccgggacctccggcagccccatcgtgaaccgggaggggaagatcgtgggcctgtacggcaacggggtcgtgacgaccagcggcacctacgtgtccgccatcgcccaggccaaggcgagccaggaggggccgctccccgagatcgaggacgaggtcttccgcaagcggaacctgaccatcatggacctgcaccccggctccgggaagacgcgccggtacctcccggccatcgtgcgcgaggccatcaagcggcgcctgcgcaccctgatcctcgcccccacccgggtggtcgccagcgagatggcggaggccctgaagggcatgcccatccgctaccagaccacggccgtgaagtccgagcacaccggcaaggagatcgtggacctgatgtgccacgccaccttcaccatgcggctcctgagccccgtccgcgtgccgaactacaacatgatcatcatggacgaggcccacttcacggacccctccagcatcgcggcccgggggtacatctccacccgcgtgggcatgggggaggccgccgccatcttcatgaccgcgacgccgcccggcagcgtcgaggccttcccgcagtccaacgccgtgatccaggacgaggagcgggacatccccgagcgcagctggaactccgggtacgagtggatcacggacttccccggcaagaccgtgtggttcgtccccagcatcaagtccggcaacgacatcgccaactgcctgcggaagaacgggaagcgcgtgatccagctcagccggaagaccttcgacaccgagtaccagaagacgaagaacaacgactgggactacgtggtcaccaccgacatctccgagatgggcgcgaacttccgcgccgaccgggtgatcgacccgcgccggtgcctgaagcccgtgatcctgaaggacgggcccgagcgcgtcatcctcgccggccccatgccggtgaccgtcgccagcgccgcgcagcggcgcgggcggatcggccgcaaccacaacaaggagggcgaccagtacatctacatggggcagcccctgaacaacgacgaggaccacgcccactggacggaggccaagatgctgctcgacaacatcaacacccccgagggcatcatccccgccctgttcgagccggagcgcgagaagtccgccgcgatcgacggggagtaccggctgcgcggcgaggcccggaagaccttcgtggagctcatgcgccgcggggacctgcccgtgtggctgagctacaaggtcgccagcgagggcttccagtactccgaccgccggtggtgcttcgacggcgagcgcaacaaccaggtgctcgaggagaacatggacgtggagatctggaccaaggagggggagcggaagaagctgcgcccccggtggctggacgcccgcacgtacagcgaccccctcgccctgcgggagttcaaggagttcgcggccggccgccggtccgtcagcggggacctgatcctcgagatcggcaagctgccgcagcacctgacccagcgcgcccagaacgccctcgacaacctggtgatgctgcacaactccgagcagggcgggcgggcgtaccgccacgccatggaggagctccccgacaccatcgagaccctgatgctgctcgccctgatcgccgtgctgacgggcggggtcaccctcttcttcctgagcggccgggggctgggcaagacctccatcggcctcctgtgcgtgatcgccagctccgtgctgctctggatggcgagcgtcgagccccactggatcgccgcctccatcatcctggagttcttcctgatggtgctcctgatccccgagccggaccgccagcggacgccccaggacaaccagctggcctacgtggtcatcgggctcctgttcatgatcctgaccgtggccgcgaacgagatgggcctcctggagacgaccaagaaggacctggggatcggccacgtggccgtcgagaaccaccaccacgccgccatgctcgacgtggacctgcaccccgccagcgcgtggaccctgtacgccgtggccaccacgatcatcaccccgatgatgcgccacaccatcgagaacaccacggccaacatctccctcaccgccatcgcgaaccaggccgccatcctgatggggctggacaagggctggcccatcagcaagatggacatcggcgtccccctcctggccctggggtgctactcccaggtgaaccccctcaccctgaccgcggccgtgctgatgctcgtcgcccactacgccatcatcggcccggggctgcaggccaaggcgacgcgcgaggcccagaagcggaccgccgccggcatcatgaagaaccccaccgtggacgggatcgtggccatcgacctggaccccgtcgtgtacgacgcgaagttcgagaagcagctcggccagatcatgctgctgatcctctgcaccagccagatcctgctgatgcgcacgacctgggccctctgcgagtccatcaccctggccaccggccccctgacgaccctctgggaggggagcccgggcaagttctggaacaccaccatcgccgtgtccatggccaacatcttccgggggagctacctggcgggcgtcggcctggccttcagcctcatgaagtccctcgggggcgggcgccgggggacgggggcccagggcgagaccctgggcgagaagtggaagcgccagctcaaccagctgagcaagtccgagttcaacacctacaagcggagcgggatcatggaggtggaccgctccgaggccaaggagggcctgaagcgcggggagaccacgaagcacgcggtgagccgcggcaccgccaagctccggtggttcgtcgagcgcaacctggtgaagcccgaggggaaggtgatcgacctgggctgcggccgcggcgggtggtcctactactgcgccgggctgaagaaggtcaccgaggtgaaggggtacaccaagggcgggcccggccacgaggagcccatcccgatggccacgtacgggtggaacctcgtgaagctgcacagcggcaaggacgtcttcttcatcccgcccgagaagtgcgacaccctgctctgcgacatcggggagtccagccccaacccgaccatcgaggagggccgcaccctgcgggtgctgaagatggtggagccctggctccgcgggaaccagttctgcatcaagatcctgaacccctacatgccctccgtcgtggagacgctggagcagatgcagcggaagcacggcggcatgctcgtgcgcaacccgctgagccggaactccacccacgagatgtactgggtcagctgcgggaccggcaacatcgtgtccgccgtgaacatgaccagccgcatgctgctcaaccgcttcaccatggcgcaccggaagcccacgtacgagcgcgacgtcgacctgggggccggcacccggcacgtggccgtggagcccgaggtcgccaacctggacatcatcggccagcgcatcgagaacatcaagcacgagcacaagtccacctggcactacgacgaggacaacccctacaagacctgggcctaccacgggagctacgaggtgaagccgtccggcagcgcgagctccatggtcaacggggtggtgaagctcctgacgaagccctgggacgtcatccccatggtgacccagatcgccatgaccgacaccacgcccttcggccagcagcgggtgttcaaggagaaggtcgacacccgcaccccgaaggccaagcgggggaccgcccagatcatggaggtgacggccaagtggctgtggggcttcctcagccgcaacaagaagccccggatctgcacccgcgaggagttcacccggaaggtgcgctccaacgcggccatcggcgccgtcttcgtggacgagaaccagtggaacagcgccaaggaggcggtggaggacgagcggttctgggacctggtccaccgcgagcgggagctgcacaagcaggggaagtgcgcgacctgcgtgtacaacatgatgggcaagcgcgagaagaagctcggggagttcggcaaggccaaggggtcccgggccatctggtacatgtggctgggcgcccgcttcctggagttcgaggcgctcggcttcatgaacgaggaccactggttcagccgggagaactccctgagcggggtggagggcgaggggctgcacaagctcggctacatcctgcgcgacatctccaagatccccgggggcaacatgtacgccgacgacacggccggctgggacacccggatcaccgaggacgacctgcagaacgaggccaagatcaccgacatcatggagccggagcacgccctcctggccaagagcatcttcaagctgacgtaccagaacaaggtcgtgcgcgtgcagcgccccgccaagaacgggaccgtcatggacgtgatctcccggcgcgaccagcggggcagcggccaggtgggcacctacggcctcaacaccttcacgaacatggaggcccagctgatccgccagatggagtccgaggggatcttcagcccctccgagctggagaccagcaacctcgccggccgggtcctggactggctggagaagcacggggtggagcgcctcaagcggatggccatctccggcgacgactgcgtggtcaagcccatcgacgaccgcttcgcgaccgccctgaccgccctgaacgacatggggaaggtgcggaaggacatcccgcagtgggagcccagcaagggctggaacgactggcagcaggtccccttctgcagccaccacttccaccagctcatcatgaaggacggccgcgagatcgtcgtgccctgccggaaccaggacgagctggtggggcgcgcccgggtctcccagggcgccgggtggagcctgcgcgagacggcgtgcctcggcaagtcctacgcccagatgtggcagctgatgtacttccaccggcgcgacctgcggctcgccgccaacgcgatctgcagcgccgtgccggtggactgggtccccacctcccgcaccacctggagcatccacgcccaccaccagtggatgacgaccgaggacatgctgtccgtgtggaaccgggtgtggatcgaggagaacccctggatggaggacaagacccacgtcagctcctggggcgacgtgccctacctgggcaagcgcgaggaccagtggtgcggcagcctcatcgggctgaccgcccgcgccacgtgggcgaccaacatccaggtggccatcaaccaggtccggcgcctgctcggcaacgagaactacctggactacatgacctccatgaagcggttcaagaacgagagcgacccggagggggccctgtggtga

SEQ ID NO: 8443 - RNA, 9879 nt, synthetic construct
  misc_feature 1..9879: note = derived and/or modified CDS sequence (opt1) from DENV-1__FJ882515__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgccggggtgaacatgtgcaccctcatcgccatggacctgggcgagctgtgcgaggacaccatgacctacaagtgcccccggatcaccgaggccgagcccgacgacgtggactgctggtgcaacgccacggacacctgggtcacctacgggacctgcagccagacgggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcatcgggaagctggtgcaccagatcttcggcaccgcctacggggtcctcttctccggcgtgagctggaccatgaagatcgggatcggcgtgctgctgacgtggctcggcctgaactcccgcagcacctccctgagcatgacctgcatcgccgtcgggctcgtgaccctgtacctgggcgtgatggtccaggccgactccgggtgcgtgatcaactggaagggccgggagctcaagtgcgggagcggcatcttcgtgacgaacgaggtccacacctggaccgagcagtacaagttccaggcggacagcccgaagcgcctgtccgccgccatcggcaaggcctgggaggagggggtgtgcggcatccggagcgccacccgcctggagaacatcatgtggaagcagatctccaacgagctcaaccacatcctgctggagaacgacatgaagttcaccgtggtcgtgggggacgtggtcggcatcctcgcgcaggggaagaagatgatccggccccagcccatggagcacaagtacagctggaagtcctggggcaaggccaagatcatcggcgccgacgtgcagaacacgaccttcatcatcgacgggcccaacaccccggagtgccccgacgaccagcgcgcctggaacatctgggaggtggaggactacggcttcgggatcttcaccacgaacatctggctgaagatgcgggacagctacacccaggtctgcgaccaccgcctgatgtccgcggccatcaaggacagcaaggccgtgcacgccgacatgggctactggatcgagtccgagaagaacgagacctggaagctcgcccgggcgagcttcatcgaggtgaagacctgcatctggcccaagtcccacacgctgtggagcaacggcgtcctggagtccgagatgatcatccccaagatctacgggggcccgatcagccagcacaactaccgccccgggtacttcacccagaccgccggcccctggcacctcgggaagctggagctggacttcgacctctgcgagggcaccacggtggtggtcgacgagcactgcggcaaccgggggccgtccctgcgcaccaccaccgtgacgggcaagatcatccacgagtggtgctgccggagctgcaccctgccgcccctgcgcttcaagggggaggacggctgctggtacgggatggagatccggcccgtgaaggagaaggaggagaacctggtcaagtccatggtgagcgccggcagcggcgaggtggactccttcagcctggggctcctgtgcatctccatcatgatcgaggaggtcatgcgcagccggtggtcccgcaagatgctgatgaccggcaccctcgccgtgttcctgctgctcatcatggggcagctgacgtggaacgacctgatccggctctgcatcatggtgggcgccaacgcgagcgaccgcatggggatgggcaccacctacctggccctgatggccaccttcaagatgcgcccgatgttcgccgtcgggctcctgttccggcgcctgacgtcccgggaggtgctcctgctgaccatcgggctcagcctggtggcctccgtcgagctgcccaacagcctcgaggagctgggcgacgggctggcgatgggcatcatgatcctcaagctgctgaccgacttccagtcccaccagctctgggccaccctgctgagcctcacgttcatcaagaccaccctgtccctgcactacgcctggaagaccatggccatggtgctcagcatcgtctccctgatccccctgtgcctcagcacgacctcccagaagaccacctggctgcccgtgctgctcggcagcctggggtgcaagccgctgacgatgttcctcatcgcggagaacaagatctggggccgcaagtcctggcccctgaacgaggggatcatggccgtgggcgtcgtgagcatcctgctcagctccctgctgaagaacgacgtgcccctcgccgggcccctgatcgccggcggcatgctgatcgcctgctacgtcatcagcgggtccagcgcggacctctccctggagaaggccgccgaggtgagctgggaggaggaggccgagcactccggcgccagccacaacatcctggtggaggtccaggacgacgggaccatgaagatcaaggacgaggagcgggacgacaccctcaccatcctgctgaaggcgaccctcctggccgtgtccggcgtgtacccgctgagcatccccgccaccctcttcgtctggtacttctggcagaagaagaagcagcgctccggggtgctgtgggacacccccagcccgcccgaggtggagcgggccgtcctggacgacggcatctaccgcatcatgcagcggggcctgctcgggcgctcccaggtgggcgtgggggtcttccaggagaacgtgttccacaccatgtggcacgtgacccggggcgccgtcctgatgtaccaggggaagcgcctggagcccagctgggcgtccgtgaagaaggacctcatcagctacggcggcgggtggcggctgcagggctcctggaacacgggggaggaggtgcaggtcatcgccgtggagcccggcaagaaccccaagaacgtgcagaccgcccccgggaccttcaagacccccgagggcgaggtcggcgccatcgccctggacttcaagcccgggacgagcggctcccccatcgtgaaccgcgaggggaagatcgtgggcctctacggcaacggggtcgtgaccaccagcggcacctacgtgagcgcgatcgcccaggccaaggcctcccaggaggggccgctgcccgagatcgaggacgaggtcttccggaagcgcaacctgacgatcatggacctccaccccggcagcgggaagacccggcgctacctgccggcgatcgtgcgggaggccatcaagcgcaagctgcggaccctcatcctggcccccacccgcgtggtcgcctccgagatggccgaggcgctgaagggcatgcccatccgctaccagacgaccgccgtcaagagcgagcacaccggcaaggagatcgtggacctcatgtgccacgccaccttcacgatgcggctgctgtcccccgtccgcgtgccgaactacaacatgatcatcatggacgaggcccacttcaccgaccccagctccatcgccgcgcgggggtacatcagcacccgcgtgggcatgggggaggccgccgccatcttcatgaccgccacgccgcccggctccgtcgaggcgttcccgcagagcaacgccgtgatccaggacgaggagcgggacatccccgagcgctcctggaacagcgggtacgagtggatcaccgacttccccggcaagaccgtgtggttcgtcccctccatcaagagcggcaacgacatcgccaactgcctccggaagaacgggaagcgcgtgatccagctgtcccggaagaccttcgacacggagtaccagaagaccaagaacaacgactgggactacgtggtcaccaccgacatcagcgagatgggcgccaacttccgcgcggaccgggtgatcgacccgcgccggtgcctgaagcccgtgatcctcaaggacgggcccgagcgcgtcatcctggccggccccatgccggtgacggtcgcctccgccgcccagcggcgcgggcggatcggccgcaaccacaacaaggagggcgaccagtacatctacatggggcagcccctgaacaacgacgaggaccacgcgcactggaccgaggccaagatgctcctggacaacatcaacacccccgagggcatcatccccgccctgttcgagccggagcgggagaagtccgccgccatcgacggggagtaccgcctccgcggcgaggcgcggaagaccttcgtggagctgatgcgccgcggggacctgcccgtgtggctctcctacaaggtcgccagcgagggcttccagtacagcgaccgccggtggtgcttcgacggcgagcgcaacaaccaggtgctggaggagaacatggacgtggagatctggacgaaggagggggagcggaagaagctgcgcccccggtggctcgacgcccgcacctactccgaccccctggccctgcgggagttcaaggagttcgccgcgggccgccggagcgtctccggggacctcatcctggagatcggcaagctgccgcagcacctcacccagcgcgcccagaacgccctggacaacctggtgatgctccacaacagcgagcagggcgggcgggcctaccgccacgcgatggaggagctgcccgacaccatcgagacgctgatgctcctggccctgatcgccgtgctcaccggcggggtcaccctgttcttcctgtccggccgggggctcggcaagaccagcatcggcctgctgtgcgtgatggcctccagcgtgctcctgtggatggcctccgtcgagccccactggatcgcggccagcatcatcctggagttcttcctcatggtgctgctgatccccgagccggaccgccagcggacgccccaggacaaccagctcgcctacgtggtcatcgggctgctgttcatgatcctcacggtggccgccaacgagatgggcctgctggagaccaccaagaaggacctcgggatcggccacgtggcggtcgagaaccaccaccacgccaccatgctggacgtggacctgcaccccgcctccgcctggacgctctacgccgtggcgaccaccatcatcaccccgatgatgcgccacacgatcgagaacaccaccgccaacatcagcctgaccgccatcgccaaccaggccgcgatcctgatggggctcgacaagggctggcccatctccaagatggacatcggcgtccccctgctggccctcgggtgctacagccaggtgaaccccctgacgctgaccgccgccgtgctcatgctggtcgcgcactacgccatcatcggcccggggctgcaggccaaggccacccgggaggcccagaagcgcaccgcggccggcatcatgaagaaccccacggtggacgggatcgtggccatcgacctcgaccccgtcgtgtacgacgccaagttcgagaagcagctgggccagatcatgctgctcatcctgtgcacctcccagatcctgctcatgcgcaccacctgggccctgtgcgagagcatcacgctggcgaccggccccctcaccaccctgtgggaggggtccccgggcaagttctggaacacgaccatcgccgtgagcatggccaacatcttccgggggtcctacctggccggcgccggcctcgcgttcagcctgatgaagtccctcgggggcgggcgccgggggaccggggcccagggcgagaccctcggcgagaagtggaagcgccagctgaaccagctgtccaagagcgagttcaacatctacaagcggtccgggatcatggaggtcgaccgcagcgaggccaaggagggcctcaagcgcggggagacgacccgccacgccgtgtcccggggcaccgcgaagctgcgctggttcgtggagcggaacctggtcaagcccgaggggaaggtgatcgacctgggctgcggccgcgggggctggagctactactgcgccgggctcaagaaggtgaccgaggtcaagggctacacgaagggcgggcccggccacgaggagcccatcccgatggccacctacgggtggaacctggtgaagctgcactccggcaaggacgtgttcttcacgccgcccgagaagtgcgacaccctcctgtgcgacatcggggagagctcccccaacccgacgatcgaggagggccggaccctgcgcgtcctcaagatggtggagccctggctgcgggggaaccagttctgcatcaagatcctgaacccctacatgcccagcgtggtcgagaccctcgagcagatgcagcgcaagcacggcggcatgctggtgcggaacccgctgtcccgcaacagcacccacgagatgtactgggtgtcctgcgggaccggcaacatcgtcagcgccgtgaacatgacgtcccggatgctcctgaaccgcttcaccatggcccaccgcaagcccacctacgagaaggacgtggacctgggggcgggcacccggcacgtcgccgtggagcccgaggtggccaacctcgacatcatcggccagcgcatcgagaacatcaagcacgagcacaagagcacgtggcactacgacgaggacaacccctacaagacctgggcctaccacgggtcctacgaggtcaagccgagcggctccgccagcagcatggtgaacggggtcgtgaagctgctgaccaagccctgggacgtgatccccatggtcacccagatcgcgatgacggacaccacccccttcggccagcagcgggtgttcaaggagaaggtggacacccgcacgccgaaggccaagcgggggaccgtccagatcatggaggtgaccgcccgctggctctggggcttcctgtcccggaacaagaagccccgcatctgcacccgggaggagttcacgcgcaaggtgcggagcaacgccgccatcggcgcggtcttcgtggacgagaaccagtggaactccgccaaggaggccgtggaggacgagcgcttctgggacctggtccagaaggagcgggagctccacaagcaggggaagtgcgcgacctgcgtgtacaacatgatgggcaagcgcgagaagaagctgggggagttcggcaaggcgaaggggagccgggccatctggtacatgtggctgggcgcccgcttcctcgagttcgaggccctgggcttcatgaacgaggaccactggttctcccgggagaacagcctgtccggggtggagggcgaggggctccacaagctgggctacatcctgcgcgacatcagcaagatccccgggggcaacatgtacgccgacgacaccgcgggctgggacacccggatcacggaggacgacctccagaacgaggccaagatcaccgacatcatggagccggagcacgccctgctggccacctccatcttcaagctcacctaccagaacaaggtcgtgcgcgtgcagcggcccgccaagaacgggacggtcatggacgtgatcagccgccgcgaccagcggggctccggccaggtgggcacctacggcctgaacaccttcaccaacatggaggcgcagctgatccgccagatggagagcgaggggatcttcctcccctccgagctggagacgcccaacctggccgagcgggtcctcgactggctggagaagtacggcgtggagcgcctgaagcggatggccatcagcggggacgactgcgtggtcaagccgatcgacgaccgcttcgccaccgccctcaccgcgctgaacgacatgggcaaggtgcggaaggacatcccccagtgggagccctccaaggggtggaacgactggccccaggtgccgcactgcagccaccacttccaccagctgatcatgaaggacggccgcgagatcgtcgtgccctgccggaaccaggacgagctcgtgggccgcgcccgggtctcccagggggccggctggagcctgcgcgagaccgcctgcctgggcaagagctacgcccagatgtggcagctcatgtacttccaccggcgcgacctgcggctggcggccaacgccatctgctccgccgtgcccgtggactgggtccccacgagccgcaccacctggtccatccacgcgcaccaccagtggatgaccacggaggacatgctcagcgtgtggaaccgggtgtggatcgaggagaacccgtggatggaggacaagacccacgtctccagctggggcgacgtgccctacctggggaagcgcgaggaccagtggtgcggctccctgatcggcctcaccgcccgggccacctgggccagcaacatccaggtggccatcaaccaggtccgccgcctgatcgggaacgagaactacctggactacatgacctccatgaagcggttcaagaacgaggacgaccccgagggcgcgctctggtga

SEQ ID NO: 8444 - RNA, 9879 nt, synthetic construct
  misc_feature 1..9879: note = derived and/or modified CDS sequence (opt1) from DENV-1__FJ882517__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagaccagcgcgggggtgaacatgtgcaccctcatcgccatggacctgggcgagttctgcgaggacacgatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagaccgtccagtacgagaacctgaagtacagcgtgatcgtgaccgtccacacgggcgaccagcaccaggtggggaacgagtccaccgagcacggcaccaccgcgaccatcacgccccaggcccccagcaccgagatccagctgaccgactacggggccctcaccctggactgcagcccccggacgggcctggacttcaacgagatggtcctcctgaccatgaaggagaagtcctggctggtgcacaagcagtggttcctcgacctgccgctgccctggaccagcggggcctccaccagccaggagacgtggaaccggaaggacctcctggtgaccttcaagaccgcccacgcgaagaagcaggaggtcgtggtgctgggctcccaggagggcgccatgcacaccgccctcacgggggccaccgagatccagaccagcggcaccacgaccatcttcgccgggcacctgaagtgccgcctgaagatggacaagctcaccctgaagggcatgtcctacgtcatgtgcaccgggagcttcaagctggagaaggaggtggcggagacgcagcacggcaccgtgctcgtccagatcaagtacgagggcaccgacgccccctgcaagatccccttctccacccaggacgagaagggggtgacgcagaacggccggctgatcaccgccaacccgatcgtgaccgacaaggagaagcccgtcaacatcgaggccgagccgcccttcggggagagctacatcgtgatcggcgcgggcgaggaggccctgaagctgtcctggttcaagaaggggagctccatcggcaagatgttcgaggccaccgcccgcggggcccggcgcatggcgatcctcggcgacacggcctgggacttcgggagcatcggcggcgtgttcacctccgtcgggaagctggtgcaccagatcttcggcaccgcctacggggtgctgttcagcggcgtctcctggaccatgaagatcgggatcggcgtgctcctgacgtggctgggcctcaacagccgctccaccagcctgtccatgacctgcatcgccgtggggctggtcaccctctacctgggcgtgatggtgcaggccgacagcgggtgcgtcatcaactggaagggccgggagctgaagtgcgggagcggcatcttcgtgacgaacgaggtgcacacctggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagttcaccgtggtggtcggggacgtggcgggcatcctggcccaggggaagaagatgatccggccccagcccatggagtacaagtactcctggaagtcctggggcaaggccaagatcatcggcgccgacgtgcagaacacgaccttcatcatcgacgggcccaacaccccggagtgccccgacgaccagcgcgcgtggaacatctgggaggtcgaggactacggcttcgggatcttcaccacgaacatctggctcaagctgcgggactcctacacccaggtgtgcgaccaccgcctgatgagcgccgccatcaaggactccaaggccgtgcacgccgacatgggctactggatcgagagcgagaagaacgagacctggaagctcgcgcgggcctccttcatcgaggtcaagacctgcatctggcccaagagccacacgctgtggtccaacggcgtgctggagagcgagatgatcatccccaagatctacgggggcccgatctcccagcacaactaccgccccgggtacttcacccagaccgccggcccctggcacctcgggaagctggagctggacttcgacctctgcgagggcaccacggtggtcgtggacgagcactgcggcaaccgggggccgagcctgcgcaccaccaccgtgacgggcaagatcatccacgagtggtgctgccggtcctgcaccctgccgcccctgcgcttcaagggggaggacggctgctggtacgggatggagatccggcccgtcaaggagaaggaggagaacctggtcaagagcatggtgagcgccggctccggcgaggtcgacagcttctccctggggctcctgtgcatcagcatcatgatcgaggaggtgatgcgctcccggtggagccgcaagatgctgatgaccggcaccctcgccgtgttcttcctgctgatcatggggcagctcacgtggaacgacctgatccggctgtgcatcatggtcggcgcgaacgcctccgaccgcatggggatgggcaccacctacctcgccctgatggtgaccttcaagatgcgcccgatgttcgccgtggggctcctgttccggcgcctgacgagccgggaggtcctgctcctgaccatcgggctgtccctcgtggccagcgtcgagctgcccaactccctggaggagctcggcgacgggctggcgatgggcatcatgatcctgaagctcctgaccgacttccagagccaccagctgtgggccaccctcctgtccctgacgttcatcaagaccaccttcagcctccactacgcctggaagaccatggccatggtgctgtccatcgtgagcctgttccccctctgcctgtccacgaccagccagaagaccacctggctgcccgtcctcctgggctccctggggtgcaagccgctcacgatgttcctgatcgcggagaacaagatctggggccgcaagagctggcccctgaacgaggggatcatggccgtgggcatcgtgagcatcctcctgtccagcctgctcaagaacgacgtccccctggccgggcccctgatcgccggcggcatgctcatcgcctgctacgtgatctccgggagctccgcggacctgagcctggagaaggccgccgaggtgtcctgggaggaggaggccgagcacagcggcgcctcccacaacatcctcgtcgaggtgcaggacgacgggaccatgaagatcaaggacgaggagcgggacgacaccctgaccatcctgctcaaggcgaccctgctggccgtgagcggcgtctacccgctctccatccccgccacgctgttcgtgtggtacttctggcagaagaagaagcagcgcagcggggtgctgtgggacacccccagcccgcccgaggtcgagcgggccgtgctcgacgacggcatctaccgcatcatgcagcggggcctgctggggcgcagccaggtgggcgtcggggtgttccaggagaacgtgttccacaccatgtggcacgtcacccggggcgccgtgctgatgtaccaggggaagcgcctcgagccctcctgggcgagcgtgaagaaggacctgatctcctacggcggcgggtggcggctgcagggcagctggaacacgggggaggaggtccaggtgatcgccgtggagcccggcaagaaccccaagaacgtccagaccgcccccgggaccttcaagacctccgagggcgaggtgggcgccatcgccctcgacttcaagcccgggacgagcggcagccccatcgtgaaccgcgaggggaagatcgtcggcctgtacggcaacggggtggtgaccacctccggcacctacgtcagcgcgatcgcccaggccaaggcctcccaggaggggcccctgccggagatcgaggacgaggtgttccggaagcgcaacctcacgatcatggacctgcaccccggcagcgggaagacccggcgctacctgcccgcgatcgtgcgggaggccatcaagcgcaagctccggaccctgatcctggccccgacccgcgtcgtggcctccgagatggccgaggcgctcaagggcatgcccatccgctaccagacgaccgccgtcaagagcgagcacaccggcaaggagatcgtcgacctgatgtgccacgccaccttcacgatgcggctgctctcccccgtgcgcgtgcccaactacaacatgatcatcatggacgaggcccacttcaccgacccgagctccatcgccgcgcgggggtacatcagcacccgcgtcggcatgggggaggccgccgccatcttcatgaccgccacgccgcccggctccgtggaggcgttcccccagagcaacgccgtgatccaggacgaggagcgggacatcccggagcgctcctggaacagcgggtacgagtggatcaccgacttccccggcaagaccgtctggttcgtgccctccatcaagagcggcaacgacatcgccaactgcctgcggaagaacgggaagcgcgtgatccagctgtcccggaagaccttcgacacggagtaccagaagaccaagaacaacgactgggactacgtcgtgaccaccgacatcagcgagatgggcgccaacttccgcgcggaccgggtgatcgacccccgccggtgcctcaagccggtcatcctgaaggacgggcccgagcgcgtgatcctggccggccccatgcccgtcacggtggcctccgccgcccagcggcgcgggcggatcggccgcaaccacaacaaggagggcgaccagtacatctacatggggcagccgctcaacaacgacgaggaccacgcgcactggaccgaggccaagatgctgctggacaacatcaacacccccgagggcatcatccccgccctcttcgagcccgagcgggagaagtccgccgccatcgacggggagtaccgcctgcgcggcgaggcgcggaagaccttcgtggagctgatgcgccgcggggacctcccggtctggctgagctacaaggtggcctccgagggcttccagtacagcgaccgccggtggtgcttcgacggcgagcgcaacaaccaggtgctggaggagaacatggacgtcgagatctggacgaaggagggggagcggaagaagctccgcccccggtggctggacgcccgcacctactccgaccccctggccctccgggagttcaaggagttcgccgcgggccgccggagcgtgtccggggacctgatcctggagatcggcaagctcccccagcacctgacccagcgcgcccagaacgccctggacaacctcgtgatgctgcacaacagcgagcagggcgggcgggcctaccgccacgcgatggaggagctgccggacaccatcgagacgctcatgctgctggccctcatcgccgtcctgaccggcggggtgaccctgttcttcctctccggccgggggctgggcaagaccagcatcggcctgctctgcgtgatggcctccagcgtcctgctgtggatggcctccgtggagccccactggatcgcggccagcatcatcctcgagttcttcctgatggtgctgctcatccccgagcccgaccgccagcggaccccgcaggacaaccagctggcctacgtcgtgatcgggctcctcttcatgatcctgacggtggccgccaacgagatgggcctgctcgagaccaccaagaaggacctggggatcggccacgtcgcggtggagaaccaccaccacgccgccatgctggacgtggacctccaccccgcctccgcctggaccctgtacgcggtcgccacgaccatcatcacccccatgatgcgccacaccatcgagaacacgaccgccaacatcagcctgaccgccatcgccaaccaggcggccatcctcatggggctggacaagggctggccgatctccaagatggacatcggcgtgcccctgctcgccctggggtgctacagccaggtgaaccccctgaccctcacggccgcggtcctgatgctggtggcccactacgccatcatcggccccgggctccaggccaaggccacccgggaggcgcagaagcgcaccgccgccggcatcatgaagaacccgaccgtggacgggatcgtcgccatcgacctggaccccgtggtgtacgacacgaagttcgagaagcagctgggccagatcatgctcctgatcctgtgcacctcccagatcctcctgatgcgcaccacctgggccctgtgcgagagcatcacgctcgcgaccggccccctgaccaccctgtgggaggggtcccccggcaagttctggaacacgaccatcgccgtcagcatggccaacatcttccgggggagctacctcgccggcgccggcctggcgttctccctgatgaagtccctcgggggcgggcgccggggcaccggggcccagggcgagaccctgggcgagaagtggaagcgccagctgaaccagctctccaagagcgagttcaacacgtacaagcggtccgggatcatggaggtggaccgcagcgaggccaaggagggcctgaagcgcggggagaccaccaagcacgccgtgtcccgcggcaccgcgaagctgcggtggttcgtcgagcgcaacctcgtgaagccggaggggaaggtgatcgacctgggctgcggccgcggcgggtggagctactactgcgccgggctgaagaaggtcacggaggtgaaggggtacaccaagggcgggcccggccacgaggagcccatccccatggccacctacgggtggaacctggtgaagctccactccggcaaggacgtcttcttcatcccgcccgagaagtgcgacaccctgctgtgcgacatcggggagagctcccccaaccccacgatcgaggagggccgcaccctccgggtgctgaagatggtggagccgtggctgcgcgggaaccagttctgcatcaagatcctcaacccctacatgcccagcgtcgtggagaccctggagcagatgcagcggaagcacggcggcatgctggtgcgcaaccccctctcccggaacagcacccacgagatgtactgggtctcctgcgggaccggcaacatcgtgagcgccgtgaacatgacgtcccgcatgctgctgaaccggttcaccatggcccaccgcaagccgacctacgagcgcgacgtcgacctcggggcgggcacccggcacgtggccgtggagcccgaggtcgccaacctggacatcatcggccagcgcatcgagaacatcaagcacgagcacaagagcacgtggcactacgacgaggacaacccctacaagacctgggcctaccacgggtcctacgaggtgaagcccagcggcagcgcctccagcatggtcaacggggtggtgaagctgctcaccaagccgtgggacgtcatccccatggtgacccagatcgcgatgacggacaccacccccttcggccagcagcgggtgttcaaggagaaggtcgacacccgcacgcccaaggccaagcgggggaccgcccagatcatggaggtgaccgccaagtggctgtggggcttcctgtcccgcaacaagaagccgcggatctgcacccgcgaggagttcacgcggaaggtgcgcagcaacgccgcgatcggcgccgtcttcgtggacgagaaccagtggaactccgccaaggaggccgtggaggacgagcggttctgggacctcgtccaccgcgagcgggagctgcacaagcaggggaagtgcgcgacctgcgtgtacaacatgatgggcaagcgcgagaagaagctgggggagttcggcaaggccaaggggagccgggccatctggtacatgtggctcggcgcccgcttcctggagttcgaggccctgggcttcatgaacgaggaccactggttctcccgggagaacagcctctccggggtggagggcgaggggctgcacaagctgggctacatcctccgcgacatcagcaagatccccgggggcaacatgtacgcggacgacaccgccggctgggacacccggatcacggaggacgacctgcagaacgaggccaagatcaccgacatcatggagcccgagcacgccctgctcgccaagtccatcttcaagctgacctaccagaacaaggtcgtgcgcgtgcagcggccggcgaagaacgggaccgtcatggacgtgatcagccgccgcgaccagcggggctccggccaggtgggcacgtacggcctgaacaccttcaccaacatggaggcccagctcatccgccagatggagagcgaggggatcttctcccccagcgagctggagacccccaacctggccggccgggtcctcgactggctggagaagcacggggtggagcgcctgaagcggatggccatctccggcgacgactgcgtggtcaagcccatcgacgaccgcttcgccacggcgctcaccgccctgaacgacatggggaaggtgcggaaggacatcccgcagtgggagcccagcaagggctggaacgactggcagcaggtccccttctgcagccaccacttccaccagctgatcatgaaggacggccgcgagatcgtcgtgccctgccggaaccaggacgagctcgtggggcgcgcccgggtctcccagggcgccgggtggagcctgcgcgagaccgcctgcctgggcaagtcctacgcgcagatgtggcagctcatgtacttccaccggcgcgacctgcggctggccgccaacgccatctgcagcgcggtgccggtggactgggtccccacctcccgcacgacctggagcatccacgcccaccaccagtggatgaccaccgaggacatgctctccgtgtggaaccgggtgtggatcgaggagaacccctggatggaggacaagacgcacatcagctcctggggcgacgtcccctacctgggcaagcgcgaggaccagtggtgcggcagcctgatcgggctcaccgcccgggccacctgggccaccaacatccaggtggcgatcaaccaggtgcgccgcctgatcggcaacgagaactacctggactacatgacctccatgaagcggttcaagaacgagagcgacccggagggggccctctggtga

SEQ ID NO: 8445 - RNA, 9879 nt, synthetic construct
  misc_feature 1..9879: note = derived and/or modified CDS sequence (opt1) from DENV-1__JQ287661__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgccggggtgaacatgtgcaccctcatcgccatggacctgggcgagctgtgcgaggacaccatgacctacaagtgcccccggatcaccgaggccgagcccgacgacgtggactgctggtgcaacgccacggacacctgggtcacctacgggacctgcagccagacgggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcatcgggaagctggtgcaccagatcttcggcaccgcctacggggtcctcttctccggcgtgagctggaccatgaagatcgggatcggcgtgctgctgacgtggctcggcctgaactcccgcagcacctccctgagcatgacctgcatcgccgtcgggctcgtgaccctgtacctgggcgtgatggtccaggccgactccgggtgcgtgatcaactggaagggccgggagctcaagtgcgggagcggcatcttcgtgacgaacgaggtccacacctggaccgagcagtacaagttccaggcggacagcccgaagcgcctgtccgccgccatcggcaaggcctgggaggagggggtgtgcggcatccggagcgccacccgcctggagaacgtgatgtggaagcagatctccaacgagctcaaccacatcctgctggagaacgacatgaagttcaccgtcgtggtgggggacgtcgtgggcatcctcgcgcaggggaagaagatgatccggccccagcccatggagcacaagtacagctggaagtcctggggcaaggccaagatcatcggcgccgacgtgcagaacacgaccttcatcatcgacgggcccaacaccccggagtgccccgacgaccagcgcgcctggaacatctgggaggtcgaggactacggcttcgggatcttcaccacgaacatctggctgaagatgcgggacagctacacccaggtgtgcgaccaccgcctgatgtccgcggccatcaaggacagcaaggccgtgcacgccgacatgggctactggatcgagtccgagaagaacgagacctggaagctcgcccgggcgagcttcatcgaggtcaagacctgcatctggcccaagtcccacacgctgtggagcaacggcgtgctggagtccgagatgatcatccccaagatctacgggggcccgatcagccagcacaactaccgccccgggtacttcacccagaccgccggcccctggcacctcgggaagctggagctggacttcgacctctgcgagggcaccacggtggtcgtggacgagcactgcggcaaccgggggccgtccctgcgcaccaccaccgtgacgggcaagatcatccacgagtggtgctgccggagctgcaccctgccgcccctgcgcttcaagggggaggacggctgctggtacgggatggagatccggcccgtcaaggagaaggaggagaacctggtgaagtccatggtgagcgccggcagcggcgaggtcgactccttcagcctggggctcctgtgcatctccatcatgatcgaggaggtgatgcgcagccggtggtcccgcaagatgctgatgaccggcaccctcgccgtgttcctgctgctcatcatggggcagctgacgtggaacgacctgatccggctctgcatcatggtcggcgccaacgcgagcgaccgcatggggatgggcaccacctacctggccctgatggccaccttcaagatgcgcccgatgttcgccgtgggcctcctgttccggcgcctgacgtcccgggaggtgctcctgctgaccatcgggctcagcctggtcgcctccgtggagctgcccaacagcctcgaggagctgggcgacgggctggcgatgggcatcatgatcctcaagctgctgaccgacttccagtcccaccagctctgggccaccctgctgagcctcacgttcatcaagaccaccctgtccctgcactacgcctggaagaccatggccatggtcctcagcatcgtgtccctgatccccctgtgcctcagcacgacctcccagaagaccacctggctgcccgtgctgctcggcagcctggggtgcaagccgctgacgatgttcctcatcgcggagaacaagatctggggccgcaagtcctggcccctgaacgaggggatcatggccgtcggcgtggtgagcatcctgctcagctccctgctgaagaacgacgtccccctcgccgggcccctgatcgccggcggcatgctgatcgcctgctacgtgatcagcgggtccagcgcggacctctccctggagaaggccgccgaggtgagctgggaggaggaggccgagcactccggcgccagccacaacatcctggtcgaggtgcaggacgacgggaccatgaagatcaaggacgaggagcgggacgacaccctcaccatcctgctgaaggcgaccctcctggccgtgtccggcgtctacccgctgagcatccccgccaccctcttcgtgtggtacttctggcagaagaagaagcagcgctccggggtgctgtgggacacccccagcccgcccgaggtcgagcgggccgtgctggacgacggcatctaccgcatcatgcagcggggcctgctcgggcgctcccaggtgggcgtcggggtgttccaggagaacgtgttccacaccatgtggcacgtcacccggggcgccgtgctgatgtaccaggggaagcgcctggagcccagctgggcgtccgtgaagaaggacctcatcagctacggcggcgggtggcggctgcagggctcctggaacacgggggaggaggtccaggtgatcgccgtggagcccggcaagaaccccaagaacgtccagaccgcccccgggaccttcaagacccccgagggcgaggtgggcgccatcgccctggacttcaagcccgggacgagcggctcccccatcgtgaaccgcgaggggaagatcgtcggcctctacggcaacggggtggtgaccaccagcggcacctacgtcagcgcgatcgcccaggccaaggcctcccaggaggggccgctgcccgagatcgaggacgaggtgttccggaagcgcaacctgacgatcatggacctccaccccggcagcgggaagacccggcgctacctgccggcgatcgtgcgggaggccatcaagcgcaagctgcggaccctcatcctggcccccacccgcgtcgtggcctccgagatggccgaggcgctgaagggcatgcccatccgctaccagacgaccgccgtcaagagcgagcacaccggcaaggagatcgtcgacctcatgtgccacgccaccttcacgatgcggctgctgtcccccgtgcgcgtgccgaactacaacatgatcatcatggacgaggcccacttcaccgaccccagctccatcgccgcgcgggggtacatcagcacccgcgtcggcatgggggaggccgccgccatcttcatgaccgccacgccgcccggctccgtggaggcgttcccgcagagcaacgccgtgatccaggacgaggagcgggacatccccgagcgctcctggaacagcgggtacgagtggatcaccgacttccccggcaagaccgtctggttcgtgccctccatcaagagcggcaacgacatcgccaactgcctccggaagaacgggaagcgcgtgatccagctgtcccggaagaccttcgacacggagtaccagaagaccaagaacaacgactgggactacgtcgtgaccaccgacatcagcgagatgggcgccaacttccgcgcggaccgggtgatcgacccgcgccggtgcctgaagcccgtcatcctcaaggacgggcccgagcgcgtgatcctggccggccccatgccggtcacggtggcctccgccgcccagcggcgcgggcggatcggccgcaaccacaacaaggagggcgaccagtacatctacatggggcagcccctgaacaacgacgaggaccacgcgcactggaccgaggccaagatgctcctggacaacatcaacacccccgagggcatcatccccgccctgttcgagccggagcgggagaagtccgccgccatcgacggggagtaccgcctccgcggcgaggcgcggaagaccttcgtggagctgatgcgccgcggggacctgcccgtctggctctcctacaaggtggccagcgagggcttccagtacagcgaccgccggtggtgcttcgacggcgagcgcaacaaccaggtgctggaggagaacatggacgtcgagatctggacgaaggagggggagcggaagaagctgcgcccccggtggctcgacgcccgcacctactccgaccccctggccctgcgggagttcaaggagttcgccgcgggccgccggagcgtgtccggggacctcatcctggagatcggcaagctgccgcagcacctcacccagcgcgcccagaacgccctggacaacctggtgatgctccacaacagcgagcagggcgggcgggcctaccgccacgcgatggaggagctgcccgacaccatcgagacgctgatgctcctggccctgatcgccgtcctcaccggcggggtgaccctgttcttcctgtccggccgggggctcggcaagaccagcatcggcctgctgtgcgtgatggcctccagcgtcctcctgtggatggcctccgtggagccccactggatcgcggccagcatcatcctggagttcttcctcatggtgctgctgatccccgagccggaccgccagcggacgccccaggacaaccagctcgcctacgtcgtgatcgggctgctgttcatgatcctcacggtggccgccaacgagatgggcctgctggagaccaccaagaaggacctcgggatcggccacgtcgcggtggagaaccaccaccacgccaccatgctggacgtggacctgcaccccgcctccgcctggacgctctacgccgtcgcgaccaccatcatcaccccgatgatgcgccacacgatcgagaacaccaccgccaacatcagcctgaccgccatcgccaaccaggccgcgatcctgatggggctcgacaagggctggcccatctccaagatggacatcggcgtgcccctgctggccctcgggtgctacagccaggtgaaccccctgacgctgaccgccgccgtcctcatgctggtggcgcactacgccatcatcggcccggggctgcaggccaaggccacccgggaggcccagaagcgcaccgcggccggcatcatgaagaaccccacggtggacgggatcgtcgccatcgacctcgaccccgtggtgtacgacgccaagttcgagaagcagctgggccagatcatgctgctcatcctgtgcacctcccagatcctgctcatgcgcaccacctgggccctgtgcgagagcatcacgctggcgaccggccccctcaccaccctgtgggaggggtccccgggcaagttctggaacacgaccatcgccgtcagcatggccaacatcttccgggggtcctacctggccggcgccggcctcgcgttcagcctgatgaagtccctcgggggcgggcgccgggggaccggggcccagggcgagaccctcggcgagaagtggaagcgccagctgaaccagctgtccaagagcgagttcaacatctacaagcggtccgggatcatggaggtggaccgcagcgaggccaaggagggcctcaagcgcggggagacgacccgccacgccgtgtcccggggcaccgcgaagctgcgctggttcgtcgagcggaacctggtgaagcccgaggggaaggtgatcgacctgggctgcggccgcgggggctggagctactactgcgccgggctcaagaaggtcaccgaggtgaagggctacacgaagggcgggcccggccacgaggagcccatcccgatggccacctacgggtggaacctggtgaagctgcactccggcaaggacgtcttcttcacgccgcccgagaagtgcgacaccctcctgtgcgacatcggggagagctcccccaacccgacgatcgaggagggccggaccctgcgcgtgctcaagatggtggagccctggctgcgggggaaccagttctgcatcaagatcctgaacccctacatgcccagcgtcgtggagaccctcgagcagatgcagcgcaagcacggcggcatgctggtgcggaacccgctgtcccgcaacagcacccacgagatgtactgggtctcctgcgggaccggcaacatcgtgagcgccgtgaacatgacgtcccggatgctcctgaaccgcttcaccatggcccaccgcaagcccacctacgagaaggacgtcgacctgggggcgggcacccggcacgtggccgtggagcccgaggtcgccaacctcgacatcatcggccagcgcatcgagaacatcaagcacgagcacaagagcacgtggcactacgacgaggacaacccctacaagacctgggcctaccacgggtcctacgaggtgaagccgagcggctccgccagcagcatggtcaacggggtggtgaagctgctgaccaagccctgggacgtcatccccatggtgacccagatcgcgatgacggacaccacccccttcggccagcagcgggtgttcaaggagaaggtcgacacccgcacgccgaaggccaagcgggggaccgtgcagatcatggaggtgaccgcccgctggctctggggcttcctgtcccggaacaagaagccccgcatctgcacccgggaggagttcacgcgcaaggtccggagcaacgccgccatcggcgcggtgttcgtggacgagaaccagtggaactccgccaaggaggccgtcgaggacgagcgcttctgggacctggtgaagaaggagcgggagctccacaagcaggggaagtgcgcgacctgcgtgtacaacatgatgggcaagcgcgagaagaagctgggggagttcggcaaggcgaaggggagccgggccatctggtacatgtggctgggcgcccgcttcctcgagttcgaggccctgggcttcatgaacgaggaccactggttctcccgggagaacagcctgtccggggtcgagggcgaggggctccacaagctgggctacatcctgcgcgacatcagcaagatccccgggggcaacatgtacgccgacgacaccgcgggctgggacacccggatcacggaggacgacctccagaacgaggccaagatcaccgacatcatggagccggagcacgccctgctggccacctccatcttcaagctcacctaccagaacaaggtggtgcgcgtccagcggcccgccaagaacgggacggtgatggacgtgatcagccgccgcgaccagcggggctccgggcaggtcggcacctacggcctgaacaccttcaccaacatggaggcgcagctgatccgccagatggagagcgaggggatcttcctcccctccgagctggagacgcccaacctggccgagcgggtgctcgactggctggagaagtacggcgtggagcgcctgaagcggatggccatcagcggggacgactgcgtcgtgaagccgatcgacgaccgcttcgccaccgccctcaccgcgctgaacgacatgggcaaggtgcggaaggacatcccccagtgggagccctccaaggggtggaacgactggcagcaggtccccttctgcagccaccacttccaccagctgatcatgaaggacggccgcgagatcgtggtgccgtgccggaaccaggacgagctcgtcggccgcgcccgggtgtcccagggggccggctggagcctgcgcgagaccgcctgcctgggcaagagctacgcccagatgtggcagctcatgtacttccaccggcgcgacctgcggctggcggccaacgccatctgctccgccgtgcccgtcgactgggtgcccacgagccgcaccacctggtccatccacgcgcaccaccagtggatgaccacggaggacatgctcagcgtgtggaaccgggtctggatcgaggagaacccctggatggaggacaagacccacgtgtccagctggggcgacgtgccgtacctggggaagcgcgaggaccagtggtgcggctccctgatcggcctcaccgcccgggccacctgggccagcaacatccaggtcgccatcaaccaggtgcgccgcctgatcgggaacgagaactacctggactacatgacctccatgaagcggttcaagaacgagggcgaccccgagggggcgctctggtga

SEQ ID NO: 8446 - RNA, 9879 nt, synthetic construct
  misc_feature 1..9879: note = derived and/or modified CDS sequence (opt1) from DENV-1__FJ882518__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagtccctgctgttcaagaccagcgcgggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtgacctacgggacctgctcccagacgggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccgtgggcggcgtgttcaccagcgtcgggaagctggtgcaccagatcttcggcaccgcctacggggtcctgttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggccgactccgggtgcgtcatcaactggaagggccgggagctcaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctggagaacatcatgtggaagcagatctccaacgagctcaaccacatcctgctggagaacgacatgaagttcaccgtggtggtcggggacgtggtgggcatcctcgcgcaggggaagaagatgatccggccccagcccatggagcacaagtacagctggaagtcctggggcaaggccaagatcatcggcgccgacgtccagaacacgaccttcatcatcgacgggcccagcaccccggagtgccccgacgaccagcgcgcctggaacatctgggaggtggaggactacggcttcgggatcttcaccacgaacatctggctgaagctgcgggactcctacacccaggtgtgcgaccaccgcctcatgagcgcggccatcaaggactccaaggccgtccacgccgacatgggctactggatcgagagcgagaagaacgagacctggaagctggcccgggcgtccttcatcgaggtgaagacctgcatctggcccaagagccacacgctgtggtccaacggcgtgctcgagagcgagatgatcatccccaagatctacgggggcccgatctcccagcacaactaccgccccgggtacttcacccagaccgccggcccctggcacctggggaagctggagctcgacttcgacctgtgcgagggcaccacggtcgtggtggacgagcactgcggcaaccgggggccgagcctgcgcaccaccaccgtcacgggcaagatcatccacgagtggtgctgccggtcctgcaccctgccgcccctccgcttcaagggggaggacggctgctggtacgggatggagatccggcccgtgaaggagaaggaggagaacctggtgaagtccatggtcagcgccggctccggcgaggtggacagcttctccctcgggctgctgtgcatcagcatcatgatcgaggaggtgatgcgctcccggtggagccgcaagatgctcatgaccggcaccctggccgtcttcctgctcctgatcatggggcagctgacgtggaacgacctcatccggctgtgcatcatggtgggcgccaacgcgtccgaccgcatggggatgggcaccacctacctggccctcatggccaccttcaagatgcgcccgatgttcgccgtgggcctgctgttccggcgcctcacgagccgggaggtcctgctgctcaccatcgggctgtccctggtggccagcgtcgagctccccaactccctggaggagctgggcgacgggctcgcgatgggcatcatgatcctgaagctgctcaccgacttccagagccaccagctgtgggccaccctgctctccctgacgttcatcaagaccaccctgagcctccactacgcctggaagaccatggccatggtgctgtccatcgcgagcctgttccccctctgcctgtccacgaccagccagaagaccacctggctgcccgtgctcctgggctccctggggtgcaagccgctcacgatgttcctgatcaccgagaccaagatctggggccgcaagagctggcccctgaacgaggggatcatggccgtcggcgtggtgagcatcctcctgtccagcctgctcaagaacgacgtccccctggccgggcccctgatcgccggcggcatgctcatcgcctgctacgtgatctccgggagctccgcggacctgagcctggagaaggccgccgaggtgtcctgggaggaggaggccgagcacagcggcgcctcccacaacatcctcgtcgtggtgcaggacgacgggaccatgaagatcaaggacgaggagcgggacgacaccctgacgatcctgctcaaggcgaccctgctggccgtcagcggcgtgtacccgctctccatccccgccaccctgttcgtgtggtacttctggcagaagaagaagcagcgcagcggggtcctgtgggacacccccagcccgcccgaggtggagcgggccgtgctggacgacggcatctaccgcatcatgcagcggggcctcctggggcgcagccaggtcggcgtgggggtgttccaggagaacgtcttccacacgatgtggcacgtgacccggggcgccgtgctgatgtaccaggggaagcgcctcgagccctcctgggcgagcgtcaagaaggacctgatctcctacggcggcgggtggcggctgcagggcagctggaacaccggggaggaggtccaggtgatcgccgtcgagcccggcaagaaccccaagaacgtgcagaccgcccccgggacgttcaagacccccgagggcgaggtgggcgccatcgccctcgacttcaagcccgggacctccggcagccccatcgtcaaccgcgaggggaagatcgtgggcctgtacggcaacggggtggtcaccacgagcggcacctacgtgtccgcgatcgcccaggccaaggccagccaggaggggccgctgcccgagatcgaggacgaggtgttccggaagcgcaacctcaccatcatggacctgcaccccggctccgggaagacccggcgctacctgccggcgatcgtccgggaggccatcaagcgcaagctccggacgctgatcctggcccccacccgcgtggtggccagcgagatggccgaggcgctcaagggcatgcccatccgctaccagaccaccgccgtcaagtccgagcacacgggcaaggagatcgtggacctgatgtgccacgccaccttcaccatgcggctgctcagccccgtgcgcgtcccgaactacaacatgatcatcatggacgaggcccacttcaccgacccctccagcatcgccgcgcgggggtacatctccacgcgcgtgggcatgggggaggccgccgccatcttcatgaccgccacgccgcccggcagcgtggaggcgttcccgcagtccaacgccgtcatccaggacgaggagcgggacatccccgagcgcagctggaactccgggtacgagtggatcaccgacttccccggcaagacggtgtggttcgtgcccagcatcaagtccggcaacgacatcgccaactgcctgcggaagaacgggaagcgcgtcatccagctgagccggaagaccttcgacaccgagtaccagaagaccaagaacaacgactgggactacgtggtgacgaccgacatctccgagatgggcgccaacttccgcgcggaccgggtcatcgacccgcgccggtgcctcaagcccgtgatcctgaaggacgggcccgagcgcgtcatcctggccggccccatgccggtgaccgtggccagcgccgcccagcggcgcgggcggatcggccgcaaccacaacaaggagggcgaccagtacatctacatggggcagcccctcaacaacgacgaggaccacgcgcactggaccgaggccaagatgctgctggacaacatcaacacgcccgagggcatcatccccgccctcttcgagccggagcgggagaagtccgccgccatcgacggggagtaccgcctgcgcggcgaggcgcggaagaccttcgtcgagctgatgcgccgcggggacctccccgtgtggctgagctacaaggtggccagcgagggcttccagtactccgaccgccggtggtgcttcgacggcgagcgcaacaaccaggtcctggaggagaacatggacgtggagatctggaccaaggagggggagcggaagaagctccgcccccggtggctggacgcccgcacctacagcgaccccctggccctccgggagttcaaggagttcgccgcgggccgccggtccgtgagcggggacctgatcctggagatcggcaagctcccgcagcacctgacgcagcgcgcccagaacgccctggacaacctcgtcatgctgcacaactccgagcagggcgggcgggcctaccgccacgcgatggaggagctgcccgacaccatcgagaccctcatgctgctggccctcatcgccgtgctgaccggcggggtgaccctgttcttcctcagcggccgggggctgggcaagacgtccatcggcctgctctgcgtcatggccagctccgtgctgctgtggatggccagcgtggagccccactggatcgcggcctccatcatcctcgagttcttcctgatggtcctgctcatccccgagccggaccgccagcggacgccccaggacaaccagctggcctacgtggtgatcgggctcctcttcatgatcctgaccgtcgccgccaacgagatgggcctgctcgagaccacgaagaaggacctggggatcggccacgtggcggtggagaaccaccaccacgccaccatgctggacgtcgacctccaccccgccagcgcctggaccctgtacgccgtggcgaccacgatcatcaccccgatgatgcgccacaccatcgagaacaccacggccaacatctccctgaccgccatcgccaaccaggccgcgatcctcatggggctggacaagggctggcccatcagcaagatggacatcggcgtgcccctgctcgccctggggtgctactcccaggtcaaccccctgaccctcaccgccgccgtgctgatgctggtggcgcactacgccatcatcggcccggggctccaggccaaggccacgcgggaggcccagaagcgcaccgcggccggcatcatgaagaaccccaccgtcgacgggatcgtggccatcgacctggaccccgtggtctacgacgccaagttcgagaagcagctgggccagatcatgctcctgatcctgtgcaccagccagatcctcctgatgcgcacgacctgggccctgtgcgagtccatcaccctcgcgaccggccccctgacgaccctgtgggaggggagcccgggcaagttctggaacaccaccatcgccgtgtccatggccaacatcttccgggggagctacctcgccggcgccggcctggcgttcagcctgatgaagtccctcgggggcgggcgccggggcacgggggcccagggcgagaccctgggcgagaagtggaagcgccagctgaaccagctcagcaagtccgagttcaacatctacaagcggagcgggatcatggaggtggaccgctccgaggccaaggagggcctgaagcgcggggagaccacccgccacgccgtcagccggggcacggcgaagctgcgctggttcgtggagcggaacctggtgaagcccgaggggaaggtcatcgacctcggctgcggccgcgggggctggtcctactactgcgccgggctgaagaaggtgaccgaggtgaagggctacaccaagggcgggcccggccacgaggagcccatcccgatggccacctacgggtggaacctggtcaagctccacagcggcaaggacgtgttcttcacgccgcccgagaagtgcgacaccctgctgtgcgacatcggggagtccagccccaacccgaccatcgaggagggccggaccctccgcgtgctgaagatggtcgagccctggctgcgggggaaccagttctgcatcaagatcctcaacccctacatgccctccgtggtggagaccctggagcagatgcagcgcaagcacggcggcatgctggtccggaacccgctcagccgcaactccacgcacgagatgtactgggtgagctgcgggaccggcaacatcgtgtccgccgtcaacatgaccagccggatgctgctgaaccgcttcaccatggcccaccgcaagcccacgtacgagcgggacgtggacctcggggcgggcacccgccacgtggccgtcgagcccgaggtggccaacctggacatcatcggccagcggatcgagaacatcaagcacgagcacaagtccacctggcactacgacgaggacaacccctacaagacctgggcctaccacgggagctacgaggtcaagccgtccggcagcgccagctccatggtgaacggggtggtcaagctgctcacgaagccctgggacgtgatccccatggtgacccagatcgcgatgaccgacaccacgcccttcggccagcagcgcgtcttcaaggagaaggtggacacccggaccccgaaggccaagcgcgggaccgcccagatcatggaggtgacggcccggtggctgtggggcttcctgagccgcaacaagaagccccggatctgcacccgcgaggagttcacccggaaggtccgctccaacgccgcgatcggcgccgtgttcgtggacgagaaccagtggaacagcgccaaggaggccgtcgaggacgagcggttctgggacctcgtgcagaaggagcgcgagctgcacaagcaggggaagtgcgcgacctgcgtgtacaacatgatgggcaagcgggagaagaagctgggggagttcggcaaggccaaggggtcccgcgccatctggtacatgtggctcggcgcccggttcctggagttcgaggccctgggcttcatgaacgaggaccactggttcagccgcgagaactccctcagcggggtcgagggcgaggggctgcacaagctgggctacatcctccgggacatctccaagatccccgggggcaacatgtacgcggacgacacggccggctgggacacccgcatcaccgaggacgacctgcagaacgaggccaagatcaccgacatcatggagccggagcacgccctgctcgccacgagcatcttcaagctgacctaccagaacaaggtggtgcgggtccagcgccccgcgaagaacgggaccgtgatggacgtgatctcccgccgggaccagcgcggcagcgggcaggtcggcacctacggcctgaacacgttcaccaacatggaggcccagctcatccggcagatggagtccgaggggatcttcctgcccagcgagctggagacccccaacctcgccgagcgcgtgctggactggctggagaagtacggcgtggagcggctcaagcgcatggccatctccggggacgactgcgtcgtgaagccgatcgacgaccggttcgccaccgcgctgacggccctgaacgacatgggcaaggtgcgcaaggacatcccccagtgggagcccagcaaggggtggaacgactggcagcaggtccccttctgctcccaccacttccaccagctcatcatgaaggacggccgggagatcgtggtgccgtgccgcaaccaggacgagctggtcggccgggcccgcgtgagccagggggccggctggagcctgcgggagaccgcctgcctcgggaagtcctacgcgcagatgtggcagctgatgtacttccaccgccgggacctgcgcctcgccgccaacgccatctgcagcgcggtgcccgtcgactgggtgcccacctcccggaccacgtggagcatccacgcccaccaccagtggatgaccaccgaggacatgctgtccgtgtggaaccgcgtctggatcgaggagaacccctggatggaggacaagacccacgtgagctcctggggcgacgtgccgtacctggggaagcgggaggaccagtggtgcggcagcctcatcggcctgaccgcccgcgccacgtgggcctccaacatccaggtcgcgatcaaccaggtgcgccggctgatcgggaacgagaactacctcgactacatgaccagcatgaagcgcttcaagaacgagggcgaccccgagggggccctgtggtga

SEQ ID NO: 8447 - RNA, 9879 nt, synthetic construct
  misc_feature 1..9879: note = derived and/or modified CDS sequence (opt1) from DENV-1__FJ882519__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagaccagcgccggggtgaacatgtgcaccctcatcgccatggacctgggcgagttctgcgaggacaccatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggaccagcggggcctccaccagccaggagacctggaaccggaaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctcgtccagatcaagtacgagggcaccgacgccccctgcaagatccccttctccacccaggacgagaagggggtgacccagaacggccggctgatcacggccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacaccgcctgggacttcgggagcatcggcggcgtgttcacgtccgtcgggaagctggtgcaccagatcttcggcaccgcctacggggtgctgttcagcggcgtctcctggaccatgaagatcgggatcggcgtgctcctgacctggctgggcctcaacagccgctccacgagcctgtccatgacctgcatcgccgtggggctggtcaccctctacctgggcgtgatggtgcaggccgacagcgggtgcgtcatcaactggaagggccgggagctgaagtgcgggagcggcatcttcgtgaccaacgaggtgcacacgtggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagttcaccgtggtggtcggggacgtggcgggcatcctggcccaggggaagaagatgatccggccccagcccatggagtacaagtactcctggaagtcctggggcaaggccaagatcatcggcgccgacgtgcagaacaccacgttcatcatcgacgggcccaacaccccggagtgccccgacgaccagcgcgcgtggaacatctgggaggtcgaggactacggcttcgggatcttcaccaccaacatctggctcaagctgcgggactcctacacccaggtgtgcgaccaccgcctgatgagcgccgccatcaaggactccaaggccgtgcacgccgacatgggctactggatcgagagcgagaagaacgagacctggaagctcgcgcgggcctccttcatcgaggtcaagacctgcatctggcccaagagccacaccctgtggtccaacggcgtgctggagagcgagatgatcatccccaagatctacgggggcccgatctcccagcacaactaccgccccgggtacttcacgcagaccgccggcccctggcacctcgggaagctggagctggacttcgacctctgcgagggcaccaccgtggtcgtggacgagcactgcggcaaccgggggccgagcctgcgcacgaccaccgtgaccggcaagatcatccacgagtggtgctgccggtcctgcacgctgccgcccctgcgcttcaagggggaggacggctgctggtacgggatggagatccggcccgtcaaggagaaggaggagaacctggtcaagagcatggtgagcgccggctccggcgaggtcgacagcttctccctggggctcctgtgcatcagcatcatgatcgaggaggtgatgcgctcccggtggagccgcaagatgctgatgaccggcaccctcgccgtgttcttcctgctgatcatggggcagctcacctggaacgacctgatccggctgtgcatcatggtcggcgcgaacgcctccgaccgcatggggatgggcacgacctacctcgccctgatggccaccttcaagatgcgcccgatgttcgccgtggggctcctgttccggcgcctgaccagccgggaggtgctgctcctgacgatcgggctgtccctcgtcgcgagcgtggagctgcccaactccctggaggagctcggcgacgggctggccatgggcatcatgatcctgaagctcctgaccgacttccagagccaccagctgtgggccaccctcctgtccctgaccttcatcaagacgaccttcagcctccactacgcctggaagaccatggcgatggtcctgtccatcgtgagcctgttccccctctgcctgtccaccacgagccagaagaccacctggctgcccgtgctcctgggctccctggggtgcaagccgctcaccatgttcctgatcgccgagaacaagatctggggccgcaagagctggcccctgaacgaggggatcatggccgtcggcatcgtgagcatcctcctgtccagcctgctcaagaacgacgtgcccctggccgggcccctgatcgccggcggcatgctcatcgcgtgctacgtcatctccgggagctccgccgacctgagcctggagaaggccgccgaggtgtcctgggaggaggaggccgagcacagcggcgcgtcccacaacatcctcgtggaggtccaggacgacgggacgatgaagatcaaggacgaggagcgggacgacaccctgaccatcctgctcaaggccaccctgctggccgtgagcggcgtgtacccgctctccatccccgccaccctgttcgtctggtacttctggcagaagaagaagcagcgcagcggggtgctgtgggacacgcccagcccgcccgaggtggagcgggccgtcctcgacgacggcatctaccgcatcatgcagcggggcctgctggggcgcagccaggtgggcgtgggggtcttccaggagaacgtgttccacaccatgtggcacgtgacccggggcgcggtcctgatgtaccaggggaagcgcctcgagccctcctgggccagcgtgaagaaggacctgatctcctacggcggcgggtggcggctgcagggcagctggaacaccggggaggaggtgcaggtcatcgccgtggagcccggcaagaaccccaagaacgtgcagacggcccccgggaccttcaagacctccgagggcgaggtcggcgccatcgcgctcgacttcaagcccgggaccagcggcagccccatcgtgaaccgcgaggggaagatcgtgggcctgtacggcaacggggtcgtgacgacctccggcacctacgtgagcgccatcgcccaggccaaggcgtcccaggaggggcccctgccggagatcgaggacgaggtcttccggaagcgcaacctcaccatcatggacctgcaccccggcagcgggaagacgcggcgctacctgcccgccatcgtgcgggaggccatcaagcgcaagctccggaccctgatcctggccccgacccgcgtggtcgcctccgagatggcggaggccctcaagggcatgcccatccgctaccagaccacggccgtcaagagcgagcacaccggcaaggagatcgtggacctgatgtgccacgccaccttcaccatgcggctgctctcccccgtccgcgtgcccaactacaacatgatcatcatggacgaggcccacttcacggacccgagctccatcgcggcccgggggtacatcagcacccgcgtgggcatgggggaggccgccgccatcttcatgaccgcgacgccgcccggctccgtcgaggccttcccccagagcaacgccgtgatccaggacgaggagcgggacatcccggagcgctcctggaacagcgggtacgagtggatcacggacttccccggcaagaccgtgtggttcgtcccctccatcaagagcggcaacgacatcgccaactgcctgcggaagaacgggaagcgcgtgatccagctgtcccggaagaccttcgacaccgagtaccagaagacgaagaacaacgactgggactacgtggtcaccaccgacatcagcgagatgggcgcgaacttccgcgccgaccgggtgatcgacccccgccggtgcctcaagccggtgatcctgaaggacgggcccgagcgcgtcatcctggccggccccatgcccgtgaccgtcgcctccgccgcgcagcggcgcgggcggatcggccgcaaccacaacaaggagggcgaccagtacatctacatggggcagccgctcaacaacgacgaggaccacgcccactggacggaggccaagatgctgctggacaacatcaacacccccgagggcatcatccccgccctcttcgagcccgagcgggagaagtccgccgcgatcgacggggagtaccgcctgcgcggcgaggcccggaagaccttcgtggagctgatgcgccgcggggacctcccggtgtggctgagctacaaggtcgcctccgagggcttccagtacagcgaccgccggtggtgcttcgacggcgagcgcaacaaccaggtgctggaggagaacatggacgtggagatctggaccaaggagggggagcggaagaagctccgcccccggtggctggacgcccgcacgtactccgaccccctggccctccgggagttcaaggagttcgcggccggccgccggagcgtctccggggacctgatcctggagatcggcaagctcccccagcacctgacccagcgcgcccagaacgccctggacaacctcgtgatgctgcacaacagcgagcagggcgggcgggcgtaccgccacgccatggaggagctgccggacaccatcgagaccctcatgctgctggccctcatcgccgtgctgacgggcggggtcaccctgttcttcctctccggccgggggctgggcaagaccagcatcggcctgctctgcgtgatggcctccagcgtgctgctgtggatggcgtccgtcgagccccactggatcgccgccagcatcatcctcgagttcttcctgatggtgctgctcatccccgagcccgaccgccagcggaccccgcaggacaaccagctggcctacgtggtcatcgggctcctcttcatgatcctgaccgtggccgcgaacgagatgggcctgctcgagacgaccaagaaggacctggggatcggccacgtggccgtcgagaaccaccaccacgccgccatgctggacgtggacctccaccccgcctccgcgtggaccctgtacgccgtggccaccacgatcatcacccccatgatgcgccacaccatcgagaacaccacggccaacatcagcctgaccgccatcgcgaaccaggccgccatcctcatggggctggacaagggctggccgatctccaagatggacatcggcgtccccctgctcgccctggggtgctacagccaggtgaaccccctgaccctcaccgcggccgtgctgatgctggtcgcccactacgccatcatcggccccgggctccaggccaaggcgacgcgggaggcccagaagcgcaccgccgccggcatcatgaagaacccgaccgtggacgggatcgtggccatcgacctggaccccgtcgtgtacgacgcgaagttcgagaagcagctgggccagatcatgctcctgatcctgtgcacctcccagatcctcctgatgcgcacgacctgggccctgtgcgagagcatcaccctcgccaccggccccctgacgaccctgtgggaggggtcccccggcaagttctggaacaccaccatcgccgtgagcatggccaacatcttccgggggagctacctcgcgggcgccggcctggccttctccctgatgaagtccctcgggggcgggcgccggggcacgggggcccagggcgagaccctgggcgagaagtggaagcgccagctgaaccagctctccaagagcgagttcaacacctacaagcggtccgggatcatggaggtcgaccgcagcgaggcgaaggagggcctgaagcgcggggagaccacgaagcacgccgtgtcccgcggcaccgccaagctgcggtggttcgtggagcgcaacctcgtcaagccggaggggaaggtgatcgacctgggctgcggccgcggcgggtggagctactactgcgccgggctgaagaaggtgaccgaggtcaaggggtacaccaagggcgggcccggccacgaggagcccatccccatggccacgtacgggtggaacctggtgaagctccactccggcaaggacgtgttcttcatcccgcccgagaagtgcgacaccctgctgtgcgacatcggggagagctcccccaaccccaccatcgaggagggccgcaccctccgggtcctgaagatggtggagccgtggctgcgcgggaaccagttctgcatcaagatcctcaacccctacatgcccagcgtggtcgagacgctggagcagatgcagcggcgccacggcggcatgctggtgcggaaccccctctcccgcaacagcacccacgagatgtactgggtgtcctgcgggaccggcaacatcgtcagcgcggtgaacatgacctcccggatgctgctgaaccgcttcaccatggcccaccgcaagccgacgtacgagcgggacgtggacctcggggccggcacccgccacgtcgccgtggagcccgaggtggccaacctggacatcatcggccagcggatcgagaacatcaagcacgagcacaagagcacctggcactacgacgaggacaacccctacaagacctgggcgtaccacgggtcctacgaggtcaagcccagcggcagcgcctccagcatggtgaacggggtcgtgaagctgctcacgaagccgtgggacgtgatccccatggtcacccagatcgccatgaccgacaccacgcccttcggccagcagcgcgtgttcaaggagaaggtggacacccggacccccaaggccaagcgcgggaccgcccagatcatggaggtcacggcgaagtggctgtggggcttcctgtcccggaacaagaagccgcgcatctgcacccgggaggagttcacccgcaaggtgcggagcaacgccgccatcggcgccgtgttcgtcgacgagaaccagtggaactccgcgaaggaggccgtggaggacgagcgcttctgggacctcgtgcaccgggagcgcgagctgcacaagcaggggaagtgcgcgacctgcgtctacaacatgatgggcaagcgggagaagaagctgggggagttcggcaaggccaaggggagccgcgccatctggtacatgtggctcggcgcgcggttcctggagttcgaggccctgggcttcatgaacgaggaccactggttctcccgcgagaacagcctctccggggtggagggcgaggggctgcacaagctgggctacatcctccgggacatcagcaagatccccgggggcaacatgtacgccgacgacacggccggctgggacacccgcatcaccgaggacgacctgcagaacgaggccaagatcaccgacatcatggagcccgagcacgcgctgctcgccaagtccatcttcaagctgacgtaccagaacaaggtggtccgggtgcagcgcccggccaagaacgggaccgtgatggacgtcatcagccgccgggaccagcgcggctccggccaggtgggcacctacggcctgaacaccttcacgaacatggaggcccagctcatccggcagatggagagcgaggggatcttctcccccagcgagctggagacccccaacctggccggccgcgtgctcgactggctggagaagcacggggtcgagcggctgaagcgcatggcgatctccggcgacgactgcgtggtgaagcccatcgacgaccggttcgccaccgccctcaccgccctgaacgacatggggaaggtccgcaaggacatcccgcagtgggagcccagcaagggctggaacgactggcagcaggtccccttctgcagccaccacttccaccagctgatcatgaaggacggccgggagatcgtggtcccctgccgcaaccaggacgagctcgtggggcgggcccgcgtgtcccagggcgcggggtggagcctgcgggagacggcctgcctgggcaagtcctacgcccagatgtggcagctcatgtacttccaccgccgggacctgcgcctggccgcgaacgccatctgcagcgccgtcccggtggactgggtgcccacctcccggaccacctggagcatccacgcccaccaccagtggatgacgaccgaggacatgctctccgtctggaaccgcgtgtggatcgaggagaacccctggatggaggacaagacccacatcagctcctggggcgacgtgccctacctgggcaagcgggaggaccagtggtgcggcagcctgatcgggctcaccgcccgcgcgacgtgggccaccaacatccaggtcgccatcaaccaggtgcgccggctgatcggcaacgagaactacctggactacatgacctccatgaagcgcttcaagaacgagagcgacccggagggggccctctggtga

SEQ ID NO: 8448 - RNA, 9879 nt, synthetic construct
  misc_feature 1..9879: note = derived and/or modified CDS sequence (opt1) from DENV-1__FJ882520__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgaggtggagcccgacgacgtggactgctggtgcaacaccaccgacacctgggtgacctacgggacctgcagccagacgggcgagcaccggcgcgacaagcggagcgtggccctcgcgccccacgtcggcctggggctggagacccgggccgagacctggatgagctccgagggcgcgtggaagcagatccagaaggtggagacctgggccctccggcaccccgggttcacggtgatcgccctgttcctggcccacgcgatcggcaccagcatcacccagaaggggatcatcttcatcctcctgatgctggtcaccccctccatggccatgcgctgcgtgggcatcggcagccgggacttcgtggaggggctctccggcgccacgtgggtcgacgtggtgctggagcacgggagctgcgtcaccaccatggccaaggacaagcccaccctggacatcgagctcctgaagacggaggtgaccaaccccgccgtgctgcgcaagctctgcatcgaggcgaagatctccaacaccaccacggacagccggtgcccgacccagggcgaggccaccctggtcgaggagcaggacgccaacttcgtgtgccgccggaccttcgtggaccgcggctgggggaacggctgcgggctgttcggcaaggggtccctcatcacgtgcgccaagttcaagtgcgtcaccaagctggagggcaagatcgtgcagtacgagaacctgaagtacagcgtgatcgtcaccgtgcacaccggcgaccagcaccaggtcgggaacgagtccacggagcacggcaccaccgccaccatcacgccccaggcgcccacgagcgagatccagctcaccgactacggggccctgaccctggactgcagcccccggaccggcctcgacttcaacgagatggtgctgctgacgatgaaggagaagtcctggctcgtgcacaagcagtggttcctggacctgcccctcccctggaccagcggggcctccaccagccaggagacctggaaccgccaggacctgctggtcacgttcaagaccgcccacgccaagaagcaggaggtggtggtcctcggctcccaggagggcgcgatgcacaccgccctgaccggggccacggagatccagaccagcggcaccaccacgatcttcgccgggcacctgaagtgccggctcaagatggacaagctgaccctgaagggcatgtcctacgtgatgtgcaccgggagcttcaagctcgagaaggaggtggccgagacccagcacggcacggtcctggtgcagatcaagtacgagggcaccgacgcgccctgcaagatccccttctccacccaggacgagaagggggtgacccagaacggccgcctgatcacggccaacccgatcgtcaccgacaaggagaagcccgtgaacatcgaggccgagccgcccttcggggagagctacatcgtgatcggcgccggcgagaaggcgctgaagctctcctggttcaagaaggggagctccatcggcaagatgttcgaggccaccgcccgcggggcccgccggatggccatcctgggcgacaccgcgtgggacttcgggagcatcggcggcgtcttcacgtccgtggggaagctggtgcaccagatcttcggcaccgcctacggggtcctcttcagcggcgtgtcctggaccatgaagatcgggatcggcgtgctgctgacctggctcggcctgaacagccgctccacgagcctgtccatgacctgcatcgccgtcgggctcgtgaccctgtacctgggcgtgatggtccaggccgacagcgggtgcgtgatcaactggaagggccgcgagctcaagtgcgggagcggcatcttcgtgaccaacgaggtccacacgtggaccgagcagtacaagttccaggccgactccccgaagcggctgagcgcggccatcggcaaggcctgggaggagggggtgtgcggcatccgctccgccacccggctggagaacatcatgtggcgccagatcagcaacgagctcaaccacatcctgctggagaacgacatgaagttcaccgtggtcgtgggggacgtggtcggcatcctcgcccaggggaagaagatgatccggccccagcccatggagcacaagtactcctggaagtcctggggcaaggcgaagatcatcggcgccgacgtgcagaacaccacgttcatcatcgacgggcccaacaccccggagtgccccgacgaccagcgcgcctggaacatctgggaggtggaggactacggcttcgggatcttcaccaccaacatctggctgaagctgcgggactcctacacgcaggtctgcgaccaccgcctcatgagcgccgcgatcaaggactccaaggccgtgcacgccgacatgggctactggatcgagagcgagaagaacgagacctggaagctggcccgggcctccttcatcgaggtgaagacctgcatctggcccaagagccacaccctgtggtccaacggcgtcctcgagagcgagatgatcatccccaagatctacgggggcccgatctcccagcacaactaccgccccgggtacttcacgcagaccgcgggcccctggcacctggggaagctggagctcgacttcgacctgtgcgagggcaccaccgtggtggtcgacgagcactgcggcaaccgggggccgagcctgcgcacgaccaccgtgaccggcaagatcatccacgagtggtgctgccggtcctgcacgctgccgcccctccgcttcaagggggaggacggctgctggtacgggatggagatccggcccgtgaaggagaaggaggagaacctggtcaagagcatggtgagcgccggctccggcgaggtggacagcttctccctcgggctgctgtgcatcagcatcatgatcgaggaggtcatgcgctcccggtggagccgcaagatgctcatgaccggcaccctggccgtgttcttcctgctcatcatggggcagctgacctggaacgacctgatccggtcctgcatcatggtgggcgccaacgccagcgaccgcatggggatgggcacgacctacctcgcgctgatggccaccttcaagatgcgcccgatgttcgccgtcggcctgctgttccggcgcctgacctcccgggaggtgctgctcctgacgatcgggctgagcctcgtcgcctccgtggagctgcccaacagcctggaggagctcggcgacgggctggccatgggcatcatgatcctgaagctcctgaccgacttccagtcctaccagctgtgggcgaccctcctgagcctgaccttcatcaagacgaccttctccctccactacgcctggaagaccatggccatggtgctgagcatcgtctccctgctccccctgtgcctgagcaccacgtcccagaagaccacctggctccccgtgctgctgggcagcctcgggtgcaagccgctgaccatgttcctgatcgccgagaacaagatctggggccgcaagagctggcccctcaacgaggggatcatggcggtgggcatcgtctccatcctgctgagctccctcctgaagaacgacgtgcccctggccgggcccctcatcgccggcggcatgctgatcgcctgctacgtgatcagcgggtccagcgccgacctgtccctcgagaaggcggccgaggtcagctgggaggaggaggccgagcactccggcgccagccacaacatcctggtggaggtgcaggacgacgggacgatgaagatcaaggacgaggagcgggacgacaccctgaccatcctcctgaaggccaccctgctcgcggtctccggcgtgtacccgctgagcatccccgccaccctgttcgtgtggtacttctggcagaagaagaagcagcgctccggggtcctctgggacacgcccagcccgcccgaggtggagcgggccgtgctggacgacggcatctaccgcatcatgcagcggggcctgctggggcgctcccaggtcggcgtgggggtgttccaggagaacgtcttccacaccatgtggcacgtgacccggggcgccgtgctcatgtaccaggggaagcgcctggagcccagctgggcctccgtcaagaaggacctgatcagctacggcggcgggtggcggctccagggctcctggaacaccggggaggaggtccaggtgatcgcggtcgagcccggcaagaaccccaagaacgtgcagacggcccccgggaccttcaagacccccgagggcgaggtgggcgccatcgccctggacttcaagcccgggaccagcggcagccccatcgtcaaccgcgaggggaagatcgtgggcctgtacggcaacggggtggtcacgacctccggcacctacgtgagcgccatcgcgcaggccaaggcctcccaggaggggccgctccccgagatcgaggacgaggtgttccggaagcgcaacctgaccatcatggacctgcaccccggcagcgggaagacgcggcgctacctcccggccatcgtccgggaggcgatcaagcgcaagctgcggaccctgatcctcgcccccacccgcgtggtggcctccgagatggccgaggccctgaagggcatgcccatccgctaccagaccacggcggtcaagagcgagcacaccggccgggagatcgtggacctgatgtgccacgccaccttcaccatgcgcctcctgtcccccgtgcgggtcccgaactacaacatgatcatcatggacgaggcccacttcacggaccccagctccatcgccgcccgcgggtacatcagcacccgggtgggcatgggggaggcggccgccatcttcatgaccgccacgccgcccggctccgtggaggccttcccgcagagcaacgcggtcatccaggacgaggagcgcgacatccccgagcggtcctggaacagcgggtacgagtggatcacggacttccccggcaagaccgtgtggttcgtgccctccatcaagagcggcaacgacatcgccaactgcctgcgcaagaacgggaagcgggtcatccagctctcccgcaagaccttcgacaccgagtaccagaagacgaagaacaacgactgggactacgtggtgaccaccgacatcagcgagatgggcgccaacttccgggccgaccgcgtcatcgacccgcggcgctgcctgaagcccgtgatcctgaaggacgggcccgagcgggtcatcctcgcgggccccatgccggtgaccgtggcctccgccgcccagcgccgggggcgcatcggccggaaccacaacaaggagggcgaccagtacatctacatggggcagcccctgaacaacgacgaggaccacgcccactggacggaggcgaagatgctgctcgacaacatcaacacccccgagggcatcatccccgccctgttcgagccggagcgcgagaagtccgccgccatcgacggggagtaccgcctgcggggcgaggcccgcaagaccttcgtcgagctcatgcggcgcggggacctgcccgtgtggctgagctacaaggtggcgtccgagggcttccagtacagcgaccggcgctggtgcttcgacggcgagcggaacaaccaggtcctcgaggagaacatggacgtggagatctggaccaaggagggggagcgcaagaagctgcggccccgctggctggacgcccggacgtactccgaccccctcgccctgcgcgagttcaaggagttcgccgccggccggcgcagcgtgtccggggacctgatcctcgagatcggcaagctgccgcagcacctgacccagcgggcgcagaacgccctcgacaacctggtcatgctgcacaacagcgagcagggcgggcgcgcctaccggcacgccatggaggagctccccgacaccatcgagaccctgatgctgctcgcgctgatcgccgtgctgacgggcggggtgaccctcttcttcctgtccggccgcgggctgggcaagaccagcatcggcctcctgtgcgtcatggcctccagcgccctgctctggatggcctccgtggagccccactggatcgcggccagcatcatcctggagttcttcctgatggtgctcctgatccccgagccggaccggcagcgcacgccccaggacaaccagctggcctacgtcgtgatcgggctcctgttcatgatcctgaccgtggccgccaacgagatgggcctcctggagacgaccaagaaggacctggggatcggccacgtcgcggtggagaaccaccaccacgccaccatgctcgacgtggacctgcaccccgcctccgcctggaccctgtacgccgtcgcgacgaccatcatcaccccgatgatgcggcacaccatcgagaacacgaccgccaacatcagcctcaccgccatcgccaaccaggccgcgatcctgatggggctggacaagggctggcccatctccaagatggacatcggcgtgcccctcctggccctggggtgctacagccaggtgaaccccctcaccctgacggccgccgtcctgatgctcgtggcgcactacgccatcatcggcccggggctgcaggccaaggccacccgcgaggcccagaagcgcaccgcggccggcatcatgaagaaccccaccgtggacgggatcgtcgccatcgacctggaccccgtggtgtacgacgccaagttcgagaagcagctcggccagatcatgctgctgatcctctgcacgtcccagatcctgctgatgcggaccacctgggccctctgcgagagcatcaccctggcgacgggccccctgaccaccctctgggaggggtccccgggcaagttctggaacaccacgatcgccgtcagcatggccaacatcttccgcgggagctacctggccggcgccggcctggcgttctccctcatgaagtccctcgggggcgggcggcgcgggaccggggcccagggcgagaccctgggcgagaagtggaagcggcagctcaaccagctgtccaagagcgagttcaacacctacaagcgctccgggatcatggaggtggaccggagcgaggccaaggagggcctgcgccgcggggagacgaccaagcacgccgtgtcccgcggcaccgcgaagctccggtggttcgtcgagcgcaacctggtgaagcccgaggggaaggtgatcgacctgggctgcggccgcggcgggtggagctactactgcgccgggctgaagaaggtcaccgaggtgaaggggtacacgaagggcgggcccggccacgaggagcccatcccgatggccacctacgggtggaacctcgtgaagctgcactccggcaaggacgtcttcttcatcccgcccgagaagtgcgacaccctgctctgcgacatcggggagagctcccccaacccgaccatcgaggagggccgcacgctgcgggtgctgaagatggtggagccctggctccgcgggaaccagttctgcatcaagatcctgaacccctacatgcccagcgtcgtggagaccctggagcagatgcagcggaagcacggcggcatgctcgtgcgcaacccgctgtcccggaacagcacccacgagatgtactgggtctcctgcgggaccggcaacatcgtgagcgccgtgaacatgacctcccgcatgctgctcaaccgcttcacgatggcccaccggaagcccacctacgagcgcgacgtcgacctgggggcgggcacccggcacgtggccgtggagcccgaggtcgccaacctggacatcatcggccagcgcatcgagaacatcaagcacgagcacaagagcacctggcactacgacgaggacaacccctacaagacgtgggcctaccacgggtcctacgaggtgaagccgagcggcagcgcctccagcatggtcaacggggtggtgaagctcctgaccaagccctgggacgtcatccccatggtgacccagatcgcgatgaccgacacgacccccttcggccagcagcgggtgttcaaggagaaggtcgacacccgcaccccgaaggccaagcgggggacggcccagatcatggaggtgaccgcccgctggctgtggggcttcctctcccggaacaagaagccccgcatctgcacccgggaggagttcacccgcaaggtgcggagcaacgccgcgatcggcgccgtcttcgtggacgagaaccagtggaactccgccaaggaggccgtggaggacgagcgcttctgggacctggtccaccgggagcgcgagctgcacaagcaggggaagtgcgcgacgtgcgtgtacaacatgatgggcaagcgggagaagaagctcggggagttcggcaaggccaaggggagccgcgccatctggtacatgtggctgggcgcccggttcctggagttcgaggccctcggcttcatgaacgaggaccactggttctcccgcgagaacagcctgtccggggtggagggcgaggggctgcacaagctcggctacatcctgcgggacatcagcaagatccccgggggcaacatgtacgcggacgacaccgccggctgggacacccgcatcaccgaggacgacctgcagaacgaggccaagatcacggacatcatggagccggagcacgccctcctggccacctccatcttcaagctgacctaccagaacaaggtcgtgcgcgtgcagcggcccgcgcgcaacgggaccgtcatggacgtgatcagccggcgcgaccagcggggctccggccaggtgggcacgtacggcctcaacaccttcaccaacatggaggcccagctgatccgccagatggagagcgaggggatcttctcccccagcgagctggagacccccaacctcgccgagcgggtcctggactggctggagaagcacggcgtggagcgcctcaagcggatggccatctccggggacgactgcgtggtcaagccgatcgacgaccgcttcgccacggcgctgagcgccctgaacgacatgggcaaggtgcggaaggacatcccccagtgggagcccagcaaggggtggaacgactggcagcaggtccccttctgctcccaccacttccaccagctcatcatgaaggacggccgcgagatcgtcgtgccgtgccggaaccaggacgagctggtgggccgcgcccgggtcagccagggggccggctggtccctgcgcgagaccgcctgcctcggcaagagctacgcgcagatgtggcagctgatgtacttccaccggcgcgacctgcggctcgccgccaacgccatctgctccgcggtgcccgtggactgggtccccaccagccgcaccacgtggtccatccacgcccaccaccagtggatgaccaccgaggacatgctgagcgtgtggaaccgcgtgtggatcgaggagaacccctggatggaggacaagacccacatctccagctggggcgacgtcccgtacctggggaagcgggaggaccagtggtgcggctccctcatcggcctgacggcccgcgccacctgggccaccaacatccaggtggcgatcaaccaggtgcggcgcctgatcgggaacgagaactacctcgactacatgaccagcatgaagcggttcaagaacgagtccgaccccgagggcgccctgtggtga

SEQ ID NO: 8449 - RNA, 9879 nt, synthetic construct
  misc_feature 1..9879: note = derived and/or modified CDS sequence (opt1) from DENV-1__FJ882523__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgcgggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtgacctacgggacctgcagccagacgggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacgaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtggggaagctggtccaccagatcttcggcaccgcctacggggtcctgttctccggcgtgagctggaccatgaagatcgggatcggcgtcctgctgacgtggctcggcctgaactcccgcagcacctccctgagcatgacctgcatcgccgtggggctcgtgaccctgtacctgggcgtcatggtgcaggccgactccgggtgcgtgatcaactggaagggccgggagctcaagtgcgggagcggcatcttcgtcacgaacgaggtgcacacctggaccgagcagtacaagttccaggcggacagcccgaagcgcctgtccgccgccatcggcaaggcctgggaggagggggtgtgcggcatccggagcgccacccgcctggagaacatcatgtggaagcagatctccaacgagctcaaccacatcctgctggagaacgacatgaagttcaccgtcgtggtgggggacgtcgtgggcatcctcgcgcaggggaagaagatgatccggccccagcccatggagcacaagtacagctggaagtcctggggcaaggccaagatcatcggcgccgacgtgcagaacacgaccttcatcatcgacgggcccaacaccccggagtgccccgacgaccagcgcgcctggaacatctgggaggtcgaggactacggcttcgggatcttcaccacgaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacctgcatctggcccaagtcccacacgctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcaccacggtggtcgtggacgagcactgcggcaaccgggggccgtccctgcgcaccaccaccgtgacgggcaagatcatccacgagtggtgctgccggagctgcaccctgccgcccctccgcttcaagggggaggacggctgctggtacgggatggagatccggcccgtcaaggagaaggaggagaacctggtgaagtccatggtgagcgccggcagcggcgaggtcgactccttcagcctcgggctgctgtgcatctccatcatgatcgaggaggtgatgcgcagccggtggtcccgcaagatgctcatgaccggcaccctggccgtgttcctgctcctgatcatggggcagctgacgtggaacgacctcatccggctgtgcatcatggtcggcgccaacgcgagcgaccgcatggggatgggcaccacctacctggccctcatggccaccttcaagatgcgcccgatgttcgccgtggggctgctgttccggcgcctcacgtcccgggaggtgctgctgctcaccatcgggctgagcctggtcgcctccgtggagctccccaacagcctggaggagctgggcgacgggctcgcgatgggcatcatgatcctgaagctgctcaccgacttccagtcccaccagctgtgggccaccctgctcagcctgacgttcatcaagaccaccctgtccctccactacgcctggaagaccatggccatggtcctgagcatcgtgtccctgttccccctctgcctgagcacgacctcccagaagaccacctggctgcccgtgctcctgggcagcctggggtgcaagccgctcacgatgttcctgatcgcggagaacaagatctggggccgcaagtcctggcccctgaacgaggggatcatggccgtcggcgtggtgagcatcctcctgagctccctgctcaagaacgacgtccccctggccgggcccctgatcgccggcggcatgctcatcgcctgctacgtgatcagcgggtccagcgcggacctgtccctggagaaggccgccgaggtgagctgggaggaggaggccgagcactccggcgccagccacaacatcctcgtcgaggtgcaggacgacgggaccatgaagatcaaggacgaggagcgggacgacaccctgaccatcctgctcaaggcgaccctgctggccgtgtccggcgtctacccgctcagcatccccgccacgctgttcgtgtggtacttctggcagaagaagaagcagcgctccggggtgctgtgggacacccccagcccgcccgaggtcgagcgggccgtgctggacgacggcatctaccgcatcatgcagcggggcctcctggggcgctcccaggtgggcgtcggggtgttccaggagaacgtgttccacaccatgtggcacgtcacccggggcgccgtgctgatgtaccaggggaagcgcctcgagcccagctgggcgtccgtgaagaaggacctgatcagctacggcggcgggtggcggctgcagggctcctggaacacgggggaggaggtccaggtgatcgccgtggagcccggcaagaaccccaagaacgtccagaccgcccccgggaccttcaagacccccgagggcgaggtgggcgccatcgccctcgacttcaagcccgggacgagcggctcccccatcgtgaaccgcgaggggaagatcgtcggcctgtacggcaacggggtggtgaccaccagcggcacctacgtcagcgcgatcgcccaggccaaggcctcccaggaggggccgctgcccgagatcgaggacgaggtgttccggaagcgcaacctcacgatcatggacctgcaccccggcagcgggaagacccggcgctacctgccggcgatcgtgcgggaggccatcaagcgcaagctccggaccctgatcctggcccccacccgcgtcgtggcctccgagatggccgaggcgctcaagggcatgcccatccgctaccagacgaccgccgtcaagagcgagcacaccggcaaggagatcgtcgacctgatgtgccacgccaccttcacgatgcggctgctctcccccgtgcgcgtgccgaactacaacatgatcatcatggacgaggcccacttcaccgaccccagctccatcgccgcgcgggggtacatcagcacccgcgtcggcatgggggaggccgccgccatcttcatgaccgccacgccgcccggctccgtggaggcgttcccgcagagcaacgccgtgatccaggacgaggagcgggacatccccgagcgctcctggaacagcgggtacgagtggatcaccgacttccccggcaagaccgtctggttcgtgccctccatcaagagcggcaacgacatcgccaactgcctgcggaagaacgggaagcgcgtgatccagctgtcccggaagaccttcgacacggagtaccagaagaccaagaacaacgactgggactacgtcgtgaccaccgacatcagcgagatgggcgccaacttccgcgcggaccgggtgatcgacccgcgccggtgcctcaagcccgtcatcctgaaggacgggcccgagcgcgtgatcctggccggccccatgccggtcacggtggcctccgccgcccagcggcgcgggcggatcggccgcaaccacaacaaggagggcgaccagtacatctacatggggcagcccctcaacaacgacgaggaccacgcgcactggaccgaggccaagatgctgctggacaacatcaacacccccgagggcatcatccccgccctcttcgagccggagcgggagaagtccgccgccatcgacggggagtaccgcctgcgcggcgaggcgcggaagaccttcgtggagctgatgcgccgcggggacctccccgtctggctgtcctacaaggtggccagcgagggcttccagtacagcgaccgccggtggtgcttcgacggcgagcgcaacaaccaggtgctggaggagaacatggacgtcgagatctggacgaaggagggggagcggaagaagctccgcccccggtggctggacgcccgcacctactccgaccccctggccctccgggagttcaaggagttcgccgcgggccgccggagcgtgtccggggacctgatcctggagatcggcaagctcccgcagcacctgacccagcgcgcccagaacgccctggacaacctcgtgatgctgcacaacagcgagcagggcgggcgggcctaccgccacgcgatggaggagctgcccgacaccatcgagacgctcatgctgctggccctcatcgccgtcctgaccggcggggtgaccctgttcttcctctccggccgggggctgggcaagaccagcatcggcctgctctgcgtgatggcctccagcgtcctgctgtggatggcctccgtggagccccactggatcgcggccagcatcatcctcgagttcttcctgatggtgctgctcatccccgagccggaccgccagcggacgccccaggacaaccagctggcctacgtcgtgatcgggctcctcttcatgatcctgacggtggccgccaacgagatgggcctgctcgagaccaccaagaaggacctggggatcggccacgtcgcggtggagaaccaccaccacgccaccatgctggacgtggacctccaccccgcctccgcctggacgctgtacgccgtcgcgaccaccatcatcaccccgatgatgcgccacacgatcgagaacaccaccgccaacatcagcctgaccgccatcgccaaccaggccgcgatcctcatggggctggacaagggctggcccatctccaagatggacatcggcgtgcccctgctcgccctggggtgctacagccaggtgaaccccctgacgctcaccgccgccgtcctgatgctggtggcgcactacgccatcatcggcccggggctccaggccaaggccacccgggaggcccagaagcgcaccgcggccggcatcatgaagaaccccacggtggacgggatcgtcgccatcgacctggaccccgtggtgtacgacgccaagttcgagaagcagctgggccagatcatgctcctgatcctgtgcacctcccagatcctcctgatgcgcaccacctgggccctgtgcgagagcatcacgctcgcgaccggccccctgaccaccctgtgggaggggtccccgggcaagttctggaacacgaccatcgccgtcagcatggccaacatcttccgggggtcctacctcgccggcgccggcctggcgttcagcctgatgaagtccctcgggggcgggcgccggggcaccggggcccagggcgagaccctgggcgagaagtggaagcgccagctgaaccagctctccaagagcgagttcaacatctacaagcggtccgggatcatggaggtggaccgcagcgaggccaaggagggcctgaagcgcggggagacgacccgccacgccgtgtcccggggcaccgcgaagctgcgctggttcgtcgagcggaacctggtgaagcccgaggggaaggtgatcgacctcggctgcggccgcgggggctggagctactactgcgccgggctgaagaaggtcaccgaggtgaagggctacacgaagggcgggcccggccacgaggagcccatcccgatggccacctacgggtggaacctggtgaagctccactccggcaaggacgtcttcttcacgccgcccgagaagtgcgacaccctgctgtgcgacatcggggagagctcccccaacccgacgatcgaggagggccggaccctccgcgtgctgaagatggtggagccctggctgcgggggaaccagttctgcatcaagatcctcaacccctacatgcccagcgtcgtggagaccctggagcagatgcagcgcaagcacggcggcatgctggtgcggaacccgctctcccgcaacagcacccacgagatgtactgggtctcctgcgggaccggcaacatcgtgagcgccgtgaacatgacgtcccggatgctgctgaaccgcttcaccatggcccaccgcaagcccacctacgagcgggacgtcgacctcggggcgggcacccgccacgtggccgtggagcccgaggtcgccaacctggacatcatcggccagcggatcgagaacatcaagcacgagcacaagagcacgtggcactacgacgaggacaacccctacaagacctgggcctaccacgggtcctacgaggtgaagccgagcggctccgccagcagcatggtcaacggggtggtgaagctgctcaccaagccctgggacgtcatccccatggtgacccagatcgcgatgacggacaccacccccttcggccagcagcgcgtgttcaaggagaaggtcgacacccggacgccgaaggccaagcgcgggaccgcccagatcatggaggtgaccgcccggtggctgtggggcttcctgtcccgcaacaagaagccccggatctgcacccgcgaggagttcacgcggaaggtgcgcagcaacgccgcgatcggcgccgtcttcgtggacgagaaccagtggaactccgccaaggaggccgtggaggacgagcggttctgggacctcgtccagaaggagcgcgagctgcacaagcaggggaagtgcgcgacctgcgtgtacaacatgatgggcaagcgggagaagaagctgggggagttcggcaaggccaaggggagccgcgccatctggtacatgtggctcggcgcccggttcctggagttcgaggccctgggcttcatgaacgaggaccactggttctcccgcgagaacagcctctccggggtggagggcgaggggctgcacaagctgggctacatcctccgggacatcagcaagatccccgggggcaacatgtacgcggacgacaccgccggctgggacacccgcatcacggaggacgacctgcagaacgaggccaagatcaccgacatcatggagccggagcacgccctgctcgccacctccatcttcaagctgacctaccagaacaaggtcgtgcgggtgcagcgccccgcgaagaacgggacggtcatggacgtgatcagccgccgggaccagcgcggctccggccaggtgggcacctacggcctgaacaccttcaccaacatggaggcccagctcatccggcagatggagagcgaggggatcttctcccccagcgagctggagatccccaacctggccgagcgcgtcctcgactggctggagaagtacggcgtggagcggctgaagcgcatggccatctccggggacgactgcgtggtcaagccgatcgacgaccggttcgccacggcgctcaccgccctgaacgacatgggcaaggtgcgcaaggacgtgccccagtgggagcccagcaaggggtggaacgactggcagcaggtccccttctgctcccaccacttccaccagctgatcatgaaggacggccgggagatcgtggtgccgtgccgcaaccaggacgagctcgtcggccgggcccgcgtgagccagggggccggctggagcctgcgggagaccgcctgcctggggaagtcctacgcgcagatgtggcagctcatgtacttccaccgccgggacctgcgcctggccgccaacgccatctgcagcgcggtgcccgtcgactgggtgcccacctcccggacgacctggagcatccacgcccaccaccagtggatgaccaccgaggacatgctctccgtgtggaaccgcgtctggatcgaggagaacccctggatggaggacaagacgcacgtgagctcctggggcgacgtgccgtacctggggaagcgggaggaccagtggtgcggcagcctgatcggcctcaccgcccgcgccacctgggcctccaacatccaggtcgcgatcaaccaggtgcgccggctgatcgggaacgagaactacctggactacatgaccagcatgaagcgcttcaagaacgagggcgaccccgagggggccctctggtga

SEQ ID NO: 8450 - RNA, 9879 nt, synthetic construct
  misc_feature 1..9879: note = derived and/or modified CDS sequence (opt1) from DENV-1__FJ882524__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgcgggggtgaacatgtgcaccctcatcgccatggacctgggcgagctgtgcgaggacaccatgacctacaagtgcccccggatcaccgaggccgagcccgacgacgtggactgctggtgcaacgccacggacacctgggtgacctacgggacctgcagccagacgggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaactacgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtggggaagctggtccaccagatcttcggcaccgcctacggggtcctgttctccggcgtgagctggaccatgaagatcgggatcggcgtcctgctgacgtggctcggcctgaactcccgcagcacctccctgagcatgacctgcatcgccgtggggctcgtgaccctgtacctgggcgtcatggtgcaggccgactccgggtgcgtgatcaactggaagggccgggagctcaagtgcgggagcggcatcttcgtcacgaacgaggtgcacacctggaccgagcagtacaagttccaggcggacagcccgaagcgcctgtccgccgccatcggcaaggcctgggaggagggggtgtgcggcatccggagcgccacccgcctggagaacatcatgtggaagcagatctccaacgagctcaaccacatcctgctggagaacgacatgaagttcaccgtcgtggtgggggacgtcgtgggcatcctcgcgcaggggaagaagatgatccggccccagcccatggagcacaagtacagctggaagtcctggggcaaggccaagatcatcggcgccgacgtgcagaacacgaccttcatcatcgacgggcccaacaccccggagtgccccgacgaccagcgcgcctggaacatctgggaggtcgaggactacggcttcgggatcttcaccacgaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacctgcatctggcccaagtcccacacgctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcaccacggtggtcgtggacgagcactgcggcaaccgggggccgtccctgcgcaccaccaccgtgacgggcaagatcatccacgagtggtgctgccggagctgcaccctgccgcccctccgcttcaagggggaggacggctgctggtacgggatggagatccggcccgtcaaggagaaggaggagaacctggtgaagtccatggtgagcgccggcagcggcgaggtcgactccttcagcctcgggctgctgtgcatctccatcatgatcgaggaggtgatgcgcagccggtggtcccgcaagatgctcatgaccggcaccctggccgtgttcctgctcctgatcatggggcagctgacgtggaacgacctcatccggctgtgcatcatggtcggcgccaacgcgagcgaccgcatggggatgggcaccacctacctggccctcatggccaccttcaagatgcgcccgatgttcgccgtggggctgctgttccggcgcctcacgtcccgggaggtgctgctgctcaccatcgggctgagcctggtcgcctccgtggagctccccaacagcctggaggagctgggcgacgggctcgcgatgggcatcatgatcctgaagctgctcaccgacttccagtcccaccagctgtgggccaccctgctcagcctgacgttcatcaagaccaccctgtccctccactacgcctggaagaccatggccatggtcctgagcatcgtgtccctgttccccctctgcctgagcacgacctcccagaagaccacctggctgcccgtgctcctgggcagcctggggtgcaagccgctcacgatgttcctgatcgcggagaacaagatctggggccgcaagtcctggcccctgaacgaggggatcatggccgtcggcgtggtgagcatcctcctgagctccctgctcaagaacgacgtccccctggccgggcccctgatcgccggcggcatgctcatcgcctgctacgtgatcagcgggtccagcgcggacctgtccctggagaaggccgccgaggtgagctgggaggaggaggccgagcactccggcgccagccacaacatcctcgtcgaggtgcaggacgacgggaccatgaagatcaaggacgaggagcgggacgacaccctgaccatcctgctcaaggcgaccctgctggccgtgtccggcgtctacccgctcagcatccccgccacgctgttcgtgtggtacttctggcagaagaagaagcagcgctccggggtgctgtgggacacccccagcccgcccgaggtcgagcgggccgtgctggacgacggcatctaccgcatcatgcagcggggcctcctggggcgctcccaggtgggcgtcggggtgttccaggagaacgtgttccacaccatgtggcacgtcacccggggcgccgtgctgatgtaccaggggaagcgcctcgagcccagctgggcgtccgtgaagaaggacctgatcagctacggcggcgggtggcggctgcagggctcctggaacacgggggaggaggtccaggtgatcgccgtggagcccggcaagaaccccaagaacgtccagaccgcccccgggaccttcaagacccccgagggcgaggtgggcgccatcgccctcgacttcaagcccgggacgagcggctcccccatcgtgaaccgcgaggggaagatcgtcggcctgtacggcaacggggtggtgaccaccagcggcacctacgtcagcgcgatcgcccaggccaaggcctcccaggaggggccgctgcccgagatcgaggacgaggtgttccggaagcgcaacctcacgatcatggacctgcaccccggcagcgggaagacccggcgctacctgccggcgatcgtgcgggaggccatcaagcgcaagctccggaccctgatcctggcccccacccgcgtcgtggcctccgagatggccgaggcgctcaagggcatgcccatccgctaccagacgaccgccgtcaagagcgagcacaccggcaaggagatcgtcgacctgatgtgccacgccaccttcacgatgcggctgctctcccccgtgcgcgtgccgaactacaacatgatcatcatggacgaggcccacttcaccgaccccagctccatcgccgcgcgggggtacatcagcacccgcgtcggcatgggggaggccgccgccatcttcatgaccgccacgccgcccggctccgtggaggcgttcccgcagagcaacgccgtgatccaggacgaggagcgggacatccccgagcgctcctggaacagcgggtacgagtggatcaccgacttccccggcaagaccgtctggttcgtgccctccatcaagagcggcaacgacatcgccaactgcctgcggaagaacgggaagcgcgtgatccagctgtcccggaagaccttcgacacggagtaccagaagaccaagaacaacgactgggactacgtcgtgaccaccgacatcagcgagatgggcgccaacttccgcgcggaccgggtgatcgacccgcgccggtgcctcaagcccgtcatcctgaaggacgggcccgagcgcgtgatcctggccggccccatgccggtcacggtggcctccgccgcccagcggcgcgggcggatcggccgcaaccacaacaaggagggcgaccagtacatctacatggggcagcccctcaacaacgacgaggaccacgcgcactggaccgaggccaagatgctgctggacaacatcaacacccccgagggcatcatccccgccctcttcgagccggagcgggagaagtccgccgccatcgacggggagtaccgcctgcgcggcgaggcgcggaagaccttcgtggagctgatgcgccgcggggacctccccgtctggctgtcctacaaggtggccagcgagggcttccagtacagcgaccgccggtggtgcttcgacggcgagcgcaacaaccaggtgctggaggagaacatggacgtcgagatctggacgaaggagggggagcggaagaagctccgcccccggtggctggacgcccgcacctactccgaccccctggccctccgggagttcaaggagttcgccgcgggccgccggagcgtgtccggggacctgatcctggagatcggcaagctcccgcagcacctgacccagcgcgcccagaacgccctggacaacctcgtgatgctgcacaacagcgagcagggcgggcgggcctaccgccacgcgatggaggagctgcccgacaccatcgagacgctcatgctgctggccctcatcgccgtcctgaccggcggggtgaccctgttcttcctctccggccgggggctgggcaagaccagcatcggcctgctctgcgtgaccgcctccagcgtcctgctgtggatggcctccgtggagccccactggatcgcggccagcatcatcctcgagttcttcctgatggtgctgctcatccccgagccggaccgccagcggacgccccaggacaaccagctggcctacgtcgtgatcgggctcctcttcatgatcctgaccgtggccgccaacgagatgggcctgctcgagaccaccaagaaggacctggggatcggccacgtcgcggtggagaaccaccaccacgccacgatgctggacgtggacctccaccccgcctccgcctggaccctgtacgccgtcgcgaccaccatcatcacgccgatgatgcgccacaccatcgagaacaccaccgccaacatcagcctgacggccatcgccaaccaggccgcgatcctcatggggctggacaagggctggcccatctccaagatggacatcggcgtgcccctgctcgccctggggtgctacagccaggtgaaccccctgaccctcaccgccgccgtcctgatgctggtggcgcactacgccatcatcggcccggggctccaggccaaggccacccgggaggcccagaagcgcacggcggccggcatcatgaagaaccccaccgtggacgggatcgtcgccatcgacctggaccccgtggtgtacgacgccaagttcgagaagcagctgggccagatcatgctcctgatcctgtgcacctcccagatcctcctgatgcgcaccacgtgggccctgtgcgagagcatcaccctcgcgaccggccccctgaccacgctgtgggaggggtccccgggcaagttctggaacaccaccatcgccgtcagcatggccaacatcttccgggggtcctacctcgccggcgccggcctggcgttcagcctgatgaagtccctcgggggcgggcgccggggcaccggggcccagggcgagacgctgggcgagaagtggaagcgccagctgaaccagctctccaagagcgagttcaacatctacaagcggtccgggatcatggaggtggaccgcagcgaggccaaggagggcctgaagcgcggggagaccacccgccacgccgtgtcccggggcaccgcgaagctgcgctggttcgtcgagcggaacctggtgaagcccgaggggaaggtgatcgacctcggctgcggccgcgggggctggagctactactgcgccgggctgaagaaggtcacggaggtgaagggctacaccaagggcgggcccggccacgaggagcccatcccgatggccacctacgggtggaacctggtgaagctccactccggcaaggacgtcttcttcacgccgcccgagaagtgcgacacgctgctgtgcgacatcggggagagctcccccaacccgaccatcgaggagggccggaccctccgcgtgctgaagatggtggagccctggctgcgggggaaccagttctgcatcaagatcctcaacccctacatgcccagcgtcgtggagaccctggagcagatgcagcgcaagcacggcggcatgctggtgcggaacccgctctcccgcaacagcacccacgagatgtactgggtctcctgcgggacgggcaacatcgtgagcgccgtgaacatgacctcccggatgctgctgaaccgcttcaccatggcccaccgcaagcccacctacgagcgggacgtcgacctcggggcgggcacgcgccacgtggccgtggagcccgaggtcgccaacctggacatcatcggccagcggatcgagaacatcaagcacgagcacaagagcacctggcactacgacgaggacaacccctacaagacctgggcctaccacgggtcctacgaggtgaagccgagcggctccgccagcagcatggtcaacggggtggtgaagctgctcaccaagccctgggacgtcatccccatggtgacgcagatcgcgatgaccgacaccacccccttcggccagcagcgcgtgttcaaggagaaggtcgacacgcggaccccgaaggccaagcgcgggaccgcccagatcatggaggtgaccgcccggtggctgtggggcttcctgtcccgcaacaagaagccccggatctgcacgcgcgaggagttcacccggaaggtgcgcagcaacgccgcgatcggcgccgtcttcgtggacgagaaccagtggaactccgccaaggaggccgtggaggacgagcggttctgggacctcgtccagaaggagcgcgagctgcacaagcaggggaagtgcgcgacctgcgtgtacaacatgatgggcaagcgggagaagaagctgggggagttcggcaaggccaaggggagccgcgccatctggtacatgtggctcggcgcccggttcctggagttcgaggccctgggcttcatgaacgaggaccactggttctcccgcgagaacagcctctccggggtggagggcgaggggctgcacaagctgggctacatcctccgggacatcagcaagatccccgggggcaacatgtacgcggacgacaccgccggctgggacacgcgcatcaccgaggacgacctgcagaacgaggccaagatcaccgacatcatggagccggagcacgccctgctcgccacctccatcttcaagctgacgtaccagaacaaggtcgtgcgggtgcagcgccccgcgaagaacgggaccgtcatggacgtgatcagccgccgggaccagcgcggctccggccaggtgggcacctacggcctgaacaccttcacgaacatggaggcccagctcatccggcagatggagagcgaggggatcttctcccccagcgagctggagatccccaacctggccgagcgcgtcctcgactggctggagaagtacggcgtggagcggctgaagcgcatggccatctccggggacgactgcgtggtcaagccgatcgacgaccggttcgccaccgcgctcaccgccctgaacgacatgggcaaggtgcgcaaggacgtgccccagtgggagcccagcaaggggtggaacgactggcagcaggtccccttctgctcccaccacttccaccagctgatcatgaaggacggccgggagatcgtggtgccgtgccgcaaccaggacgagctcgtcggccgggcccgcgtgagccagggggccggctggagcctgcgggagaccgcctgcctggggaagtcctacgcgcagatgtggcagctcatgtacttccaccgccgggacctgcgcctggccgccaacgccatctgcagcgcggtgcccgtcgactgggtgcccacgtcccggaccacctggagcatccacgcccaccaccagtggatgaccacggaggacatgctctccgtgtggaaccgcgtctggatcgaggagaacccctggatggaggacaagacccacgtgagctcctggggcgacgtgccgtacctggggaagcgggaggaccagtggtgcggcagcctgatcggcctcaccgcccgcgccacctgggcctccaacatccaggtcgcgatcaaccaggtgcgccggctgatcgggaacgagaactacctggactacatgaccagcatgaagcgcttcaagaacgagggcgaccccgagggggccctctggtga

SEQ ID NO: 8451 - RNA, 9879 nt, synthetic construct
  misc_feature 1..9879: note = derived and/or modified CDS sequence (opt1) from DENV-1__FJ882525__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagaccagcgcgggggtgaacatgtgcaccctcgtggccatggacctgggcgagttctgcgaggacacgatgacctacaagtgcccccggatcaccgaggccgagcccgacgacgtggactgctggtgcaacgccaccgacacgtgggtgacctacgggacctgcagccagaccggcgagcaccggcgcgacaagcggtccgtggccctggcgccccacgtgggcctcgggctggagacgcggaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtcaccccctccatggccatgcggtgcgtgggcatcggcagccgcgacttcgtggaggggctgtccggcgccacgtgggtcgacgtggtgctcgagcacgggagctgcgtcaccaccatggccaaggacaagcccaccctggacatcgagctgctcaagacggaggtgaccaaccccgcggtgctgcggaagctgtgcatcgaggccaagatctccaacaccaccacggacagccgctgcccgacccagggcgaggccaccctcgtcgaggagcaggacgccaacttcgtgtgccggcgcaccttcgtggaccggggctgggggaacggctgcgggctgttcggcaaggggtccctgatcacgtgcgccaagttcaagtgcgtcaccaagctcgagggcaagaccgtgcagtacgagaacctgaagtacagcgtgatcgtcaccgtgcacacgggcgaccagcaccaggtcgggaacgagtccaccgagcacggcaccaccgcgaccatcacgccccaggcccccagcaccgagatccagctgaccgactacggggccctcaccctggactgcagcccccggacgggcctggacttcaacgagatggtgctcctgaccatgaaggagaagtcctggctggtgcacaagcagtggttcctcgacctgccgctgccctggaccagcggggcctccaccagccaggagacgtggaaccggaaggacctcctggtcaccttcaagaccgcccacgcgaagaagcaggaggtggtggtcctgggctcccaggagggcgccatgcacaccgccctcacgggggccaccgagatccagaccagcggcaccacgaccatcttcgccgggcacctgaagtgccgcctgaagatggacaagctcaccctgaagggcatgtcctacgtgatgtgcaccgggagcttcaagctggagaaggaggtggcggagacgcagcacggcaccgtcctcgtgcagatccggtacgagggcaccgacgccccctgcaagatccccttctccacccaggacgagaagggggtgacgcagaacggccgcctgatcaccgccaacccgatcgtcaccgacaaggagaagcccgtgaacatcgaggccgagccgcccttcggggagagctacatcgtgatcggcgcgggcgagaaggccctgaagctgtcctggttcaagaaggggagctccatcggcaagatgttcgaggccaccgcccgcggggcccgccgcatggcgatcctcggcgacacggcctgggacttcgggagcatcggcggcgtcttcacctccgtggggaagctggtgcaccagatcttcggcaccgcctacggggtcctgttcagcggcgtgtcctggaccatgaagatcgggatcggcgtgctcctgacgtggctgggcctcaacagccggtccaccagcctgtccatgacctgcatcgccgtcgggctggtgaccctctacctgggcgtgatggtccaggccgacagcgggtgcgtgatcaactggaagggccgcgagctgaagtgcgggagcggcatcttcgtgacgaacgaggtccacacctggaccgagcagtacaagttccaggcggactccccgaagcggctcagcgccgccatcggcaaggcctgggaggagggggtgtgcggcatccgctccgccacccggctggagaacatcatgtggaagcagatcagcaacgagctgaaccacatcctcctggagaacgacatgaagttcaccgtggtcgtgggggacgtggcgggcatcctggcccaggggaagaagatgatccgcccccagcccatggagtacaagtactcctggaagtcctggggcaaggccaagatcatcggcgccgacgtccagaacacgaccttcatcatcgacgggcccaacaccccggagtgccccgacgaccagcgggcgtggaacatctgggaggtggaggactacggcttcgggatcttcaccacgaacatctggctcaagctgcgcgactcctacacccaggtgtgcgaccaccggctgatgagcgccgccatcaaggactccaaggccgtccacgccgacatgggctactggatcgagagcgagaagaacgagacctggaagctcgcgcgcgcctccttcatcgaggtgaagacctgcatctggcccaagagccacacgctgtggtccaacggcgtgctggagagcgagatgatcatccccaagatctacgggggcccgatctcccagcacaactaccggcccgggtacttcacccagaccgccggcccctggcacctcgggaagctggagctggacttcgacctctgcgagggcaccacggtcgtggtggacgagcactgcggcaaccgcgggccgagcctgcggaccaccaccgtcacgggcaagatcatccacgagtggtgctgccgctcctgcaccctgccgcccctgcggttcaagggggaggacggctgctggtacgggatggagatccgccccgtgaaggagaaggaggagaacctggtcaagagcatggtcagcgccggctccggcgaggtggacagcttctccctggggctcctgtgcatcagcatcatgatcgaggaggtgatgcggtcccgctggagccggaagatgctgatgaccggcaccctcgccgtcttcttcctgctgatcatcgggcagctcacgtggaacgacctgatccgcctgtgcatcatggtgggcgcgaacgcctccgaccgcatggggatgggcaccacctacctcgccctgatggccaccttcaagatgcggccgatgttcgccgtggggctcctgttccgccggctgacgagccgcgaggtcctgctcctgaccatcgggctgtccctcgtggcgagcgtcgagctgcccaactccctggaggagctcggcgacgggctggccatgggcatcatgatcctgaagctcctgaccgacttccagagccaccagctgtgggccaccctcctgtccctgacgttcatcaagaccaccttcagcctccactacgcctggaagaccatggcgatggtgctgtccatcgtgagcctgttccccctctgcctgtccacgaccagccagaagaccacctggctgcccgtcctcctgggctccctggggtgcaagccgctcacgatgttcctgatcgccgagaacaagatctggggccggcgcagctggcccctgaacgaggggatcatggccgtgggcatcgtgagcatcctcctgtccagcctgctcaagaacgacgtccccctggccgggcccctgatcgccggcggcatgctcatcgcgtgctacgtgatctccgggagctccgccgacctgagcctggagaaggccgccgaggtgtcctgggaggaggaggccgagcacagcggcgcgtcccacaacatcctcgtcgaggtgcaggacgacgggaccatgaagatcaaggacgaggagcgggacgacaccctgaccatcctgctcaaggccaccctgctggccgtgagcggcgtctacccgctctccatccccgccacgctgttcgtgtggtacttctggcagaagaagaagcagcgcagcggggtgctgtgggacacccccagcccgcccgaggtcgagcgggccgtgctcgacgacggcatctaccgcatcatgcagcggggcctgctggggcgcagccaggtgggcgtcggggtgttccaggagaacgtgttccacaccatgtggcacgtcacccggggcgcggtgctgatgtaccaggggaagcgcctcgagccctcctgggccagcgtgaagaaggacctgatctcctacggcggcgggtggcggctgcagggcagctggaacacgggggaggaggtccaggtgatcgccgtggagcccggcaagaaccccaagaacgtccagaccgcccccgggaccttcaagacctccgagggcgaggtgggcgccatcgcgctcgacttcaagcccgggacgagcggcagccccatcgtgaaccgcgaggggaagatcgtcggcctgtacggcaacggggtggtgaccacctccggcacctacgtcagcgccatcgcccaggccaaggcgtcccaggaggggcccctgccggagatcgaggacgaggtgttccggaagcgcaacctcacgatcatggacctgcaccccggcagcgggaagacccggcgctacctgcccgccatcgtgcgggaggccatcaagcgcaagctccgcaccctgatcctggccccgacccgggtcgtggcctccgagatggcggaggccctcaagggcatgcccatccgctaccagacgaccgccgtcaagagcgagcacaccggcaaggagatcgtcgacctgatgtgccacgccaccttcacgatgcggctgctctcccccgtgcgcgtgcccaactacaacatgatcatcatggacgaggcccacttcaccgacccgagctccatcgcggcccgggggtacatcagcacccgcgtcggcatgggggaggccgccgccatcttcatgaccgcgacgccgcccggctccgtggaggccttcccccagagcaacgccgtgatccaggacgaggagcgggacatcccggagcgctcctggaacagcgggtacgagtggatcaccgacttccccggcaagaccgtctggttcgtgccctccatcaagagcggcaacgacatcgccaactgcctgcggaagaacgggaagcgcgtgatccagctgtcccggaagaccttcgacacggagtaccagaagaccaagaacaacgactgggactacgtcgtgaccaccgacatcagcgagatgggcgcgaacttccgcgccgaccgggtgatcgacccccgccggtgcctcaagccggtcatcctgaaggacgggcccgagcgcgtgatcctggccggccccatgcccgtcacggtggcctccgccgcgcagcggcgcgggcggatcggccgcaaccacaacaaggagggcgaccagtacatctacatggggcagccgctcaacaacgacgaggaccacgcccactggaccgaggccaagatgctgctggacaacatcaacacccccgagggcatcatccccgccctcttcgagcccgagcgcgagaagtccgccgcgatcgacggggagtaccggctgcgcggcgaggcccggaagaccttcgtggagctgatgcgccgcggggacctcccggtctggctgagctacaaggtggcctccgagggcttccagtacagcgaccgccggtggtgcttcgacggcgagcgcaacaaccaggtgctggaggagaacatggacgtcgagatctggacgaaggagggggagcggaagaagctccgcccccggtggctggacgcccgcacctactccgaccccctggccctccgggagttcaaggagttcgcggccggccgccggagcgtgtccggggacctgatcctggagatcggcaagctcccccagcacctgacccagcgcgcccagaacgccctggacaacctcgtgatgctgcacaacagcgagcagggcgggcgggcgtaccgccacgccatggaggagctgccggacaccatcgagacgctcatgctgctggccctcatcgccgtcctgaccggcggggtgaccctgttcttcctctccggccgggggctgggcaagaccagcatcggcctgctctgcgtgatggcctccagcgtcctgctgtggatggcgtccgtggagccccactggatcgccgccagcatcatcctcgagttcttcctgatggtgctgctcatccccgagcccgaccgccagcggaccccgcaggacaaccagctggcctacgtcgtgatcgggctcctcttcatgatcctgacggtggccgcgaacgagatgggcctgctcgagaccaccaagaaggacctggggatcggccacgtcgccgtggagaaccaccaccacgccgccatgctggacgtggacctccaccccgcctccgcgtggaccctgtacgccgtcgccacgaccatcatcacccccatgatgcgccacaccatcgagaacacgaccgccaacatcagcctgaccgccatcgcgaaccaggccgccatcctcatggggctggacaagggctggccgatctccaagatggacatcggcgtgcccctgctcgccctggggtgctacagccaggtgaaccccctgaccctcacggcggccgtcctgatgctggtggcccactacgccatcatcggccccgggctccaggccaaggcgacccgcgaggcccagaagcggaccgccgccggcatcatgaagaacccgaccgtggacgggatcgtcgccatcgacctggaccccgtggtgtacgacgcgaagttcgagaagcagctgggccagatcatgctcctgatcctgtgcacgtcccagatcctcctgatgcgcaccacctgggccctgtgcgagagcatcaccctcgccacgggccccctgaccaccctgtgggaggggtcccccggcaagttctggaacaccacgatcgccgtcagcatggccaacatcttccgggggagctacctcgcgggcgccggcctggccttctccctgatgaagtccctcgggggcgggcgccggggcaccggggcccagggcgagaccctgggcgagaagtggaagcgccagctgaaccagctctccaagagcgagttcaacacctacaagcggtccgggatcatggaggtggaccgcagcgaggcgaaggagggcctgaagcgcggggagacgaccaagcacgccgtgtcccgcggcaccgccaagctgcggtggttcgtcgagcgcaacttcgtgaagccggaggggaaggtgatcgacctcggctgcggccgcggcgggtggagctactactgcgccgggctgaagaaggtcaccgaggtgaaggggtacacgaagggcgggcccggccacgaggagcccatccccatggccacctacgggtggaacctggtgaagctgcactccggcaaggacgtcttcttcatcccgcccgagaagtgcgacaccctcctgtgcgacatcggggagagctcccccaaccccaccatcgaggagggccgcacgctgcgggtgctcaagatggtggagccgtggctgcgcgggaaccagttctgcatcaagatcctgaacccctacatgcccagcgtcgtggagaccctcgagcggatgcagcgcaagcacggcggcatgctggtgcggaaccccctgtcccgcaacagcacccacgagatgtactgggtctcctgcgggaccggcaacatcgtgagcgcggtgaacatgacctcccgcatgctcctgaaccggttcacgatggcccaccgcaagccgacctacgagcgggacgtcgacctgggggccggcacccgccacgtggccgtggagcccgaggtcgccaacctcgacatcatcggccagcggatcgagaacatcaagcacgagcacaagagcacctggcactacgacgaggacaacccctacaagacgtgggcgtaccacgggtcctacgaggtgaagcccagcggcagcgcctccagcatggtcaacggggtggtgaagctgctgaccaagccgtgggacgtcatccccatggtgacccagatcgccatgaccgacacgacccccttcggccagcagcgcgtgttcaaggagaaggtcgacacccggacccccaaggccaagcgcgggacggcccagatcatggaggtgaccgcgaagtggctctggggcttcctgtcccggaacaagaagccgcgcatctgcacccgggaggagttcacccgcaaggtgcggagcaacgccgccatcggcgccgtcttcgtggacgagaaccagtggaactccgcgaaggaggccgtggaggacgagcgcttctgggacctggtccaccgggagcgcgagctccacaagcaggggaagtgcgccacgtgcgtgtacaacatgatgggcaagcgggagaagaagctgggggagttcggcaaggccaaggggagccgcgccatctggtacatgtggctgggcgcgcggttcctcgagttcgaggccctgggcttcatgaacgaggaccactggttctcccgcgagaacagcctgtccggggtggagggcgaggggctccacaagctgggctacatcctgcgggacatcagcaagatccccgggggcaacatgtacgccgacgacaccgccggctgggacacccgcatcaccgaggacgacctccagaacgaggccaagatcacggacatcatggagcccgagcacgcgctgctggccaagtccatcttcaagctcacctaccagaacaaggtcgtgcgcgtgcagcggccggccaagaacgggaccgtcatggacgtgatcagccgccgggaccagcgcggctccggccaggtgggcacctacggcctgaacacgttcaccaacatggaggcccagctgatccggcagatggagagcgaggggatcttctcccccagcgagctcgagacccccaacctggccggccgcgtcctggactggctcgagaagcacggggtggagcggctgaagcgcatggcgatctccggcgacgactgcgtggtcaagcccatcgacgaccggttcgccaccgccctgacggccctcaacgacatggggaaggtgcgcaaggacatcccgcagtgggagcccagcaagggctggaacgactggcagcaggtccccttctgcagccaccacttccaccagctgatcatgaaggacggccgggagatcgtcgtgccctgccgcaaccaggacgagctggtggggcgggcccgcgtctcccagggcgcggggtggagcctccgggagaccgcctgcctgggcaagtcctacgcccagatgtggcagctgatgtacttccaccgccgggacctccgcctggccgcgaacgccatctgcagcgccgtgccggtggactgggtccccacctcccggaccacgtggagcatccacgcccaccaccagtggatgaccaccgaggacatgctgtccgtgtggaaccgcgtgtggatcgaggagaacccctggatggaggacaagacccacatcagctcctggggcgacgtcccctacctcggcaagcgcgaggaccagtggtgcggcagcctgatcgggctgacggcccgggcgacctgggccaccaacatccaggtggccatcaaccaggtgcgccggctcatcggcaacgagaactacctggactacatgacctccatgaagcgcttcaagaacgagagcgacccggagggggccctgtggtga

SEQ ID NO: 8452 - RNA, 9879 nt, synthetic construct
  misc_feature 1..9879: note = derived and/or modified CDS sequence (opt1) from DENV-1__FJ882526__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagacctccgccggggtgaacatgtgcaccctcatcgccatggacctgggggagttctgcgaggacaccatgacctacaagtgcccccgcatcaccgaggccgagcccgacgacgtggactgctggtgcaacgccaccgacacgtgggtgacctacgggacctgcagccagaccggggagcaccggcgcgacaagcggtccgtggccctggcgccccacgtgggcctcgggctggagacgcgcaccgagacctggatgagctccgagggcgcctggaagcagatccagcgggtcgagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggaccagcggggcctccaccagccaggagacctggaaccggaaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctcgtccagatcaagtacgagggcaccgacgccccctgcaagatccccttctccacccaggacgagaagggggtgacccagaacggccggctgatcacggccaacccgatcgtgaccgacaaggagaagcccgtcaacatcgaggccgagccgcccttcggggagagctacatcgtgatcggcgcgggcgagcgcgccctgaagctgtcctggttcaagaaggggagctccatcggcaagatgttcgaggccaccgcccgcggggcccgccgcatggcgatcctcggcgacaccgcctgggacttcgggagcatcggcggcgtgttcacgtccgtcgggaagctggtgcaccagatcttcggcaccgcctacggggtgctgttcagcggcgtctcctggaccatgaagatcgggatcggcgtgctcctgacctggctgggcctcaacagccggtccacgagcctgtccatgacctgcatcgccgtggggctggtcaccctctacctgggcgtgatggtgcaggccgacagcgggtgcgtcatcaactggaagggccgcgagctgaagtgcgggagcggcatcttcgtgaccaacgaggtgcacacgtggaccgagcagtacaagttccaggcggactccccgaagcggctcagcgccgccatcggcaaggcctgggaggagggggtctgcggcatccgctccgccacccggctggagaacatcatgtggaagcagatcagcaacgagctgaaccacatcctcctggagaacgacatgaagttcaccgtggtggtcggggacgtggcgggcatcctggcccaggggaagaagatgatccgcccccagcccatggagtacaagtactcctggaagtcctggggcaaggccaagatcatcggcgccgacgtgcagaacaccacgttcatcatcgacgggcccaacaccccggagtgccccgacgaccagcgggcgtggaacatctgggaggtcgaggactacggcttcgggatcttcaccaccaacatctggctcaagctgcgcgactcctacacccaggtgtgcgaccaccggctgatgagcgccgccatcaaggactccaaggccgtgcacgccgacatgggctactggatcgagagcgagaagaacgagacctggaagctcgcgcgcgcctccttcatcgaggtcaagacctgcatctggcccaagagccacaccctgtggtccaacggcgtgctggagagcgagatgatcatccccaagatctacgggggcccgatctcccagcacaactaccggcccgggtacttcacgcagaccgccggcccctggcacctcgggaagctggagctggacttcgacctctgcgagggcaccaccgtggtcgtggacgagcactgcggcaaccgcgggccgagcctgcggacgaccaccgtgaccggcaagatcatccacgagtggtgctgccgctcctgcacgctgccgcccctgcggttcaagggggaggacggctgctggtacgggatggagatccgccccgtcaaggagaaggaggagaacctggtcaagagcatggtgagcgccggctccggcgaggtcgacagcttctccctggggctcctgtgcatcagcatcatgatcgaggaggtgatgcggtcccgctggagccggaagatgctgatgaccggcaccctcgccgtgttcttcctgctgatcatggggcagctcacctggaacgacctgatccgcctgtgcatcatggtcggcgcgaacgcctccgaccgcatggggatgggcacgacctacctcgccctgatggccaccttcaagatgcggccgatgttcgccgtgggcctcctgttccgccggctgaccagccgcgaggtgctgctcctgacgatcgggctgtccctcgtcgcgagcgtggagctgcccaactccctggaggagctcggcgacgggctggccatgggcatcatgatcctgaagctcctgaccgacttccagagccaccagctgtgggccaccctcctgtccctgaccttcatcaagacgaccttcagcctccactacgcctggaagaccatggcgatggtcctgtccatcgtgagcctgttccccctctgcctgtccaccacgagccagaagaccacctggctgcccgtgctcctgggctccctggggtgcaagccgctcaccatgttcctgatcgccgagaacaagatctggggccgcaagagctggcccctgaacgaggggatcatggccgtcggcatcgtgagcatcctcctgtccgccctgctcaagaacgacgtgcccctggccgggcccctgatcgcgggcggcatgctcatcgcctgctacgtcatcagcgggtccagcgccgacctgtccctggagaaggccgccgaggtgagctgggaggaggaggcggagcactccggcgccagccacaacatcctcgtggaggtccaggacgacgggacgatgaagatcaaggacgaggagcgcgacgacaccctgaccatcctgctcaaggccaccctgctggccgtgtccggcgtgtacccgctcagcatccccgccaccctgttcgtctggtacttctggcagaagaagaagcagcggtccggggtgctgtgggacacgcccagcccgcccgaggtggagcgcgcggtcctcgacgacggcatctaccggatcatgcagcgcggcctgctggggcggtcccaggtgggcgtgggggtcttccaggagaacgtgttccacaccatgtggcacgtgacccgcggcgccgtcctgatgtaccaggggaagcggctcgagcccagctgggcctccgtgaagaaggacctgatcagctacggcggcgggtggcgcctgcagggctcctggaacaccggggaggaggtgcaggtcatcgccgtggagcccggcaagaaccccaagaacgtgcagacggcccccgggaccttcaagaccagcgagggcgaggtcggcgcgatcgccctcgacttcaagcccgggacctccggcagccccatcgtgaaccgggaggggaagatcgtgggcctgtacggcaacggggtcgtgacgaccagcggcacctacgtgtccgccatcgcccaggcgaaggccagccaggaggggcccctgccggagatcgaggacgaggtcttccgcaagcggaacctcaccatcatggacctgcaccccggctccgggaagacgcgccggtacctgcccgccatcgtgcgcgaggccatcaagcggaagctccgcaccctgatcctggccccgacccgcgtggtcgcgagcgagatggccgaggccctcaagggcatgcccatccggtaccagaccacggccgtgaagtccgagcacaccggcaaggagatcgtggacctgatgtgccacgccaccttcaccatgcgcctgctcagccccgtccgggtgcccaactacaacatgatcatcatggacgaggcgcacttcacggacccgtccagcatcgccgcccgcgggtacatctccacccgggtgggcatgggggaggccgccgcgatcttcatgaccgccacgccgcccggcagcgtcgaggccttcccccagtccaacgccgtgatccaggacgaggagcgcgacatcccggagcggagctggaactccgggtacgagtggatcacggacttccccggcaagaccgtgtggttcgtccccagcatcaagtccggcaacgacatcgcgaactgcctgcgcaagaacgggaagcgggtgatccagctgagccgcaagaccttcgacaccgagtaccagaagacgaagaacaacgactgggactacgtggtcaccaccgacatctccgagatgggcgccaacttccgggccgaccgcgtgatcgacccccggcgctgcctcaagccggtgatcctgaaggacgggcccgagcgggtcatcctggccggccccatgcccgtgaccgtcgccagcgcggcccagcgccgggggcgcatcggccggaaccacaacaaggagggcgaccagtacatctacatggggcagccgctcaacaacgacgaggaccacgcccactggacggaggccaagatgctgctggacaacatcaacacccccgagggcatcatccccgccctcttcgagcccgagcgcgagaagtccgcggccatcgacggggagtaccgcctgcggggcgaggcccgcaagaccttcgtggagctgatgcggcgcggggacctcccggtgtggctgagctacaaggtcgccagcgagggcttccagtactccgaccggcgctggtgcttcgacggcgagcggaacaaccaggtgctggaggagaacatggacgtggagatctggaccaaggagggggagcgcaagaagctccggccccgctggctggacgcccggacgtacagcgaccccctggcgctccgcgagttcaaggagttcgccgccggccggcgctccgtcagcggggacctgatcctggagatcggcaagctcccccagcacctgacccagcgggcccagaacgcgctggacaacctcgtgatgctgcacaactccgagcagggcgggcgcgcctaccggcacgccatggaggagctgccggacaccatcgagaccctcatgctgctggccctcatcgccgtgctgacgggcggggtcaccctgttcttcctcagcggccgcgggctgggcaagacctccatcggcctgctctgcgtgatggcgagctccgtgctgctgtggatggccagcgtcgagccccactggatcgccgcctccatcatcctcgagttcttcctgatggtgctgctcatccccgagcccgaccggcagcgcaccccgcaggacaaccagctggcctacgtggtcatcgggctcctcttcatgatcctgaccgtggcggccaacgagatgggcctgctcgagacgaccaagaaggacctggggatcggccacgtggccgtcgagaaccaccaccacgccgccatgctggacgtggacctccaccccgcgagcgcctggaccctgtacgccgtggccaccacgatcatcacccccatgatgcggcacaccatcgagaacaccacggccaacatctccctgaccgcgatcgccaaccaggccgccatcctcatggggctggacaagggctggccgatcagcaagatggacatcggcgtccccctgctcgcgctggggtgctactcccaggtgaaccccctgaccctcaccgccgccgtgctgatgctggtcgcccactacgccatcatcggccccgggctccaggcgaaggccacgcgcgaggcccagaagcgcaccgccgccggcatcatgaagaacccgaccgtggacgggatcgtggcgatcgacctggaccccgtcgtgtacgacgccaagttcgagaagcagctgggccagatcatgctcctgatcctgtgcaccagccagatcctcctgatgcggacgacctgggccctgtgcgagtccatcaccctcgccaccggccccctgacgaccctgtgggaggggagccccggcaagttctggaacaccaccatcgccgtgtccatggcgaacatcttccgcgggagctacctcgccggcgccggcctggccttcagcctgatgaagtccctcgggggcgggcggcgcggcacgggggcgcagggcgagaccctgggcgagaagtggaagcggcagctgaaccagctcagcaagtccgagttcaacacctacaagcgcagcgggatcatggaggtcgaccggtccgaggccaaggagggcctgaagcgcggggagaccacgaagcacgccgtgagccggggcaccgccaagctgcgctggttcgtggagcggaacctcgtcaagccggaggggaaggtgatcgacctgggctgcggccgcgggggctggtcctactactgcgccgggctgaagaaggtgaccgaggtcaagggctacaccaagggcgggcccggccacgaggagcccatccccatggcgacgtacgggtggaacctggtgaagctccacagcggcaaggacgtgttcttcatcccgcccgagaagtgcgacaccctgctgtgcgacatcggggagtccagccccaaccccaccatcgaggagggccggaccctccgcgtcctgaagatggtggagccgtggctgcgggggaaccagttctgcatcaagatcctcaacccctacatgccctccgtggtcgagacgctggagcagatgcagcgcaagcacggcggcatgctggtgcggaaccccctcagccgcaactccacccacgagatgtactgggtgagctgcgggaccggcaacatcgtctccgccgtgaacatgaccagccggatgctgctgaaccgcttcaccatggcccaccgcaagccgacgtacgagcgggacgtggacctcggggccggcacccgccacgtcgccgtggagcccgaggtggcgaacctggacatcatcggccagcggatcgagaacatcaagcacgagcacaagtccacctggcactacgacgaggacaacccctacaagacctgggcctaccacgggagctacgaggtcaagccctccggcagcgccagctccatggtgaacggggtcgtgaagctgctcacgaagccgtgggacgtgatccccatggtcacccagatcgccatgaccgacaccacgcccttcggccagcagcgcgtgttcaaggagaaggtggacacccggacccccaaggccaagcgcgggaccgcgcagatcatggaggtcacggccaagtggctgtggggcttcctgagccggaacaagaagccgcgcatctgcacccgggaggagttcacccgcaaggtgcggtccaacgccgccatcggcgcggtgttcgtcgacgagaaccagtggaacagcgccaaggaggccgtggaggacgagcgcttctgggacctcgtgcaccgggagcgcgagctgcacaagcaggggaagtgcgcgacctgcgtctacaacatgatgggcaagcgggagaagaagctgggggagttcggcaaggccaaggggtcccgcgcgatctggtacatgtggctcggcgcccggttcctggagttcgaggccctgggcttcatgaacgaggaccactggttcagccgcgagaactccctcagcggggtggagggcgaggggctgcacaagctgggctacatcctccgggacatctccaagatccccgggggcaacatgtacgccgacgacacggccggctgggacacccgcatcaccgaggacgacctgcagaacgaggcgaagatcaccgacatcatggagcccgagcacgccctgctcgccaagagcatcttcaagctgacgtaccagaacaaggtggtccgggtgcagcgcccggccaagaacgggaccgtgatggacgtcatctcccgccgggaccagcgcggcagcggccaggtgggcacctacggcctgaacaccttcacgaacatggaggcccagctcatccggcagatggagtccgaggggatcttcagcccctccgagctggagacccccaacctggcgggccgcgtgctcgactggctggagaagcacggggtcgagcggctgaagcgcatggccatcagcggcgacgactgcgtggtgaagcccatcgacgaccggttcgccaccgccctcaccgccctgaacgacatggggaaggtccgcaaggacatcccgcagtgggagccctccaagggctggaacgactggcagcaggtccccttctgcagccaccacttccaccagctgatcatgaaggacggccgggagatcgtggtcccctgccgcaaccaggacgagctcgtggggcgggcgcgcgtgagccagggcgccgggtggtccctgcgggagacggcctgcctgggcaagagctacgcccagatgtggcagctcatgtacttccaccgccgggacctgcgcctggcggccaacgccatctgctccgccgtcccggtggactgggtgcccaccagccggaccacctggtccatccacgcccaccaccagtggatgacgaccgaggacatgctcagcgtctggaaccgcgtgtggatcgaggagaacccctggatggaggacaagacccacatctccagctggggcgacgtgccctacctgggcaagcgggaggaccagtggtgcggctccctgatcgggctcaccgcgcgcgccacgtgggccaccaacatccaggtcgccatcaaccaggtgcgccggctgatcggcaacgagaactacctggactacatgaccagcatgaagcgcttcaagaacgagtccgacccggagggggccctctggtga

SEQ ID NO: 8453 - RNA, 9879 nt, synthetic construct
  misc_feature 1..9879: note = derived and/or modified CDS sequence (opt1) from DENV-1__FJ882527__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagaccagcgccggggtgaacatgtgcaccctcatcgccatggacctgggcgagttctgcgaggacaccatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagaccgtccagtacgagaacctgaagtacagcgtgatcgtgaccgtccacacgggcgaccagcaccaggtggggaacgagtccaccgagcacggcaccaccgcgaccatcacgccccaggcccccagcaccgagatccagctgaccgactacggggccctcaccctggactgcagcccccggacgggcctggacttcaacgagatggtcctcctgaccatgaaggagaagtcctggctggtgcacaagcagtggttcctcgacctgccgctgccctggaccagcggggcctccaccagccaggagacgtggaaccggaaggacctcctggtgaccttcaagaccgcccacgcgaagaagcaggaggtcgtggtgctgggctcccaggagggcgccatgcacaccgccctcacgggggccaccgagatccagaccagcggcaccacgaccatcttcgccgggcacctgaagtgccgcctgaagatggacaagctcaccctgaagggcatgtcctacgtcatgtgcaccgggagcttcaagctggagaaggaggtggcggagacgcagcacggcaccgtgctcgtccagatcaagtacgagggcaccgacgccccctgcaagatccccttctccacccaggacgagaagggggtgacgcagaacggccggctgatcaccgccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacacggcctgggacttcgggagcatcggcggcgtgttcacctccgtcgggaagctggtgcaccagatcttcggcaccgcctacggggtgctgttcagcggcgtctcctggaccatgaagatcgggatcggcgtgctcctgacgtggctgggcctcaacagccgctccaccagcctgtccatgacctgcatcgccgtggggctggtcaccctctacctgggcgtgatggtgcaggccgacagcgggtgcgtcatcaactggaagggccgggagctgaagtgcgggagcggcatcttcgtgacgaacgaggtgcacacctggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagttcaccgtggtggtcggggacgtggcgggcatcctggcccaggggaagaagatgatccggccccagcccatggagtacaagtactcctggaagtcctggggcaaggccaagatcatcggcgccgacgtgcagaacacgaccttcatcatcgacgggcccaacaccccggagtgccccgacgaccagcgcgcgtggaacatctgggaggtcgaggactacggcttcgggatcttcaccacgaacatctggctcaagctgcgggactcctacacccaggtgtgcgaccaccgcctgatgagcgccgccatcaaggactccaaggccgtgcacgccgacatgggctactggatcgagagcgagaagaacgagacctggaagctcgcgcgggcctccttcatcgaggtcaagacctgcatctggcccaagagccacacgctgtggtccaacggcgtgctggagagcgagatgatcatccccaagatctacgggggcccgatctcccagcacaactaccgccccgggtacttcacccagaccgccggcccctggcacctcgggaagctggagctggacttcgacctctgcgagggcaccacggtggtcgtggacgagcactgcggcaaccgggggccgagcctgcgcaccaccaccgtgacgggcaagatcatccacgagtggtgctgccggtcctgcaccctgccgcccctgcgcttcaagggggaggacggctgctggtacgggatggagatccggcccgtcaaggagaaggaggagaacctggtcaagagcatggtgagcgccggctccggcgaggtcgacagcttctccctggggctcctgtgcatcagcatcatgatcgaggaggtgatgcgctcccggtggagccgcaagatgctgatgaccggcaccctcgccgtgttcttcctgctgatcatggggcagctcacgtggaacgacctgatccggctgtgcatcatggtcggcgcgaacgcctccgaccgcatggggatgggcaccacctacctcgccctgatggccaccttcaagatgcgcccgatgctggccgtgggcctcctgttccggcgcctgacgagccgggaggtgctcctgctgaccatcgggctctccctggtcgcgagcgtggagctgcccaactccctcgaggagctgggcgacgggctggccatgggcatcatgatcctcaagctgctgaccgacttccagagccaccagctctgggccaccctgctgtccctcacgttcatcaagaccaccttcagcctgcactacgcctggaagaccatggcgatggtcctgtccatcgtgagcctcttccccctgtgcctgtccacgaccagccagaagaccacctggctccccgtgctgctgggctccctcgggtgcaagccgctggccatgttcctgatcgccgagaacaagatctggggccgcaagagctggcccctcaacgaggggatcatggccgtcggcatcgtgagcatcctgctgtccagcctcctgaagaacgacgtgcccctggccgggcccctcatcgcgggcggcatgctgatcgcctgctacgtcatctccgggagctccgccgacctgagcctcgagaaggccgccgaggtgtcctgggaggaggaggcggagcacagcggcgcctcccacaacatcctggtggaggtccaggacgacgggacgatgaagatcaaggacgaggagcgggacgacaccctgaccatcctcctgaaggccaccctgctcgccgtgagcggcgtgtacccgctgtccatccccgccaccctgttcgtctggtacttctggcagaagaagaagcagcgcagcggggtgctctgggacacgcccagcccgcccgaggtggagcgggcggtcctggacgacggcatctaccgcatcatgcagcggggcctgctggggcgcagccaggtgggcgtgggggtcttccaggagaacgtgttccacaccatgtggcacgtgacccggggcgccgtcctcatgtaccaggggaagcgcctggagccctcctgggccagcgtgaagaaggacctgatctcctacggcggcgggtggcggctccagggcagctggaacaccggggaggaggtgcaggtcatcgccgtggagcccggcaagaaccccaagaacgtgcagacggcccccgggaccttcaagacctccgagggcgaggtcggcgcgatcgccctggacttcaagcccgggaccagcggcagccccatcgtgaaccgcgaggggaagatcgtgggcctgtacggcaacggggtcgtgacgacctccggcacctacgtgagcgccatcgcccaggcgaaggcctcccaggaggggcccctcccggagatcgaggacgaggtcttccggaagcgcaacctgaccatcatggacctgcaccccggcagcgggaagacgcggcgctacctccccgccatcgtgcgggaggccatcaagcgcaagctgcggaccctgatcctcgccccgacccgcgtggtcgcgtccgagatggccgaggccctgaagggcatgcccatccgctaccagaccacggccgtcaagagcgagcacaccggcaaggagatcgtggacctgatgtgccacgccaccttcaccatgcggctcctgtcccccgtccgcgtgcccaactacaacatgatcatcatggacgaggcgcacttcacggacccgagctccatcgccgcccgggggtacatcagcacccgcgtgggcatgggggaggccgccgcgatcttcatgaccgccacgccgcccggctccgtcgaggccttcccccagagcaacgccgtgatccaggacgaggagcgggacatcccggagcgctcctggaacagcgggtacgagtggatcacggacttccccggcaagaccgtgtggttcgtcccctccatcaagagcggcaacgacatcgcgaactgcctgcggaagaacgggaagcgcgtgatccagctctcccggaagaccttcgacaccgagtaccagaagacgaagaacaacgactgggactacgtggtcaccaccgacatcagcgagatgggcgccaacttccgcgccgaccgggtgatcgacccccgccggtgcctgaagccggtgatcctgaaggacgggcccgagcgcgtcatcctcgccggccccatgcccgtgaccgtcgcctccgcggcccagcggcgcgggcggatcggccgcaaccacaacaaggagggcgaccagtacatctacatggggcagccgctgaacaacgacgaggaccacgcccactggacggaggccaagatgctgctcgacaacatcaacacccccgagggcatcatccccgccctgttcgagcccgagcgggagaagtccgcggccatcgacggggagtaccgcctgcgcggcgaggcccggaagaccttcgtggagctcatgcgccgcggggacctgccggtgtggctgagctacaaggtcgcctccgagggcttccagtacagcgaccgccggtggtgcttcgacggcgagcgcaacaaccaggtgctcgaggagaacatggacgtggagatctggaccaaggagggggagcggaagaagctgcgcccccggtggctggacgcccgcacgtactccgaccccctcgcgctgcgggagttcaaggagttcgccgccggccgccggagcgtctccggggacctgatcctcgagatcggcaagctgccccagcacctgacccagcgcgcccagaacgcgctcgacaacctggtgatgctgcacaacagcgagcagggcgggcgggcctaccgccacgccatggaggagctcccggacaccatcgagaccctgatgctgctcgccctgatcgccgtgctgacgggcggggtcaccctcttcttcctgtccggccgggggctgggcaagaccagcatcggcctcctgtgcgtgatggcgtccagcgtgctgctctggatggcctccgtcgagccccactggatcgccgccagcatcatcctggagttcttcctgatggtgctcctgatccccgagcccgaccgccagcggaccccgcaggacaaccagctggcctacgtggtcatcgggctcctgttcatgatcctgaccgtggcggccaacgagatgggcctcctggagacgaccaagaaggacctggggatcggccacgtggccgtcgagaaccaccaccacgccgccatgctcgacgtggacctgcaccccgcgtccgcctggaccctgtacgccgtggccaccacgatcatcacccccatgatgcgccacaccatcgagaacaccacggccaacatcagcctcaccgcgatcgccaaccaggccgccatcctgatggggctggacaagggctggccgatctccaagatggacatcggcgtccccctcctggcgctggggtgctacagccaggtgaaccccctcaccctgaccgccgccgtgctgatgctcgtcgcccactacgccatcatcggccccgggctgcaggcgaaggccacgcgggaggcccagaagcgcaccgccgccggcatcatgaagaacccgaccgtggacgggatcgtggcgatcgacctggaccccgtcgtgtacgacgccaagttcgagaagcagctcggccagatcatgctgctgatcctctgcacctcccagatcctgctgatgcgcacgacctgggccctctgcgagagcatcaccctggccaccggccccctgacgaccctctgggaggggtcccccggcaagttctggaacaccaccatcgccgtgagcatggcgaacatcttccgggggagctacctggccggcgccggcctggccttctccctcatgaagtccctcgggggcgggcgccgggggacgggggcgcagggcgagaccctgggcgagaagtggaagcgccagctcaaccagctgtccaagagcgagttcaacacctacaagcggtccgggatcatggaggtcgaccgcagcgaggccaaggagggcctgaagcgcggggagaccacgaagcacgccgtgtcccgcggcaccgccaagctccggtggttcgtggagcgcaacctggtcaagccggaggggaaggtgatcgacctgggctgcggccgcggcgggtggagctactactgcgccgggctgaagaaggtgaccgaggtcaaggggtacaccaagggcgggcccggccacgaggagcccatccccatggcgacgtacgggtggaacctcgtgaagctgcactccggcaaggacgtgttcttcatcccgcccgagaagtgcgacaccctgctctgcgacatcggggagagctcccccaaccccaccatcgaggagggccgcaccctgcgggtcctgaagatggtggagccgtggctccgcgggaaccagttctgcatcaagatcctgaacccctacatgcccagcgtggtcgagacgctggagcagatgcagcggaagcacggcggcatgctcgtgcgcaaccccctgtcccggaacagcacccacgagatgtactgggtgtcctgcgggaccggcaacatcgtcagcgccgtgaacatgacctcccgcatgctgctcaaccggttcaccatggcccaccgcaagccgacgtacgagcgcgacgtggacctgggggccggcacccggcacgtcgccgtggagcccgaggtggcgaacctggacatcatcggccagcgcatcgagaacatcaagcacgagcacaagagcacctggcactacgacgaggacaacccctacaagacctgggcctaccacgggtcctacgaggtcaagcccagcggcagcgcctccagcatggtgaacggggtcgtgaagctcctgacgaagccgtgggacgtgatccccatggtcacccagatcgccatgaccgacaccacgcccttcggccagcagcgggtgttcaaggagaaggtggacacccgcacccccaaggccaagcgggggaccgcgcagatcatggaggtcacggccaagtggctgtggggcttcctctcccgcaacaagaagccgcggatctgcacccgcgaggagttcacccggaaggtgcgcagcaacgccgccatcggcgcggtgttcgtcgacgagaaccagtggaactccgccaaggaggccgtggaggacgagcggttctgggacctggtgcaccgcgagcgggagctgcacaagcaggggaagtgcgcgacctgcgtctacaacatgatgggcaagcgcgagaagaagctcggggagttcggcaaggccaaggggagccgggcgatctggtacatgtggctgggcgcccgcttcctggagttcgaggccctcggcttcatgaacgaggaccactggttctcccgggagaacagcctgtccggggtggagggcgaggggctgcacaagctcggctacatcctgcgcgacatcagcaagatccccgggggcaacatgtacgccgacgacacggccggctgggacacccggatcaccgaggacgacctgcagaacgaggcgaagatcaccgacatcatggagcccgagcacgccctcctggccaagtccatcttcaagctgacgtaccagaacaaggtggtccgcgtgcagcggccggccaagaacgggaccgtgatggacgtcatcagccgccgcgaccagcggggctccggccaggtgggcacctacggcctcaacaccttcacgaacatggaggcccagctgatccgccagatggagagcgaggggatcttctcccccagcgagctggagacccccaacctcgcgggccgggtgctggactggctggagaagcacggggtcgagcgcctcaagcggatggccatctccggcgacgactgcgtggtgaagcccatcgacgaccgcttcgccaccgccctgaccgccctgaacgacatggggaaggtccggaaggacatcccgcagtgggagcccagcaagggctggaacgactggcagcaggtccccttctgcagccaccacttccaccagctcatcatgaaggacggccgcgagatcgtggtcccctgccggaaccaggacgagctggtggggcgcgcgcgggtgtcccagggcgccgggtggagcctgcgcgagacggcctgcctcggcaagtcctacgcccagatgtggcagctgatgtacttccaccggcgcgacctgcggctcgcggccaacgccatctgcagcgccgtcccggtggactgggtgcccacctcccgcaccacctggagcatccacgcccaccaccagtggatgacgaccgaggacatgctgtccgtctggaaccgggtgtggatcgaggagaacccctggatggaggacaagacccacatcagctcctggggcgacgtgccctacctgggcaagcgcgaggaccagtggtgcggcagcctcatcgggctgaccgcgcgggccacgtgggccaccaacatccaggtcgccatcaaccaggtgcgccgcctgatcggcaacgagaactacctcgactacatgacctccatgaagcggttcaagaacgagagcgacccggagggggccctgtggtga

SEQ ID NO: 8454 - RNA, 9879 nt, synthetic construct
  misc_feature 1..9879: note = derived and/or modified CDS sequence (opt1) from DENV-1__FJ882529__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagaccagcgccggggtgaacatgtgcaccctcatcgccatggacctgggcgagttctgcgaggacaccatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtcgagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggaccagcggggcctccaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctcgtccagatcaagtacgagggcaccgacgccccctgcaagatccccttctccacccaggacgagaagggggtgacccagaacggccggctgatcacggccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacaccgcctgggacttcgggagcatcggcggcgtgttcacgtccgtcgggaagctggtgcaccagatcttcggcaccgcctacggggtgctgttcagcggcgtctcctggaccatgaagatcgggatcggcgtgctcctgacctggctgggcctcaacagccgctccacgagcctgtccatgacctgcatcgccgtggggctggtcaccctctacctgggcgtgatggtgcaggccgacagcgggtgcgtcatcaactggaagggccgggagctgaagtgcgggagcggcatcttcgtgaccaacgaggtgcacacgtggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacgtgaagttcaccgtggtcgtgggggacgtggcgggcatcctggcccaggggaagaagatgatccggccccagcccatggagtacaagtactcctggaagtcctggggcaaggccaagatcatcggcgccgacgtccagaacaccacgttcatcatcgacgggcccaacaccccggagtgccccgacgaccagcgcgcgtggaacatctgggaggtggaggactacggcttcgggatcttcaccaccaacatctggctcaagctgcgggactcctacacccaggtgtgcgaccaccgcctgatgagcgccgccatcaaggactccaaggccgtccacgccgacatgggctactggatcgagagcgagaagaacgagacctggaagctcgcgcgggcctccttcatcgaggtgaagacctgcatctggcccaagagccacaccctgtggtccaacggcgtgctggagagcgagatgatcatccccaagatctacgggggcccgatctcccagcacaactaccgccccgggtacttcacgcagaccgccggcccctggcacctcgggaagctggagctggacttcgacctctgcgagggcaccaccgtcgtggtggacgagcactgcggcaaccgggggccgagcctgcgcacgaccaccgtcaccggcaagatcatccacgagtggtgctgccggtcctgcacgctgccgcccctgcgcttcaagggggaggacggctgctggtacgggatggagatccggcccgtgaaggagaaggaggagaacctggtcaagagcatggtcagcgccggctccggcgaggtggacagcttctccctggggctcctgtgcatcagcatcatgatcgaggaggtgatgcgctcccggtggagccgcaagatgctgatgaccggcaccctcgccgtcttcttcctgctgatcatggggcagctcacctggaacgacctgatccggctgtgcatcatggtgggcgcgaacgcctccgaccgcatggggatgggcacgacctacctcgccctgatggccaccttcaagatgcgcccgatgttcgccgtgggcctcctgttccggcgcctgaccagccgggaggtcctgctcctgacgatcgggctgtccctcgtggcgagcgtcgagctgcccaactccctggaggagctcggcgacgggctggccatgggcatcatgatcctgaagctcctgaccgacttccagagccaccagctgtgggccaccctcctgtccctgaccttcatcaagacgaccttcagcctccactacgcctggaagaccatggcgatggtgctgtccatcgtgagcctgttccccctctgcctgtccaccacgagccagaagaccacctggctgcccgtcctcctgggctccctggggtgcaagccgctcaccatgttcctgatcgccgagaacaagatctggggccgcaagagctggcccctgaacgaggggatcatggccgtgggcatcgtgagcatcctcctgtccagcctgctcaagaacgacgtccccctggccgggcccctgatcgccggcggcatgctcatcgcgtgctacgtgatctccgggagctccgccgacctgagcctggagaaggccgccgaggtgtcctgggaggaggaggccgagcacagcggcgcgtcccacaacatcctcgtcgaggtgcaggacgacgggacgatgaagatcaaggacgaggagcgggacgacaccctgaccatcctgctcaaggccaccctgctggccgtgagcggcgtctacccgctctccatccccgccaccctgttcgtgtggtacttctggcagaagaagaagcagcgcagcggggtgctgtgggacacgcccagcccgcccgaggtcgagcgggccgtgctcgacgacggcatctaccgcatcatgcagcggggcctgctggggcgcagccaggtgggcgtcggggtgttccaggagaacgtgttccacaccatgtggcacgtcacccggggcgcggtgctgatgtaccaggggaagcgcctcgagccctcctgggccagcgtgaagaaggacctgatctcctacggcggcgggtggcggctgcagggcagctggaacaccggggaggaggtccaggtgatcgccgtggagcccggcaagaaccccaagaacgtccagacggcccccgggaccttcaagacctccgagggcgaggtgggcgccatcgcgctcgacttcaagcccgggaccagcggcagccccatcgtgaaccgcgaggggaagatcgtcggcctgtacggcaacggggtggtgacgacctccggcacctacgtcagcgccatcgcccaggccaaggcgtcccaggaggggcccctgccggagatcgaggacgaggtgttccggaagcgcaacctcaccatcatggacctgcaccccggcagcgggaagacgcggcgctacctgcccgccatcgtgcgggaggccatcaagcgcaagctccggaccctgatcctggccccgacccgcgtcgtggcctccgagatggcggaggccctcaagggcatgcccatccgctaccagaccacggccgtcaagagcgagcacaccggcaaggagatcgtcgacctgatgtgccacgccaccttcaccatgcggctgctctcccccgtgcgcgtgcccaactacaacatgatcatcatggacgaggcccacttcacggacccgagctccatcgcggcccgggggtacatcagcacccgcgtcggcatgggggaggccgccgccatcttcatgaccgcgacgccgcccggctccgtggaggccttcccccagagcaacgccgtgatccaggacgaggagcgggacatcccggagcgctcctggaacagcgggtacgagtggatcacggacttccccggcaagaccgtctggttcgtgccctccatcaagagcggcaacgacatcgccaactgcctgcggaagaacgggaagcgcgtgatccagctgtcccggaagaccttcgacaccgagtaccagaagacgaagaacaacgactgggactacgtcgtgaccaccgacatcagcgagatgggcgcgaacttccgcgccgaccgggtgatcgacccccgccggtgcctcaagccggtcatcctgaaggacgggcccgagcgcgtgatcctggccggccccatgcccgtcaccgtggcctccgccgcgcagcggcgcgggcggatcggccgcaaccacaacaaggagggcgaccagtacatctacatggggcagccgctcaacaacgacgaggaccacgcccactggacggaggccaagatgctgctggacaacatcaacacccccgagggcatcatccccgccctcttcgagcccgagcgggagaagtccgccgcgatcgacggggagtaccgcctgcgcggcgaggcccggaagaccttcgtggagctgatgcgccgcggggacctcccggtctggctgagctacaaggtggcctccgagggcttccagtacagcgaccgccggtggtgcttcgacggcgagcgcaacaaccaggtgctggaggagaacatggacgtcgagatctggaccaaggagggggagcggaagaagctccgcccccggtggctggacgcccgcacgtactccgaccccctggccctccgggagttcaaggagttcgcggccggccgccggagcgtgtccggggacctgatcctggagatcggcaagctcccccagcacctgacccagcgcgcccagaacgccctggacaacctcgtgatgctgcacaacagcgagcagggcgggcgggcgtaccgccacgccatggaggagctgccggacaccatcgagaccctcatgctgctggccctcatcgccgtcctgacgggcggggtgaccctgttcttcctctccggccgggggctgggcaagaccagcatcggcctgctctgcgtgatggcctccagcgtcctgctgtggatggcgtccgtggagccccactggatcgccgccagcatcatcctcgagttcttcctgatggtgctgctcatccccgagcccgaccgccagcggaccccgcaggacaaccagctggcctacgtcgtgatcgggctcctcttcatgatcctgaccgtggccgcgaacgagatgggcctgctcgagacgaccaagaaggacctggggatcggccacgtcgccgtggagaaccaccaccacgccgccatgctggacgtggacctccaccccgcctccgcgtggaccctgtacgccgtcgccaccacgatcatcacccccatgatgcgccacaccatcgagaacaccacggccaacatcagcctgaccgccatcgcgaaccaggccgccatcctcatggggctggacaagggctggccgatctccaagatggacatcggcgtgcccctgctcgccctggggtgctacagccaggtgaaccccctgaccctcaccgcggccgtcctgatgctggtggcccactacgccatcatcggccccgggctccaggccaaggcgacgcgggaggcccagaagcgcaccgccgccggcatcatgaagaacccgaccgtggacgggatcgtcgccatcgacctggaccccgtggtgtacgacgcgaagttcgagaagcagctgggccagatcatgctcctgatcctgtgcacctcccagatcctcctgatgcgcacgacctgggccctgtgcgagagcatcaccctcgccaccggccccctgacgaccctgtgggaggggtcccccggcaagttctggaacaccaccatcgccgtcagcatggccaacatcttccgggggagctacctcgcgggcgccggcctggccttctccctgatgaagtccctcgggggcgggcgccggggcacgggggcccagggcgagaccctgggcgagaagtggaagcgccagctgaaccagctctccaagagcgagttcaacacctacaagcggtccgggatcatggaggtggaccgcagcgaggcgaaggagggcctgaagcgcggggagaccacgaagcacgccgtgtcccgcggcaccgccaagctgcggtggttcgtcgagcgcaacctcgtgaagccggaggggaaggtgatcgacctgggctgcggccgcggcgggtggagctactactgcgccgggctgaagaaggtcaccgaggtgaaggggtacaccaagggcgggcccggccacgaggagcccatccccatggccacgtacgggtggaacctggtgaagctccactccggcaaggacgtcttcttcatcccgcccgagaagtgcgacaccctgctgtgcgacatcggggagagctcccccaaccccaccatcgaggagggccgcaccctccgggtgctgaagatggtggagccgtggctgcgcgggaaccagttctgcatcaagatcctcaacccctacatgcccagcgtcgtggagacgctggagcagatgcagcggaagcacggcggcatgctggtgcgcaaccccctctcccggaacagcacccacgagatgtactgggtctcctgcgggaccggcaacatcgtgagcgcggtgaacatgacctcccgcatgctgctgaaccggttcaccatggtccaccgcaagccgacgtacgagcgcgacgtggacctcggggccggcacccggcacgtggccgtcgagcccgaggtggccaacctggacatcatcggccagcgcatcgagaacatcaagcacgagcacaagagcacctggcactacgacgaggacaacccctacaagacctgggcctaccacgggtcctacgaggtcaagcccagcggcagcgcgtccagcatggtgaacggggtggtcaagctgctcacgaagccgtgggacgtgatccccatggtgacccagatcgccatgaccgacaccacgcccttcggccagcagcgggtcttcaaggagaaggtggacacccgcacccccaaggccaagcgggggaccgcccagatcatggaggtgacggccaagtggctgtggggcttcctgtcccgcaacaagaagccgcggatctgcacccgcgaggagttcacccggaaggtccgcagcaacgcggccatcggcgccgtgttcgtggacgagaaccagtggaactccgccaaggaggcggtcgaggacgagcggttctgggacctcgtgcaccgcgagcgggagctgcacaagcaggggaagtgcgcgacctgcgtgtacaacatgatgggcaagcgcgagaagaagctgggggagttcggcaaggccaaggggagccgggccatctggtacatgtggctcggcgcccgcttcctggagttcgaggcgctgggcttcatgaacgaggaccactggttctcccgggagaacagcctctccggggtcgagggcgaggggctgcacaagctgggctacatcctccgcgacatcagcaagatccccgggggcaacatgtacgccgacgacacggccggctgggacacccggatcaccgaggacgacctgcagaacgaggccaagatcaccgacatcatggagcccgagcacgccctgctcgcgaagtccatcttcaagctgacgtaccagaacaaggtggtgcgcgtccagcggccggccaagaacgggaccgtgatggacgtgatcagccgccgcgaccagcggggctccgggcaggtcggcacctacggcctgaacaccttcacgaacatggaggcccagctcatccgccagatggagagcgaggggatcttctcccccagcgagctggagacccccaacctggccggccgggtgctcgactggctggagaagcacggggtggagcgcctgaagcggatggccatctccggcgacgactgcgtcgtgaagcccatcgacgaccgcttcgcgaccgccctcaccgccctgaacgacatggggaaggtgcggaaggacatcccgcagtgggagcccagcaagggctggaacgactggcagcaggtccccttctgcagccaccacttccaccagctgatcatgaaggacggccgcgagatcgtggtgccctgccggaaccaggacgagctcgtcgggcgcgcccgggtgtcccagggcgccgggtggagcctgcgcgagacggcgtgcctgggcaagtcctacgcccagatgtggcagctcatgtacttccaccggcgcgacctgcggctggccgccaacgcgatctgcagcgccgtgccggtcgactgggtgcccacctcccgcaccacctggagcatccacgcccaccaccagtggatgacgaccgaggacatgctctccgtgtggaaccgggtctggatcgaggagaacccctggatggaggacaagacccacatcagctcctggggcgacgtgccctacctgggcaagcgcgaggaccagtggtgcggcagcctgatcgggctcaccgcccgggccacgtgggcgaccaacatccaggtggccatcaaccaggtccgccgcctgatcggcaacgagaactacctggactacatgacctccatgaagcggttcaagaacgagagcgacccggagggggccctctggtga

SEQ ID NO: 8455 - RNA, 9879 nt, synthetic construct
  misc_feature 1..9879: note = derived and/or modified CDS sequence (opt1) from DENV-1__FJ882530__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagaccagcgcgggggtgaacatgtgcaccctcatcgccatggacctgggcgagttctgcgaggacacgatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagaccgtccagtacgagaacctgaagtacagcgtgatcgtgaccgtccacacgggcgaccagcaccaggtggggaacgagtccaccgagcacggcaccaccgcgaccatcacgccccaggcccccagcaccgagatccagctgaccgactacggggccctcaccctggactgcagcccccggacgggcctggacttcaacgagatggtcctcctgaccatgaaggagaagtcctggctggtgcacaagcagtggttcctcgacctgccgctgccctggaccagcggggcctccaccagccaggagacgtggaaccggaaggacctcctggtgaccttcaagaccgcccacgcgaagaagcaggaggtcgtggtgctgggctcccaggagggcgccatgcacaccgccctcacgggggccaccgagatccagaccagcggcaccacgaccatcttcgccgggcacctgaagtgccgcctgaagatggacaagctcaccctgaagggcatgtcctacgtcatgtgcaccgggagcttcaagctggagaaggaggtggcggagacgcagcacggcaccgtgctcgtccagatcaagtacgagggcaccgacgccccctgcaagatccccttctccacccaggacgagaagggggtgacgcagaacggccggctgatcaccgccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacacggcctgggacttcgggagcatcggcggcgtgttcacctccgtcgggaagctggtgcaccagatcttcggcaccgcctacggggtgctgttcagcggcgtctcctggaccatgaagatcgggatcggcgtgctcctgacgtggctgggcctcaacagccgctccaccagcctgtccatgacctgcatcgccgtggggctggtcaccctctacctgggcgtgatggtgcaggccgacagcgggtgcgtcatcaactggaagggccgggagctgaagtgcgggagcggcatcttcgtgacgaacgaggtgcacacctggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagttcaccgtggtggtcggggacgtggcgggcatcctggcccaggggaagaagatgatccggccccagcccatggagtacaagtactcctggaagtcctggggcaaggccaagatcatcggcgccgacgtgcagaacacgaccttcatcatcgacgggcccaacaccccggagtgccccgacgaccagcgcgcgtggaacatctgggaggtcgaggactacggcttcgggatcttcaccacgaacatctggctcaagctgcgggactcccacacccaggtgtgcgaccaccgcctgatgagcgccgccatcaaggactccaaggccgtgcacgccgacatgggctactggatcgagagcgagaagaacgagacctggaagctcgcgcgggcctccttcatcgaggtcaagacctgcatctggcccaagagccacacgctgtggtccaacggcgtgctggagagcgagatgatcatccccaagatctacgggggcccgatctcccagcacaactaccgccccgggtacttcacccagaccgccggcccctggcacctcgggaagctggagctggacttcgacctctgcgagggcaccacggtggtcgtggacgagcactgcggcaaccgggggccgagcctgcgcaccaccaccgtgacgggcaagatcatccacgagtggtgctgccggtcctgcaccctgccgcccctgcgcttcaagggggaggacggctgctggtacgggatggagatccggcccgtcaaggagaaggaggagaacctggtcaagagcatggtgagcgccggctccggcgaggtcgacagcttctccctggggctcctgtgcatcagcatcatgatcgaggaggtgatgcgctcccggtggagccgcaagatgctgatgaccggcaccctcgccgtgttcttcctgctgatcatggggcagctcacgtggaacgacctgatccggctgtgcatcatggtcggcgcgaacgcctccgaccgcatggggatgggcaccacctacctcgccctgatggccaccttcaagatgcgcccgatgttcgccgtggggctcctgttccggcgcctgacgagccgggaggtgctgctcctgaccatcgggctgtccctcgtcgcgagcgtggagctgcccaactccctggaggagctcggcgacgggctggccatgggcatcatgatcctgaagctcctgaccgacttccagagccaccagctgtgggccaccctcctgtccctgacgttcatcaagaccaccttcagcctccactacgcctggaagaccatggcgatggtcctgtccatcgtgagcctgttccccctctgcctgtccacgaccagccagaagaccacctggctgcccgtgctcctgggctccctggggtgcaagccgctcacgatgttcctgatcgccgagaacaagatctggggccgcaagagctggcccctgaacgaggggatcatggccgtcggcatcgtgagcatcctcctgtccagcctgctcaagaacgacgtgcccctggccgggcccctgatcgccggcggcatgctcatcgcgtgctacgtcatctccgggagctccgccgacctgagcctggagaaggccgccgaggtgtcctgggaggaggaggccgagcacagcggcgcgtcccacaacatcctcgtggaggtccaggacgacgggaccatgaagatcaaggacgaggagcgggacgacaccctgaccatcctgctcaaggccaccctgctggccgtgagcggcgtgtacccgctctccatccccgccacgctgttcgtctggtacttctggcagaagaagaagcagcgcagcggggtgctgtgggacacccccagcccgcccgaggtggagcgggccgtcctcgacgacggcatctaccgcatcatgcagcggggcctgctggggcgcagccaggtgggcgtgggggtcttccaggagaacgtgttccacaccatgtggcacgtgacccggggcgcggtcctgatgtaccaggggaagcgcctcgagccctcctgggccagcgtgaagaaggacctgatctcctacggcggcgggtggcggctgcagggcagctggaacacgggggaggaggtgcaggtcatcgccgtggagcccggcaagaaccccaagaacgtgcagaccgcccccgggaccttcaagacctccgagggcgaggtcggcgccatcgcgctcgacttcaagcccgggacgagcggcagccccatcgtgaaccgcgaggggaagatcgtgggcctgtacggcaacggggtcgtgaccacctccggcacctacgtgagcgccatcgcccaggccaaggcgtcccaggaggggcccctgccggagatcgaggacgaggtcttccggaagcgcaacctcacgatcatggacctgcaccccggcagcgggaagacccggcgctacctgcccgccatcgtgcgggaggccatcaagcgcaagctccggaccctgatcctggccccgacccgcgtggtcgcctccgagatggcggaggccctcaagggcatgcccatccgctaccagacgaccgccgtcaagagcgagcacaccggcaaggagatcgtggacctgatgtgccacgccaccttcacgatgcggctgctctcccccgtccgcgtgcccaactacaacatgatcatcatggacgaggcccacttcaccgacccgagctccatcgcggcccgggggtacatcagcacccgcgtgggcatgggggaggccgccgccatcttcatgaccgcgacgccgcccggctccgtcgaggccttcccccagagcaacgccgtgatccaggacgaggagcgggacatcccggagcgctcctggaacagcgggtacgagtggatcaccgacttccccggcaagaccgtgtggttcgtcccctccatcaagagcggcaacgacatcgccaactgcctgcggaagaacgggaagcgcgtgatccagctgtcccggaagaccttcgacacggagtaccagaagaccaagaacaacgactgggactacgtggtcaccaccgacatcagcgagatgggcgcgaacttccgcgccgaccgggtgatcgacccccgccggtgcctcaagccggtgatcctgaaggacgggcccgagcgcgtcatcctggccggccccatgcccgtgacggtcgcctccgccgcgcagcggcgcgggcggatcggccgcaaccacaacaaggagggcgaccagtacatctacatggggcagccgctcaacaacgacgaggaccacgcccactggaccgaggccaagatgctgctggacaacatcaacacccccgagggcatcatccccgccctcttcgagcccgagcgggagaagtccgccgcgatcgacggggagtaccgcctgcgcggcgaggcccggaagaccttcgtggagctgatgcgccgcggggacctcccggtgtggctgagctacaaggtcgcctccgagggcttccagtacagcgaccgccggtggtgcttcgacggcgagcgcaacaaccaggtgctggaggagaacatggacgtggagatctggacgaaggagggggagcggaagaagctccgcccccggtggctggacgcccgcacctactccgaccccctggccctccgggagttcaaggagttcgcggccggccgccggagcgtctccggggacctgatcctggagatcggcaagctcccccagcacctgacccagcgcgcccagaacgccctggacaacctcgtgatgctgcacaacagcgagcagggcgggcgggcgtaccgccacgccatggaggagctgccggacaccatcgagacgctcatgctgctggccctcatcgccgtgctgaccggcggggtcaccctgttcttcctctccggccgggggctgggcaagaccagcatcggcctgctctgcgtgatggcctccagcgtgctgctgtggatggcgtccgtcgagccccactggatcgccgccagcatcatcctcgagttcttcctgatggtgctgctcatccccgagcccgaccgccagcggaccccgcaggacaaccagctggcctacgtggtcatcgggctcctcttcatgatcctgacggtggccgcgaacgagatgggcctgctcgagaccaccaagaaggacctggggatcggccacgtggccgtcgagaaccaccaccacgccgccatgctggacgtggacctccaccccgcctccgcgtggaccctgtacgccgtggccacgaccatcatcacccccatgatgcgccacaccatcgagaacacgaccgccaacatcagcctgaccgccatcgcgaaccaggccgccatcctcatggggctggacaagggctggccgatctccaagatggacatcggcgtccccctgctcgccctggggtgctacagccaggtgaaccccctgaccctcacggcggccgtgctgatgctggtcgcccactacgccatcatcggccccgggctccaggccaaggcgacccgggaggcccagaagcgcaccgccgccggcatcatgaagaacccgaccgtggacgggatcgtggccatcgacctggaccccgtcgtgtacgacgcgaagttcgagaagcagctgggccagatcatgctcctgatcctgtgcacgtcccagatcctcctgatgcgcaccacctgggccctgtgcgagagcatcaccctcgccacgggccccctgaccaccctgtgggaggggtcccccggcaagttctggaacaccacgatcgccgtgagcatggccaacatcttccgggggagctacctcgcgggcgccggcctggccttctccctgatgaagtccctcgggggcgggcgccggggcaccggggcccagggcgagaccctgggcgagaagtggaagcgccagctgaaccagctctccaagagcgagttcaacacctacaagcggtccgggatcatggaggtcgaccgcagcgaggcgaaggagggcctgaagcgcggggagacgaccaagcacgccgtgtcccgcggcaccgccaagctgcggtggttcgtggagcgcaacctcgtcaagccggaggggaaggtgatcgacctgggctgcggccgcggcgggtggagctactactgcgccgggctgaagaaggtgaccgaggtcaaggggtacacgaagggcgggcccggccacgaggagcccatccccatggccacctacgggtggaacctggtgaagctccactccggcaaggacgtgttcttcatcccgcccgagaagtgcgacaccctgctgtgcgacatcggggagagctcccccaaccccaccatcgaggagggccgcacgctccgggtcctgaagatggtggagccgtggctgcgcgggaaccagttctgcatcaagatcctcaacccctacatgcccagcgtggtcgagaccctggagcagatgcagcggaagcacggcggcatgctggtgcgcaaccccctctcccggaacagcacccacgagatgtactgggtgtcctgcgggaccggcaacatcgtcagcgcggtgaacatgacctcccgcatgctgctgaaccggttcacgatggcccaccgcaagccgacctacgagcgcgacgtggacctcggggccggcacccggcacgtcgccgtggagcccgaggtggccaacctggacatcatcggccagcgcatcgagaacatcaagcacgagcacaagagcacctggcactacgacgaggacaacccctacaagacgtgggcgtaccacgggtcctacgaggtcaagcccagcggcagcgcctccagcatggtgaacggggtcgtgaagctgctcaccaagccgtgggacgtgatccccatggtcacccagatcgccatgaccgacacgacccccttcggccagcagcgggtgttcaaggagaaggtggacacccgcacccccaaggccaagcgggggacggcccagatcatggaggtcaccgcgaagtggctgtggggcttcctgtcccgcaacaagaagccgcggatctgcacccgcgaggagttcacccggaaggtgcgcagcaacgccgccatcggcgccgtgttcgtcgacgagaaccagtggaactccgcgaaggaggccgtggaggacgagcggttctgggacctcgtgcaccgcgagcgggagctgcacaagcaggggaagtgcgccacgtgcgtctacaacatgatgggcaagcgcgagaagaagctgggggagttcggcaaggccaaggggagccgggccatctggtacatgtggctcggcgcgcgcttcctggagttcgaggccctgggcttcatgaacgaggaccactggttctcccgggagaacagcctctccggggtggagggcgaggggctgcacaagctgggctacatcctccgcgacatcagcaagatccccgggggcaacatgtacgccgacgacaccgccggctgggacacccggatcaccgaggacgacctgcagaacgaggccaagatcacggacatcatggagcccgagcacgcgctgctcgccaagtccatcttcaagctgacctaccagaacaaggtggtccgcgtgcagcggccggccaagaacgggaccgtgatggacgtcatcagccgccgcgaccagcggggctccggccaggtgggcacctacggcctgaacacgttcaccaacatggaggcccagctcatccgccagatggagagcgaggggatcttctcccccagcgagctggagacccccaacctggccggccgggtgctcgactggctggagaagcacggggtcgagcgcctgaagcggatggcgatctccggcgacgactgcgtggtgaagcccatcgacgaccgcttcgccaccgccctcacggccctgaacgacatggggaaggtccggaaggacatcccgcagtgggagcccagcaagggctggaacgactggcagcaggtccccttctgcagccaccacttccaccagctgatcatgaaggacggccgcgagatcgtggtcccctgccggaaccaggacgagctcgtggggcgcgcccgggtgtcccagggcgcggggtggagcctgcgcgagaccgcctgcctgggcaagtcctacgcccagatgtggcagctcatgtacttccaccggcgcgacctgcggctggccgcgaacgccatctgcagcgccgtcccggtggactgggtgcccacctcccgcaccacgtggagcatccacgcccaccaccagtggatgaccaccgaggacatgctctccgtctggaaccgggtgtggatcgaggagaacccctggatggaggacaagacccacatcagctcctggggcgacgtgccctacctgggcaagcgcgaggaccagtggtgcggcagcctgatcgggctcacggcccgggcgacctgggccaccaacatccaggtcgccatcaaccaggtgcgccgcctgatcggcaacgagaactacctggactacatgacctccatgaagcggttcaagaacgagagcgacccggagggggccctctggtga

SEQ ID NO: 8456 - RNA, 9879 nt, synthetic construct
  misc_feature 1..9879: note = derived and/or modified CDS sequence (opt1) from DENV-1__GQ868605__SS-prME
  source 1..9879: mol_type = other RNA
agcgtgaccatgctgctgatgctgatgcccaccgccctggccttccacctcaccacccggggcggggagccccacatgatcgtgaccaagcaggagcggggcaagagcctgctgttcaagaccagcgtgggggtgaacatgtgcaccctcatcgccatggacctgggcgagctgtgcgaggacaccatgacctacaagtgcccccgcatcaccgaggccgagcccgacgacgtcgactgctggtgcaacgccacggacacctgggtgacctacgggacctgctcccagacgggcgagcaccggcgggacaagcggagcgtggccctcgcgccccacgtcggcctggggctggagacccgcaccgagacctggatgtccagcgagggcgcgtggaagcagatccagcgggtggagacgtgggccctccgccaccccgggttcaccgtgatcgccctgttcctggcccacgcgatcggcacctccatcacccagaaggggatcatcttcatcctcctgatgctggtcacgcccagcatggccatgcggtgcgtgggcatcggctcccgcgacttcgtggaggggctcagcggcgccacctgggtcgacgtggtgctggagcacgggtcctgcgtcaccaccatggccaaggacaagcccacgctggacatcgagctcctgaagaccgaggtgaccaaccccgccgtgctgcggaagctctgcatcgaggcgaagatcagcaacaccacgaccgactcccgctgcccgacccagggcgaggccaccctgatggaggagcaggacgccaacttcgtctgccggcgcacgttcgtggaccggggctgggggaacggctgcgggctgttcggcaaggggagcctcatcacgtgcgccaagttcaagtgcgtgaccaagctggagggcaagatcgtccagtacgagaacctgaagtactccgtgatcgtgaccgtccacacgggcgaccagcaccaggtggggaacgagagcaccgagcacggcaccaccgccaccatcacgccccaggcgcccacctccgagatccagctcaccgactacggggccctgaccctggactgcagcccccgcacgggcctcgacttcaacgagatggtcctgctgaccatgaaggagaagtcctggctcgtgcacaagcagtggttcctggacctgccgctcccctggaccagcggggccagcacctcccaggagacgtggaaccggcaggacctgctggtgaccttcaagaccgcccacgccaagaagcaggaggtcgtggtgctcggcagccaggagggcgcgatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggccgagacgcagcacggcaccgtgctggtccagatcaagtacgagggcaccgacgcgccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgtgggcgagaaggccctgaagctcagctggttcaagaaggggtccagcatcggcaagatgttcgaggcgaccgcccgcggggcccggcgcatggccatcctgggcgacacggcctgggacttcgggtccatcggcggcgtcttcaccagcgtggggaagctggtgcaccagatcttcggcaccgcgtacggggtcctcttctccggcgtgagctggaccatgaagatcgggatcggcgtgctgctgacgtggctcggcctgaactcccgcagcacctccctgagcatgacctgcatcgccgtcgggctcgtgaccctgtacctgggcgtgatggtccaggccgactccgggtgcgtgatcaactggaagggccgggagctcaagtgcgggagcggcatcttcgtgacgaacgaggtccacacctggaccgagcagtacaagttccaggccgacagcccgaagcgcctgtccgccgcgatcggcaaggcctgggaggagggggtgtgcggcatccggagcgccacccgcctggagaacatcatgtggaagcagatctccaacgagctcaaccacatcctgctggagaacgacatgaagttcaccgtggtcgtgggggacgtggtcggcatcctcgcccaggggaagaagatgatccggccccagcccatggagcacaagtacagctggaagtcctggggcaaggccaagatcatcggcgcggacgtgcagaacacgaccttcatcatcgacgggcccaacaccccggagtgccccgacgaccagcgcgcctggaacatctgggaggtggaggactacggcttcgggatcttcaccacgaacatctggctgaagctgcgggacagctacacccaggtctgcgaccaccgcctcatgtccgccgccatcaaggacagcaaggcggtgcacgccgacatgggctactggatcgagtccgagaagaacgacacctggaagctggcccgggccagcttcatcgaggtgaagacctgcatctggcccaagtcccacacgctgtggagcaacggcgtcctcgagtccgagatgatcatccccaagatctacgggggcccgatcagccagcacaactaccgccccgggtacttcacccagaccgccggcccctggcacctggggaagctggagctcgacttcgacctgtgcgagggcaccacggtggtggtcgacgagcactgcggcaaccgggggccgtccctgcgcaccaccaccgtgacgggcaagatcatccacgagtggtgctgccggagctgcaccctgccgcccctccgcttcaagggggaggacggctgctggtacgggatggagatccggcccgtgaaggagaaggaggagaacctggtcaagtccatggtgagcgcgggcagcggcgaggtggactccttcagcctcgggctgctgtccatcagcatcatgatcgaggaggtcatgcgctcccggtggagccgcaagatgctcatgaccggcaccctggccgtgttcctgctcctgatcgtggggcagctgacgtggaacgacctcatccggctgtgcatcatggtcggcgccaacgcctccgaccgcatggggatgggcaccacctacctggccctcatggcgaccttcaagatgcgcccgatgttcgccgtgggcctgctgttccggcgcctcacgagccgggaggtcctgctgctcaccatcgggctgtccctggtggccagcgtggagctccccaactccctggaggagctgggcgacgggctcgccatgggcatcatgatcctgaagctgctcaccgacttccagagccaccagctgtgggccaccctgctctccctgacgttcatcaagaccgcgctgagcctccactacgcctggaagaccatggccatggtcctgtccatcgtgagcctgttccccctctgcctgtccaccacgagccagaagaccacctggctgcccgtgctcctgggctccctggggtgcaagccgctcaccatgttcctgatcgccgagaacaagatctggggccgcaagagctggcccctgaacgaggggatcatggcggtcggcgtggtgagcatcctcctgtccagcctgctcaagaacgacgtccccctggccgggcccctgatcgccggcggcatgctcatcgcctgctacgtgatctccgggagctccgccgacctgagcctggagaaggcggccgaggtgtcctgggaggaggaggccgagcacagcggcgcctcccacaacatcctcgtcgaggtgcaggacgacgggacgatgaagatcaaggacgaggagcgggacgacaccctgaccatcctgctcaaggccaccctgctggcggtgagcggcgtctacccgctctccatccccgccaccctgttcgtgtggtacttctggcagaagaagaagcagcgcagcggggtgctgtgggacacgcccagcccgcccgaggtcgagcgggccgtgctggacgacggcatctaccgcatcatgcagcggggcctcctggggcgcagccaggtgggcgtcggggtgttccaggagaacgtgttccacaccatgtggcacgtcacccggggcgccgtgctgatgtaccaggggaagcgcctcgagccctcctgggccagcgtgaagaaggacctgatctcctacggcggcgggtggcggctgcagggcagctggaacaccggggaggaggtccaggtgatcgcggtggagcccggcaagaaccccaagaacgtccagacggcccccgggaccttcaagacccccgagggcgaggtgggcgccatcgccctcgacttcaagcccgggacctccggcagccccatcgtgaaccgcgaggggaagatcgtcggcctgtacggcaacggggtggtgacgaccagcggcacctacgtctccgccatcgcgcaggccaaggccagccaggaggggccgctgcccgagatcgaggacgaggtgttccggaagcgcaacctcaccatcatggacctgcaccccggctccgggaagacgcggcgctacctgccggccatcgtgcgggaggcgatcaagcgcaagctccggaccctgatcctggcccccacccgcgtcgtggccagcgagatggccgaggccctcaagggcatgcccatccgctaccagaccacggcggtgaagtccgagcacaccggcaaggagatcgtcgacctgatgtgccacgccaccttcaccatgcggctgctcagccccgtgcgcgtgccgaactacaacatgatcatcatggacgaggcccacttcacggacccctccagcatcgccgcccgggggtacatctccacccgcgtcggcatgggggaggcggccgccatcttcatgaccgccacgccgcccggcagcgtggaggccttcccgcagtccaacgcggtgatccaggacgaggagcgggacatccccgagcgcagctggaactccgggtacgagtggatcacggacttccccggcaagaccgtctggttcgtgcccagcatcaagtccggcaacgacatcgccaactgcctgcggaagaacgggaagcgcgtgatccagctgagccggaagaccttcgagaccgagtaccagaagacgaagaacaacgactgggactacgtcgtgaccaccgacatctccgagatgggcgccaacttccgcgccgaccgggtcatcgacccgcgccggtgcctcaagcccgtgatcctgaaggacgggagcgagcgcgtgatcctggcgggccccatgcccgtcaccgtggcctccgccgcccagcggcgcgggcggatcggccgcaaccacaacaaggagggcgaccagtacatctacatggggcagccgctcaacaacgacgaggaccacgcccactggacggaggcgaagatgctgctggacaacatcaacacccccgagggcatcatccccgccctcttcgagcccgagcgggagaagtccgccgccatcgacggggagtaccgcctgcgcggcgaggcccggaagaccttcgtggagctgatgcgccgcggggacctcccggtctggctgagctacaaggtggcgtccgagggcttccagtacagcgaccgccggtggtgcttcgacggcgagcgcaacaaccaggtgctggaggagaacatggacgtcgagatctggaccaaggagggggagcggaagaagctccgcccccggtggctggacgcccgcacgtactccgaccccctggccctccgggagttcaaggagttcgccgccggccgccggagcgtgtccggggacctgatcatcgagatcggcaagctgccccagcacctcacccagaaggcgcagaacgccctggacaacctggtgatgctccacaacagcgagcagggcgggcgcgcctaccggcacgccatggaggagctgccggacaccatcgagaccctgatgctcctggcgctgatcgccgtcctcacgggcggggtgaccctgttcttcctgtccggccgcgggctcggcaagaccagcatcggcctgctgtgcgtgatggcctccagcgtcctcctgtggatggcctccgtggagccccactggatcgccgcgagcatcatcctggagttcttcctcatggtgctgctgatccccgagcccgaccggcagcgcaccccgcaggacaaccagctcgcctacgtcgtgatcgggctgctgttcatgatcctcaccgtggccgccaacgagatgggcctgctggagacgaccaagaaggacctcgggatcggccacgtcgccgtggagaaccaccaccacgcgaccatgctggacgtggacctgcaccccgcctccgcctggaccctctacgccgtcgccacgaccatcatcacccccatgatgcggcacaccatcgagaacacgaccgcgaacatcagcctgaccgccatcgccaaccaggccgccatcctgatggggctcgacaagggctggccgatctccaagatggacatcggcgtgcccctgctggcgctcgggtgctacagccaggtgaaccccctgaccctgacggccgccgtcctcatgctggtggcccactacgcgatcatcggccccgggctgcaggccaaggccacccgcgaggcccagaagcggaccgccgcgggcatcatgaagaacccgaccgtggacgggatcgtcgccatcgacctcgaccccgtggtgtacgacgccaagttcgagaagcagctgggccagatcatgctgctcatcctgtgcacgtcccagatcctgctcatgcgcaccacctgggccctgtgcgagagcatcaccctggccacgggccccctcaccaccctgtgggaggggtcccccggcaagttctggaacaccacgatcgcggtcagcatggccaacatcttccgcgggagctacctggccggcgccggcctcgccttctccctgatgaagtccctcgggggcgggcggcgcgggaccggggcgcagggcgagaccctcggcgagaagtggaagcggcagctgaaccagctgtccaagagcgagttcaacatctacaagcgctccgggatcatggaggtggaccggagcgaggccaaggagggcctcaagcgcggggagaccacgcggcacgccgtgtcccgcggcaccgccaagctgcggtggttcgtcgagcgcaacctggtgaagccggaggggaaggtgatcgacctgggctgcggccgcggcgggtggagctactactgcgcggggctcaagaaggtcaccgaggtgaaggggtacaccaagggcggccccggccacgaggagcccatccccatggccacgtacgggtggaacctggtgaagctgcactccggcaaggacgtcttcttcaccccgcccgagaagtgcgacaccctcctgtgcgacatcggggagagctcccccaaccccaccatcgaggagggccgcacgctgcgggtgctcaagatggtggagccgtggctgcgcgggaaccagttctgcatcaagatcctgaacccctacatgcccagcgtcgtggagaccctcgagcagatgcagcggaagcacggcggcatgctggtgcgcaaccccctgtcccggaacagcacccacgagatgtactgggtctcctgcgggaccggcaacatcgtgagcgccgtgaacatgacctcccgcatgctcctgaaccggttcacgatggcccaccgcaagccgacctacgagcgcgacgtcgacctgggggccggcacccggcacgtggcggtcgagcccgaggtggccaacctcgacatcatcggccagcgcatcgagaacatcaagcacgagcacaagagcacctggcactacgacgaggacaacccctacaagacgtgggcctaccacgggtcctacgaggtgaagcccagcggcagcgcctccagcatggtcaacggggtggtgaagctgctgaccaagccgtgggacgtcatccccatggtgacccagatcgccatgaccgacacgacccccttcggccagcagcgggtgttcaaggagaaggtcgacacccgcacccccaaggcgaagcgggggacggcccagatcatggaggtgaccgcccgctggctctggtccttcctgagccggaacaagaagccgcgcatctgcacccgggaggagttcacccgcaaggtgcggtccaacgccgccatcggcgcggtcttcgtggacgagaaccagtggaacagcgccaaggaggccgtggaggacgagcgcttctgggacctggtccagaaggagcgggagctccacaagcagggcaagtgcgccacgtgcgtgtacaacatgatggggaagcgcgagaagaagctgggcgagttcgggaaggcgaagggctcccgggccatctggtacatgtggctgggggcccgcttcctcgagttcgaggccctgggcttcatgaacgaggaccactggttcagccgggagaactccctgagcggcgtggagggggagggcctccacaagctggggtacatcctgcgcgacatctccaagatccccggcgggaacatgtacgccgacgacaccgcgggctgggacacccggatcaccgaggacgacctccagaacgaggccaagatcacggacatcatggagcccgagcacgccctgctggccaccagcatcttcaagctcacctaccagaacaaggtcgtgcgcgtgcagcggccggccaagaacggcaccgtcatggacgtgatctcccgccgcgaccagcgggggagcggccaggtggggacgtacggcctgaacaccttcaccaacatggaggcgcagctgatccgccagatggagtccgagggcatcttcctccccagcgagctggagacccccaacctggccgagcgggtcctcgactggctggagaagcacggggtggagcgcctgaagcggatggccatctccggcgacgactgcgtggtcaagcccatcgacgaccgcttcgccacggccctcaccgcgctgaacgacatggggaaggtgcggaaggacatcccgcagtgggagcccagcaagggctggaacgactggcagcaggtccccttctgcagccaccacttccaccagctgatcatgaaggacgggcgcgagatcgtcgtgccctgccggaaccaggacgagctcgtgggccgcgcccgggtctcccagggcgccgggtggagcctgcgcgagaccgcctgcctgggcaagtcctacgcccagatgtggcagctcatgtacttccaccggcgcgacctgcggctggcggccaacgccatctgcagcgccgtgccggtggactgggtccccacctcccgcacgacctggagcatccacgcgcaccaccagtggatgaccaccgaggacatgctctccgtgtggaaccgggtgtggatcgaggagaacccctggatggaggacaagacgcacgtcagctcctggggcgacgtgccctacctgggcaagcgcgaggaccagtggtgcgggagcctgatcggcctcaccgcccgggccacctgggcctccaacatccaggtggccatcaaccaggtccgccgcctgatcggcaacgagaactacctggactacatgaccagcatgaagcggttcaagaacgagggggacccggagggcgcgctctggtga

SEQ ID NO: 8457 - RNA, 9879 nt, synthetic construct
  misc_feature 1..9879: note = derived and/or modified CDS sequence (opt1) from DENV-1__FJ882534__SS-prME
  source 1..9879: mol_type = other RNA
agcgtgaccatgctgctcatgctgatgcccaccgccctggccttccacctcacgacccgcggcggggagccgcacatgatcgtctccaagcaggagcggggcaagagcctgctgttcaagacctccgcgggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtcacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccacccggggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcaccccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgccgctcccctggaccagcggggccagcacctcccaggagacgtggaaccggcaggacctgctggtgaccttcaagaccgcccacgcgaagaagcaggaggtcgtggtgctcggcccccaggagggcgccatgcacaccgccctgacgggggccaccgagatccagaccagcggcaccacgaccatcttcgccgggcacctgaagtgccgcctcaagatggacaagctgaccctgaagggcatgtcctacgtcatgtgcaccgggagcttcaagctcgagaaggaggtggcggagacgcagcacggcaccgtgctggtccagatcaagtacgagggcaccgacgccccctgcaagatcccgttctccacccaggacgagaagggggtgacgcagaacggccggctgatcaccgccaaccccatcgtgaccgacaaggagaagcccgtcaacatcgaggccgagcccccgttcggggagagctacatcgtgatcggcgcgggcgagaaggccctgaagctctcctggttcaagaaggggagctccatcggcaagatgttcgaggccaccgcccgcggggcccggcgcatggcgatcctgggcgacacggcctgggacttcgggagcatcggcggcgtgttcacctccgtcgggaagctggtgcaccagatcttcggcaccgcctacggggtgctcttcagcggcgtctcctggaccatgaagatcgggatcggcgtgctgctgacgtggctcggcctgaacagccgctccaccagcctgtccatgacctgcatcgccgtggggctcgtcaccctgtacctgggcgtgatggtgcaggccgacagcgggtgcgtcatcaactggaagggccgggagctcaagtgcgggtccggcatcttcgtgacgaacgaggtgcacacctggaccgagcagtacaagttccaggcggacagccccaagcgcctgagcgccgccatcggcaaggcctgggaggagggggtctgcggcatccggtccgccacccgcctggagaacatcatgtggaagcagatcagcaacgagctcaaccacatcctgctggagaacgacatgaagctcaccgtggtggtcggggacgtggcgggcatcctggggcagggcaagaagatgatccggccccagcccatggagtacaagtactcctggaagagctggggcaaggccaagatcatcggggccgacgcccagaacacgaccttcatcatcgacggcccgaacacccccgagtgccccgacgaccagcgcgcgtggaacatctgggaggtggaggactacgggttcggcatcttcaccacgaacatctggctgaagctccgggactcctacacccaggtctgcgaccaccgcctgatgagcgccgccatcaaggactccaaggccgtgcacgccgacatgggctactggatcgagagcgagaagaacgagacctggaagctggcgcgggcctccttcatcgaggtgaagacctgcatctggcccaagagccacacgctctggtccaacggggtcctggagagcgagatgatcatcccgaagatctacggcgggcccatctcccagcacaactaccgccccggctacttcacccagaccgccgggccgtggcacctgggcaagctcgagctggacttcgacctgtgcgagggcaccacggtggtggtcgacgagcactgcgggaaccggggccccagcctccgcaccaccaccgtgacggggaagatcatccacgagtggtgctgccggtcctgcaccctgccccccctgcgcttccggggcgaggacgggtgctggtacggcatggagatccgcccggtgaaggagaaggaggagaacctcgtcaagagcatggtgtccgccggcagcggggaggtggacagcttctccctgggcctgctctgcatcagcatcatgatcgaggaggtcatgcggtcccgctggagccggaagatgctgatgaccgggaccctggccgtgttcttcctcctgatcatgggccagctgacgtggaacgacctcatccgcctgtgcatcatggtgggggcgaacgcctccgaccgcatgggcatgggcaccacctacctggccctcatggccaccttcaagatgcggcccatgttcgccgtcgggctgctgttccgccggctcacgagccgcgaggtgctgctgctcaccatcggcctgtccctggtggcgagcgtcgagctccccaactccctggaggagctgggggacggcctcgccatgggcatcatgatcctgaagctgctcaccgacttccagagccaccagctgtgggccaccctgctctccctgacgttcatcaagaccaccttcagcctgcactacgcctggaagaccatggcgatggtgctctccatcgtcagcctgttccccctgtgcctctccacgaccagccagaagaccacctggctgccggtgctgctcgggtccctgggctgcaagcccctgacgatgttcctcatcgtggagaacaagatctgggggcggaagagctggcccctgaacgagggcatcatggccgtcgggatcgtgtccatcctgctcagcagcctgctgaagaacgacgtgcccctcgccggcccgctgatcgccggcgggatgctgatcgcctgctacgtcatctccggcagctccgcggacctcagcctggagaaggccgccgaggtgtcctgggaggaggaggccgagcacagcggggcctcccacaacatcctggtggaggtccaggacgacggcaccatgaagatcaaggacgaggagcgcgacgacaccctcaccatcctgctgaaggcgaccctcctggccgtgagcggggtgtaccccctgtccatccccgccacgctcttcgtctggtacttctggcagaagaagaagcagcggagcggcgtgctgtgggacaccccctccccgcccgaggtggagcgcgccgtcctggacgacggcatctaccggatcatgcagcgcgggctgctcggccggagccaggtgggggtgggcgtcttccaggagaacgtgttccacaccatgtggcacgtgacccgcggggccgtcctgatgtaccagggcaagcggctggagccctcctgggcgagcgtgaagaaggacctcatctcctacggcgggggctggcgcctgcgggggagctggaacacgggcgaggaggtgcaggtcatcgccgtggagcccgggaagaacccgaagaacgtgcagaccgcccccggcaccttcaagacccccgagggcgaggtcggggccatcgccctggacttcaagcccggcacgtccgggagcccgatcgtgaaccgcgagggcaagatcgtgggcctctacgggaacggcgtcgtgaccacctccgggacctacgtgagcgcgatcgcccaggccaaggccagccaggagggccccctgcccgagatcgaggacgaggtcttccggaagcgcaacctgacgatcatggacctccacccggggtccggcaagacccggcgctacctgcccgcgatcgtgcgggaggccatcaagcgcaagctgcgcaccctcatcctggcccccacccgggtggtcgccagcgagatggccgaggcgctgaagggcatgcccatccgctaccagacgaccgccgtgaagtccgagcacaccgggaaggagatcgtggacctcatgtgccacgccaccttcacgatgcggctgctgagcccggtccgcgtgcccaactacaacatgatcatcatggacgaggcccacttcaccgacccctccagcatcgccgcgcggggctacatctccacccgcgtggggatgggcgaggccgccgccatcttcatgaccgccacgcccccggggagcgtcgaggcgttcccccagtccaacgccgtgatccaggacgaggagcgggacatccccgagcgcagctggaactccggctacgagtggatcaccgacttccccggcaagaccgtgtggttcgtcccgagcatcaagtccgggaacgacatcgccaactgcctccggaagaacggcaagcgcgtgatccagctgagccggaagaccttcgacacggagtaccagaagaccaagaacaacgactgggactacgtggtcaccaccgacatctccgagatgggggccaacttccgcgcggaccgggtgatcgacccccgccggtgcctgaagcccgtgatcctcaaggacggccccgagcgcgtcatcctggccgggccgatgcccgtgacggtcgccagcgccgcccagcggcgcggccggatcggccgcaaccacaacaaggagggggaccagtacatctacatgggccagcccctgaacaacgacgaggaccacgcgcactggaccgaggccaagatgctcctggacaacatcaacacccccgaggggatcatcccggccctgttcgagcccgagcgcgagaagtccgccgccgtggacggcgagtaccggctccgcggggaggcgcggaagaccttcgtggagctgatgcgccggggcgacctgcccgtctggctcagctacaaggtggcctccgagggcttccagtacagcgaccgccggtggtgcttcgacggggagcgcaacaaccaggtgctggaggagaacatggacgtcgagatctggacgaaggagggcgagcggaagaagctgcgcccccggtggctcgacgcccgcacctacagcgacccgctggccctgcgggagttcaaggagttcgccgcggggcgccggtccgtgagcggcgacctcatcctggagatcggcaagctgccccagcacctcacccagcgcgcccagaacgccctggacaacctggtgatgctccacaactccgagcaggggggccgggcctaccgccacgcgatggaggagctgcccgacaccatcgagacgctgatgctcctggccctgatcgccgtcctcaccgggggcgtgaccctgttcttcctgagcgggcggggcctcggcaagacctccatcgggctgctgtgcgtgatggccagctccgtcctcctgtggatggccagcgtggagccccactggatcgcggcctccatcatcctggagttcttcctcatggtgctgctgatcccggagcccgaccgccagcggaccccccaggacaaccagctcgcctacgtcgtgatcggcctgctgttcatgatcctcacggtggccgccaacgagatggggctgctggagaccaccaagaaggacctcggcatcgggcacgtcgcggtggagaaccaccaccacgccgccatgctggacgtggacctgcacccggccagcgcctggaccctctacgcggtcgccacgaccatcatcacccccatgatgcgccacaccatcgagaacacgaccgccaacatctccctgaccgccatcgccaaccaggcggccatcctgatgggcctcgacaagggctggcccatcagcaagatggacatcggggtgcccctgctggccctcggctgctactcccaggtgaacccgctgaccctgacggccgcggtcctcatgctggtggcccactacgccatcatcgggcccggcctgcaggccaaggccacccgcgaggcgcagaagcggaccgccgccgggatcatgaagaaccccaccgtggacggcatcgtcgccatcgacctcgaccccgtggtgtacgacgccaagttcgagaagcagctgggccagatcatgctgctcatcctgtgcacgagccagatcctgctcatgcgcaccacctgggcgctgtgcgagtccatcaccctggccacggggccgctcaccaccctgtgggagggcagccccgggaagttctggaacaccacgatcgccgtctccatggccaacatcttccggggcagctacctggccggcgcggggctcgccttctccctgatgaagagcctgggcgggggccgccgggggaccggcgcccagggcgagaccctcggggagaagtggaagcgccagctgaaccagctgagcaagtccgagttcaacacctacaagcggagcggcatcatggaggtggaccgctccgaggccaaggaggggctcaagcggggcgagacgaccaagcacgcggtgagccgcgggaccgccaagctgcggtggttcgtcgagcgcaacctggtgaagcccgagggcaaggtgatcgacctgggctgcgggcggggcgggtggtcctactactgcgccggcctcaagaaggtcaccgaggtgaaggggtacacgaagggcggccccgggcacgaggagccgatccccatggccacctacggctggaacctggtgaagctgcacagcgggaaggacgtcttcttcatcccccccgagaagtgcgacaccctcctgtgcgacatcggcgagtccagcccgaaccccaccatcgaggaggggcgcacgctgcgggtgctcaagatggtggagccctggctgcgcggcaaccagttctgcatcaagatcctgaacccctacatgccgtccgtcgtggagaccctcgagcagatgcagcggaagcacggcgggatgctggtgcgcaaccccctgagccggaactccacccacgagatgtactgggtcagctgcggcaccgggaacatcgtgtccgccgtgaacatgaccagccgcatgctcctgaaccgcttcacgatggcgcaccggaagcccacctacgagcgcgacgtcgacctgggcaccggcacccggcacgtggccgtggagcccgaggtcgccaacctcgacatcatcgggcagcgcatcgagaacatcaagcacgagcacaagtccacgtggcactacgacgaggacaacccgtacaagacctgggcctaccacggcagctacgaggtgaagccctccgggagcgcctccagcatggtcaacggcgtggtgaagctgctgaccaagccctgggacgtcatccccatggtgacccagatcgcgatgacggacaccaccccgttcgggcagcagcgggtgttcaaggagaaggtcgacacccgcacgcccaaggccaagcggggcaccgcccagatcatggaggtgaccgcccgctggctctggggcttcctgagccggaacaagaagccccgcatctgcacccgggaggagttcacgcgcaaggtgcggtccaacgccgcgatcggggccgtcttcgtggacgagaaccagtggaacagcgccaaggaggccgtggaggacgagcgcttctgggacctggtccaccgggagcgcgagctccacaagcagggcaagtgcgcgacctgcgtgtacaacatgatggggaagcgggagaagaagctgggcgagttcgggaaggccaagggctcccgcgccatctggtacatgtggctgggcgcccggttcctcgagttcgaggccctggggttcatgaacgaggaccactggttcagccgcgagaactccctgagcggcgtggagggggagggcctccacaagctggggtacatcctgcgggacatctccaagatcccgggcggcaacatgtacgcggacgacaccgccgggtgggacacccgcatcacggaggacgacctccagaacgaggccaagatcaccgacatcatggagcccgagcacgccctgctggccaaggcgatcttcaagctcacctaccagaacaaggtcgtgcgcgtgcagcggcccgccaagaacggcaccgtcatggacgtgatcagccgccgggaccagcgcgggtccggccaggtgggcacgtacgggctgaacaccttcaccaacatggaggcccagctgatccggcagatggagagcgagggcatcttctcccccagcgagctcgagaccccgaacctggccgagcgcgccctggactggctcgagaagtacggggtcgagcggctgaagcgcatggcgatctccggcgacgactgcgtggtgaagcccatcgacgaccggttcgccacggccctgaccgccctcaacgacatggggaaggtccgcaaggacatcccccagtgggagcccagcaagggctggaacgactggcagcaggtgccgttctgctcccaccacttccaccagctgatcatgaaggacggccgggagatcgtggtcccctgccgcaaccaggacgagctggtggggcgggcccgcgtgagccagggcgcggggtggtccctccgggagaccgcctgcctgggcaagagctacgcccagatgtggcagctgatgtacttccaccgccgggacctccgcctggccgcgaacgccatctgcagcgccgtccccgtggactgggtgcccacctcccggacgacctggagcatccacgcccaccaccagtggatgaccaccgaggacatgctgtccgtctggaaccgcgtgtggatcgaggagaacccgtggatggaggacaagacgcacatcagctcctgggaggacgtgccctacctcgggaagcgcgaggaccagtggtgcggcagcctgatcggcctgaccgcccgggcgacctgggccaccaacatccaggtcgccatcaaccaggtgcgccggctcatcgggaacgagaactacctggactacatgacctccatgaagcgcttcaagaacgagagcgaccccgagggcgccctgtggtga

SEQ ID NO: 8458 - RNA, 9879 nt, synthetic construct
  misc_feature 1..9879: note = derived and/or modified CDS sequence (opt1) from DENV-1__FJ882536__SS-prME
  source 1..9879: mol_type = other RNA
agcgtgaccatgctgctcatgctgatgcccaccgccctggccttccacctcaccacccgcggcggggagccccacatgatcgtgagcaagcaggagcggggcaagagcctgctgttcaagaccagcgccggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtcctcttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggccgactccgggtgcgtcatcaactggaagggccgggagctcaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctggagaacatcatgtggaagcagatctccaacgagctcaaccacatcctgctggagaacgacatgaagctcaccgtggtggtcggggacgtggcgggcatcctggggcagggcaagaagatgatccggccccagcccatggagtacaagtacagctggaagtcctggggcaaggccaagatcatcggggccgacgcccagaacacgaccttcatcatcgacggccccaacaccccggagtgccccgacgaccagcgcgcgtggaacatctgggaggtggaggactacgggttcggcatcttcaccacgaacatctggctgaagctccgggacagctacacccaggtctgcgaccaccgcctgatgtccgccgccatcaaggacagcaaggccgtgcacgccgacatgggctactggatcgagtccgagaagaacgagacctggaagctggcgcgggccagcttcatcgaggtgaagacctgcatctggcccaagtcccacacgctctggagcaacggggtcctggagtccgagatgatcatccccaagatctacggcgggccgatcagccagcacaactaccgccccggctacttcacccagaccgccgggccctggcacctgggcaagctcgagctggacttcgacctgtgcgagggcaccacggtggtggtcgacgagcactgcgggaaccggggcccgtccctccgcaccaccaccgtgacggggaagatcatccacgagtggtgctgccggagctgcaccctgccgcccctgcgcttccggggcgaggacgggtgctggtacggcatggagatccgccccgtgaaggagaaggaggagaacctcgtcaagtccatggtgagcgccggcagcggggaggtggactccttcagcctgggcctgctctgcatctccatcatgatcgaggaggtcatgcggagccgctggtcccggaagatgctgatgaccgggaccctggccgtgttcttcctcctgatcatgggccagctgacgtggaacgacctcatccgcctgtgcatcatggtgggggcgaacgccagcgaccgcatgggcatgggcaccacctacctggccctcatggccaccttcaagatgcggccgatgttcgccgtcgggctgctgttccgccggctcacgtcccgcgaggtgctgctgctcaccatcggcctgagcctggtggcgtccgtcgagctccccaacagcctggaggagctgggggacggcctcgccatgggcatcatgatcctgaagctgctcaccgacttccagtcccaccagctgtgggccaccctgctcagcctgacgttcatcaagaccaccttctccctgcactacgcctggaagaccatggcgatggtgctcagcatcgtctccctgttccccctgtgcctcagcacgacctcccagaagaccacctggctgcccgtgctgctcgggagcctgggctgcaagccgctgacgatgttcctcatcgccgagaacaagatctgggggcggaagtcctggcccctgaacgagggcatcatggccgtggggatcgtcagcatcctgctcagctccctgctgaagaacgacgtgcccctcgccggccccctgatcgccggcgggatgctgatcgcgtgctacgtgatcagcggctccagcgccgacctctccctggagaaggccgccgaggtcagctgggaggaggaggccgagcactccggggcgagccacaacatcctggtggaggtgcaggacgacggcaccatgaagatcaaggacgaggagcgcgacgacaccctcaccatcctgctgaaggccaccctcctggccgtctccggggtgtacccgctgagcatccccgccaccctcttcgtgtggtacttctggcagaagaagaagcagcggtccggcgtcctgtgggacacccccagcccgcccgaggtggagcgcgccgtgctggacgacggcatctaccggatcatgcagcgcgggctgctcggccggtcccaggtcggggtgggcgtgttccaggagaacgtcttccacaccatgtggcacgtgacccgcggggcggtgctgatgtaccagggcaagcggctggagcccagctgggcctccgtcaagaaggacctcatcagctacggcgggggctggcgcctgcgggggtcctggaacacgggcgaggaggtccaggtgatcgccgtcgagcccgggaagaaccccaagaacgtgcagaccgcccccggcaccttcaagacccccgagggcgaggtgggggccatcgcgctggacttcaagcccggcacgagcgggtcccccatcgtcaaccgcgagggcaagatcgtgggcctctacgggaacggcgtggtcaccaccagcgggacctacgtgagcgccatcgcccaggccaaggcgtcccaggagggcccgctgcccgagatcgaggacgaggtgttccggaagcgcaacctgacgatcatggacctccaccccgggagcggcaagacccggcgctacctgccggccatcgtccgggaggccatcaagcgcaagctgcgcaccctcatcctggcccccacccgggtggtggcctccgagatggcggaggccctgaagggcatgcccatccgctaccagacgaccgccgtcaagagcgagcacaccgggaaggagatcgtggacctcatgtgccacgccaccttcacgatgcggctgctgtcccccgtgcgcgtcccgaactacaacatgatcatcatggacgaggcccacttcaccgaccccagctccatcgcggcccggggctacatcagcacccgcgtggggatgggcgaggccgccgccatcttcatgaccgcgacgccgcccgggtccgtggaggccttcccgcagagcaacgccgtcatccaggacgaggagcgggacatccccgagcgctcctggaacagcggctacgagtggatcaccgacttccccggcaagaccgtgtggttcgtgccctccatcaagagcgggaacgacatcgccaactgcctccggaagaacggcaagcgcgtcatccagctgtcccggaagaccttcgacacggagtaccagaagaccaagaacaacgactgggactacgtggtgaccaccgacatcagcgagatgggggcgaacttccgcgccgaccgggtcatcgacccgcgccggtgcctgaagcccgtgatcctcaaggacggccccgagcgcgtgatcctggccgggcccatgccggtcacggtggcctccgccgcgcagcggcgcggccggatcggccgcaaccacaacaaggagggggaccagtacatctacatgggccagcccctgaacaacgacgaggaccacgcccactggaccgaggccaagatgctcctggacaacatcaacacccccgaggggatcatccccgccctgttcgagccggagcgcgagaagtccgccgcggtcgacggcgagtaccggctccgcggggaggcccggaagaccttcgtggagctgatgcgccggggcgacctgcccgtgtggctctcctacaaggtcgccagcgagggcttccagtacagcgaccgccggtggtgcttcgacggggagcgcaacaaccaggtgctggaggagaacatggacgtggagatctggacgaaggagggcgagcggaagaagctgcgcccccggtggctcgacgcccgcacctactccgaccccctggccctgcgggagttcaaggagttcgcggccgggcgccggagcgtctccggcgacctcatcctggagatcggcaagctgccgcagcacctcacccagcgcgcccagaacgccctggacaacctggtgatgctccacaacagcgagcagggcgggcgggcgtaccgccacgccatggaggagctgcccgacaccatcgagacgctgatgctcctggccctgatcgccgtgctcaccgggggcgtcaccctgttcttcctgtccgggcggggcctcggcaagaccagcatcgggctgctgtgcgtgatggcctccagcgtgctcctgtggatggcgtccgtcgagccccactggatcgccgccagcatcatcctggagttcttcctcatggtgctgctgatccccgagccggaccgccagcggacgccccaggacaaccagctcgcctacgtggtcatcggcctgctgttcatgatcctcacggtggccgcgaacgagatggggctgctggagaccaccaagaaggacctcggcatcgggcacgtggccgtcgagaaccaccaccacgccgccatgctggacgtggacctgcaccccgcctccgcgtggaccctctacgccgtggccacgaccatcatcaccccgatgatgcgccacaccatcgagaacacgaccgccaacatcagcctgaccgccatcgcgaaccaggccgccatcctgatgggcctcgacaagggctggcccatctccaagatggacatcggggtccccctgctggccctcggctgctacagccaggtgaaccccctgaccctgacggcggccgtgctcatgctggtcgcccactacgccatcatcgggccgggcctgcaggccaaggcgacccgcgaggcccagaagcggaccgccgccgggatcatgaagaaccccaccgtggacggcatcgtggccatcgacctcgaccccgtcgtgtacgacgcgaagttcgagaagcagctgggccagatcatgctgctcatcctgtgcacgtcccagatcctgctcatgcgcaccacctgggccctgtgcgagagcatcaccctggccacggggcccctcaccaccctgtgggagggctccccggggaagttctggaacaccacgatcgccgtgagcatggccaacatcttccggggctcctacctggcgggcgccgggctcgccttcagcctgatgaagtccctgggcgggggccgccgggggaccggcgcccagggcgagaccctcggggagaagtggaagcgccagctgaaccagctgtccaagagcgagttcaacacctacaagcggtccggcatcatggaggtcgaccgcagcgaggcgaaggaggggctcaagcggggcgagacgaccaagcacgccgtgtcccgcgggaccgccaagctgcggtggttcgtggagcgcaacctggtcaagcccgagggcaaggtgatcgacctgggctgcgggcggggcgggtggagctactactgcgccggcctcaagaaggtgaccgaggtcaaggggtacacgaagggcggccccgggcacgaggagcccatcccgatggccacctacggctggaacctggtgaagctgcactccgggaaggacgtgttcttcatcccgcccgagaagtgcgacaccctcctgtgcgacatcggcgagagctcccccaacccgaccatcgaggaggggcgcacgctgcgggtcctcaagatggtggagccctggctgcgcggcaaccagttctgcatcaagatcctgaacccctacatgcccagcgtggtcgagaccctcgagcagatgcagcggaagcacggcgggatgctggtgcgcaacccgctgtcccggaacagcacccacgagatgtactgggtgtcctgcggcaccgggaacatcgtcagcgcggtgaacatgacctcccgcatgctcctgaaccgcttcacgatggcccaccggaagcccacctacgagcgcgacgtggacctgggcaccggcacccggcacgtcgccgtggagcccgaggtggccaacctcgacatcatcgggcagcgcatcgagaacatcaagcacgagcacaagagcacgtggcactacgacgaggacaacccctacaagacctgggcctaccacggctcctacgaggtcaagccgagcgggtccgcgagcagcatggtgaacggcgtcgtgaagctgctgaccaagccctgggacgtgatccccatggtcacccagatcgccatgacggacaccacccccttcgggcagcagcgggtgttcaaggagaaggtggacacccgcacgccgaaggccaagcggggcaccgcccagatcatggaggtcaccgcccgctggctctggggcttcctgtcccggaacaagaagccccgcatctgcacccgggaggagttcacgcgcaaggtgcggagcaacgcggccatcggggccgtgttcgtcgacgagaaccagtggaactccgccaaggaggcggtggaggacgagcgcttctgggacctggtgcaccgggagcgcgagctccacaagcagggcaagtgcgcgacctgcgtctacaacatgatggggaagcgggagaagaagctgggcgagttcgggaaggccaagggcagccgcgccatctggtacatgtggctgggcgcccggttcctcgagttcgaggcgctggggttcatgaacgaggaccactggttctcccgcgagaacagcctgtccggcgtggagggggagggcctccacaagctggggtacatcctgcgggacatcagcaagatccccggcggcaacatgtacgccgacgacaccgccgggtgggacacccgcatcacggaggacgacctccagaacgaggccaagatcaccgacatcatggagccggagcacgccctgctggcgaaggccatcttcaagctcacctaccagaacaaggtggtccgcgtgcagcggcccgccaagaacggcaccgtgatggacgtcatctcccgccgggaccagcgcgggagcggccaggtgggcacgtacgggctgaacaccttcaccaacatggaggcccagctgatccggcagatggagtccgagggcatcttcagcccctccgagctcgagacccccaacctggccgagcgcgcgctggactggctcgagaagtacggggtggagcggctgaagcgcatggccatcagcggcgacgactgcgtcgtgaagccgatcgacgaccggttcgccacggccctgaccgccctcaacgacatggggaaggtgcgcaaggacatcccccagtgggagccctccaagggctggaacgactggcagcaggtccccttctgcagccaccacttccaccagctgatcatgaaggacggccgggagatcgtggtgccgtgccgcaaccaggacgagctggtcgggcgggcgcgcgtgtcccagggcgccgggtggagcctccgggagaccgcctgcctgggcaagagctacgcccagatgtggcagctgatgtacttccaccgccgggacctccgcctggcggccaacgccatctgctccgccgtgcccgtcgactgggtgcccaccagccggacgacctggtccatccacgcccaccaccagtggatgaccaccgaggacatgctgagcgtgtggaaccgcgtctggatcgaggagaacccctggatggaggacaagacgcacatctccagctgggaggacgtgccgtacctcgggaagcgcgaggaccagtggtgcggctccctgatcggcctgaccgcgcgggccacctgggccaccaacatccaggtggccatcaaccaggtccgccggctcatcgggaacgagaactacctggactacatgaccagcatgaagcgcttcaagaacgagtccgaccccgagggcgccctgtggtga

SEQ ID NO: 8459 - RNA, 9879 nt, synthetic construct
  misc_feature 1..9879: note = derived and/or modified CDS sequence (opt1) from DENV-1__FJ882537__SS-prME
  source 1..9879: mol_type = other RNA
agcgtgaccatgctgctcatgctgatgcccaccgccctggccttccacctcaccacccggggcggggagccccacatgatcgtgtccaagcaggagcggggcaagagcctgctgttcaagacctccgccggggtgaacatgtgcaccctcatcgccatggacctgggcgagctgtgcgaggacaccatgacctacaagtgcccccggatcaccgaggtggagcccgacgacgtggactgctggtgcaacaccaccgacacctgggtgacctacgggacctgcagccagacgggcgagcaccggcgcgacaagcggtccgtggccctcgcgccccacgtcggcctggggctggagacccgggccgagacctggatgagctccgagggcgcgtggaagcagatccagaaggtggagacctgggccctccggcaccccgggttcacggtgatcgccctgttcctggcccacgcgatcggcaccagcatcacccagaaggggatcatcttcatcctcctgatgctggtcaccccctccatggccatgcgctgcgtgggcatcggcagccgggacttcgtggaggggctctccggcgccacgtgggtcgacgtggtgctggagcacgggagctgcgtcaccaccatggccaaggacaagcccaccctggacatcgagctcctgaagacggaggtgaccaaccccgccgtgctgcgcaagctctgcatcgaggcgaagatctccaacaccaccacggacagccggtgcccgacccagggcgaggccaccctggtcgaggagcaggacgccaacttcgtgtgccgccggaccttcgtggaccgcggctgggggaacggctgcgggctgttcggcaaggggtccctcatcacgtgcgccaagttcaagtgcgtcaccaagctggagggcaagatcgtgcagtacgagaacctgaagtacagcgtgatcgtcaccgtgcacaccggcgaccagcaccaggtcgggaacgagtccacggagcacggcaccatcgccaccatcacgccccaggcgcccaccagcgagatccagctcacggactacggggccctgaccctggactgcagcccccggaccggcctcgacttcaacgagatggtgctgctgaccatgaaggagaagtcctggctcgtgcacaagcagtggttcctggacctgcccctcccctggacgagcggggcctccaccagccaggagacctggaaccgccaggacctgctggtcaccttcaagacggcccacgccaagaagcaggaggtggtggtcctcggctcccaggagggcgcgatgcacaccgccctgaccggggccaccgagatccagacgaccggcaccaccacgatcttcgccgggcacctgaagtgccggctcaagatggacaagctgaccctgaagggcatgagctacgtgatgtgcaccgggtccttcaagctcgagaaggaggtggccgagacccagcacggcacggtcctggtgcagatcaagtacgagggcaccgacgcgccctgcaagatccccttcagcacccaggacgagaagggggtgacccagaacggccgcctgatcacggccaacccgatcgtcaccgacaaggagaagcccgtgaacatcgaggccgagccgcccttcggggagtcctacatcgtgatcggcgccggcgagaaggcgctgaagctcagctggttcaagaaggggtccagcatcggcaagatgttcgaggccaccgcccgcggggcccgccggatggccatcctgggcgacaccgcgtgggacttcgggtccatcggcggcgtcttcacgagcgtggggaagctggtgcaccagatcttcggcaccgcctacggggtcctcttctccggcgtgagctggaccatgaagatcgggatcggcgtgctgctgacctggctcggcctgaactcccgcagcacgtccctgagcatgacctgcatcgccgtcgggctcatcaccctgtacctgggcgtgatggtgcaggccgactccgggtgcgtcatcaactggaagggccgcgagctcaagtgcgggagcggcatcttcgtgaccaacgaggtgcacacgtggaccgagcagtacaagttccaggccgacagcccgaagcggctgtccgcggccatcggcaaggcctgggaggagggggtctgcggcatccgcagcgccacccggctggagaacatcatgtggcgccagatctccaacgagctcaaccacatcctgctggagaacgacatgaagttcaccgtggtggtcggggacgtggtgggcatcctcgcccaggggaagaagatggtccggccccagcccatggagcacaagtacagctggaagtcctggggcaaggcgaagatcatcggcgccgacgtgcagaacaccacgttcatcatcgacgggcccaacaccccggagtgccccgacgaccagcgcgcctggaacatctgggaggtggaggactacggcttcgggatcttcaccaccaacatctggctgaagctgcgggacagctacacgcaggtctgcgaccaccgcctcatgtccgccgcgatcaaggacagcaaggccgtgcacgccgacatgggctactggatcgagtccgagaagaacgagacctggaagctggcccgggccagcttcatcgaggtgaagacctgcatctggcccaagtcccacaccctgtggagcaacggcgtcctcgagtccgagatgatcatccccaagatctacgggggcccgatcagccagcacaactaccgccccgggtacttcacgcagaccgcgggcccctggcacctggggaagctggagctcgacttcgacctgtgcgagggcaccaccgtggtggtcgacgagcactgcggcaaccgggggccgtccctgcgcacgaccaccgtgaccggcaagatcatccacgagtggtgctgccggagctgcacgctgccgcccctccgcttcaagggggaggacggctgctggtacgggatggagatccggcccgtgaaggagaaggaggagaacctggtcaagtccatggtgagcgccggcagcggcgaggtggactccttcagcctcgggctgctgtgcatctccatcatgatcgaggaggtcatgcgcagccggtggtcccgcaagatgctcatgaccggcaccctggccgtgttcttcctgctcatcatggggcagctgacctggaacgacctgatccggagctgcatcatggtgggcgccaacgcctccgaccgcatggggatgggcacgacctacctcgcgctgatggccaccttcaagatgcgcccgatgttcgccgtcggcctgctgttccggcgcctgaccagccgggaggtgctgctcctgacgatcgggctgtccctcgtcgccagcgtggagctgcccaactccctggaggagctcggcgacgggctggccatgggcatcatgatcctgaagctcctgaccgacttccagagctaccagctgtgggcgaccctcctgtccctgaccttcatcaagacgaccttcagcctccactacgcctggaagaccatggccatggtgctgtccatcgtcagcctgctccccctgtgcctgtccaccacgagccagaagaccacctggctccccgtgctgctgggctccctcgggtgcaagccgctgaccatgttcctgatcgccgagaacaagatctggggccgcaagagctggcccctcaacgaggggatcatggcggtgggcatcgtcagcatcctgctgtccagcctcctgaagaacgacgtgcccctggccgggcccctcatcgccggcggcatgctgatcgcctgctacgtgatctccgggagctccgccgacctgagcctcgagaaggcggccgaggtctcctgggaggaggaggccgagcacagcggcgcctcccacaacatcctggtggaggtgcaggacgacgggacgatgaagatcaaggacgaggagcgggacgacaccctgaccatcctcctgaaggccaccctgctcgcggtcagcggcgtgtacccgctgtccatccccgccaccctgttcgtgtggtacttctggcagaagaagaagcagcgcagcggggtcctctgggacacgcccagcccgcccgaggtggagcgggccgtgctggacgacggcatctaccgcatcatgcagcggggcctgctggggcgcagccaggtcggcgtgggggtgttccaggagaacgtcttccacaccatgtggcacgtgacccggggcgccgtgctcatgtaccaggggaagcgcctggagccctcctgggccagcgtcaagaaggacctgatctcctacggcggcgggtggcggctccagggcagctggaacaccggggaggaggtccaggtgatcgcggtcgagcccggcaagaaccccaagaacgtgcagacggcccccgggaccttcaagacccccgagggcgaggtgggcgccatcgccctggacttcaagcccgggacctccggcagccccatcgtcaaccgcgaggggaagatcgtgggcctgtacggcaacggggtggtcacgaccagcggcacctacgtgtccgccatcgcgcaggccaaggccagccaggaggggccgctccccgagatcgaggacgaggtgttccggaagcgcaacctgaccatcatggacctgcaccccggctccgggaagacgcggcgctacctcccggccatcgtccgggaggcgatcaagcgcaagctgcggaccctgatcctcgcccccacccgcgtggtggccagcgagatggccgaggccctgaagggcatgcccatccgctaccagaccacggcggtcaagtccgagcacaccggccgggagatcgtggacctgatgtgccacgccaccttcaccatgcgcctcctgagccccgtgcgggtcccgaactacaacatgatcatcatggacgaggcccacttcacggacccctccagcatcgccgcccgcgggtacatctccacccgggtgggcatgggggaggcggccgccatcttcatgaccgccacgccgcccggcagcgtggaggccttcccgcagtccaacgcggtcatccaggacgaggagcgcgacatccccgagcggagctggaactccgggtacgagtggatcacggacttccccggcaagaccgtgtggttcgtgcccagcatcaagtccggcaacgacatcgccaactgcctgcgcaagaacgggaagcgggtcatccagctcagccgcaagaccttcgacaccgagtaccagaagacgaagaacaacgactgggactacgtggtgaccaccgacatctccgagatgggcgccaacttccgggccgaccgcgtcatcgacccgcggcgctgcctgaagcccgtgatcctgaaggacgggcccgagcgggtcatcctcgcgggccccatgccggtgaccgtggccagcgccgcccagcgccgggggcgcatcggccggaaccacaacaaggagggcgaccagtacatctacatggggcagcccctgaacaacgacgaggaccacgcccactggacggaggcgaagatgctgctcgacaacatcaacacccccgagggcatcatccccgccctgttcgagccggagcgcgagaagtccgccgccatcgacggggagtaccgcctgcggggcgaggcccgcaagaccttcgtcgagctcatgcggcgcggggacctgcccgtgtggctgagctacaaggtggcgagcgagggcttccagtactccgaccggcgctggtgcttcgacggcgagcggaacaaccaggtcctcgaggagaacatggacgtggagatctggaccaaggagggggagcgcaagaagctgcggccccgctggctggacgcccggacgtacagcgaccccctcgccctgcgcgagttcaaggagttcgccgccggccggcgctccgtgagcggggacctgatcctcgagatcggcaagctgccgcagcacctgacccagcgggcgcagaacgccctcgacaacctggtcatgctgcacaactccgagcagggcgggcgcgcctaccggcacgccatggaggagctccccgacaccatcgagaccctgatgctgctcgcgctgatcgccgtgctgacgggcggggtgaccctcttcttcctgagcggccgcgggctgggcaagacctccatcggcctcctgtgcgtcatggccagctccgccctgctctggatggccagcgtggagccccactggatcgcggcctccatcatcctggagttcttcctgatggtgctcctgatccccgagccggaccggcagcgcacgccccaggacaaccagctggcctacgtcgtgatcgggctcctgttcatgatcctgaccgtggccgccaacgagatgggcctcctggagacgaccaagaaggacctggggatcggccacgtcgcggtggagaaccaccaccacgccaccatgctcgacgtggacctgcaccccgccagcgcctggaccctgtacgccgtcgcgacgaccatcatcaccccgatgatgcggcacaccatcgagaacacgaccgccaacatctccctcaccgccatcgccaaccaggccgcgatcctgatggggctggacaagggctggcccatcagcaagatggacatcggcgtgcccctcctggccctggggtgctactcccaggtgaaccccctcaccctgacggccgccgtcctgatgctcgtggcgcactacgccatcatcggcccggggctgcaggccaaggccacccgcgaggcccagaagcgcaccgcggccggcatcatgaagaaccccaccgtggacgggatcgtcgccatcgacctggaccccgtggtgtacgacgccaagttcgagaagcagctcggccagatcatgctgctgatcctctgcacgagccagatcctgctgatgcggaccacctgggccctctgcgagtccatcaccctggcgacgggccccctgaccaccctctgggaggggagcccgggcaagttctggaacaccacgatcgccgtctccatggccaacatcttccgcgggagctacctggccggcgccggcctggcgttcagcctcatgaagtccctcgggggcgggcggcgcgggaccggggcccagggcgagaccctgggcgagaagtggaagcggcagctcaaccagctgagcaagtccgagttcaacacctacaagcgcagcgggatcatggaggtggaccggtccgaggccaaggagggcctgcgccgcggggagacgaccaagcacgccgtgagccgcggcaccgcgaagctccggtggttcgtcgagcgcaacctggtgaagcccgaggggaaggtgatcgacctgggctgcggccgcggcgggtggtcctactactgcgccgggctgaagaaggtcaccgaggtgaaggggtacacgaagggcggccccggccacgaggagcccatcccgatggccacctacgggtggaacctcgtgaagctgcacagcggcaaggacgtcttcttcatcccgcccgagaagtgcgacaccctgctctgcgacatcggggagtccagccccaacccgaccatcgaggagggccgcacgctgcgggtgctgaagatggtggagccctggctccgcgggaaccagttctgcatcaagatcctgaacccctacatgccctccgtcgtggagaccctggagcacatgcagcggaagcacggcggcatgctcgtgcgcaacccgctgagccggaactccacccacgagatgtactgggtcagctgcgggaccggcaacatcgtgtccgccgtgaacatgaccagccgcatgctgctcaaccgcttcacgatggcccaccggaagcccacctacgagcgcgacgtcgacctgggggcgggcacccggcacgtggccgtggagcccgaggtcgccaacctggacatcatcggccagcgcatcgagaacatcaagcacgagcacaagtccacctggcactacgacgaggacaacccctacaagacgtgggcctaccacgggagctacgaggtgaagccgtccggcagcgccagctccatggtcaacggggtggtgaagctcctgaccaagccctgggacgtcatccccatggtgacccagatcgcgatgaccgacacgacccccttcggccagcagcgggtgttcaaggagaaggtcgacacccgcaccccgaaggccaagcgggggacggcccagatcatggaggtgaccgcccgctggctgtggggcttcctcagccggaacaagaagccccgcatctgcacccgggaggagttcacccgcaaggtgcggtccaacgccgcgatcggcgccgtcttcgtggacgagaaccagtggaacagcgccaaggaggccgtggaggacgagcgcttctgggacctggtccaccgggagcgcgagctgcacaagcaggggaagtgcgcgacgtgcgtgtacaacatgatgggcaagcgggagaagaagctcggggagttcggcaaggccaaggggtcccgcgccatctggtacatgtggctgggcgcccggttcctggagttcgaggccctcggcttcatgaacgaggaccactggttcagccgcgagaactccctgagcggggtggagggcgaggggctgcacaagctcggctacatcctgcgggacatctccaagatccccgggggcaacatgtacgcggacgacaccgccggctgggacacccgcatcaccgaggacgacctgcagaacgaggccaagatcacggacatcatggagccggagcacgccctcctggccaccagcatcttcaagctgacctaccagaacaaggtcgtgcgcgtgcagcggcccgcgaagaacgggaccgtcatggacgtgatctcccgccgggaccagcgcggcagcggccaggtgggcacgtacggcctcaacaccttcaccaacatggaggcccagctgatccggcagatggagtccgaggggatcttcagcccctccgagctggagacccccaacctcgccgagcgcgtcctggactggctggagaagtacggcgtggagcggctcaagcgcatggccatcagcggggacgactgcgtggtcaagccgatcgacgaccggttcgccacggcgctgaccgccctgaacgacatgggcaaggtgcgcaaggacatcccccagtgggagccctccaaggggtggaacgactggcagcaggtccccttctgcagccaccacttccaccagctcatcatgaaggacggccgggagatcgtcgtgccgtgccgcaaccaggacgagctggtgggccgggcccgcgtcagccagggggccggctggtccctgcgggagaccgcctgcctcgggaagtcctacgcgcagatgtggcagctgatgtacttccaccgccgggacctgcgcctcgccgccaacgccatctgctccgcggtgcccgtggactgggtccccaccagccggacgacctggtccatccacgcccaccaccagtggatgaccaccgaggacatgctgagcgtgtggaaccgcgtgtggatcgaggagaacccctggatggaggacaagacgcacatctccagctggggcgacgtcccgtacctggggaagcgcgaggaccagtggtgcggctccctcatcggcctgaccgcccgggccacctgggccaccaacatccaggtggcgatcaaccaggtgcgccggctgatcgggaacgagaactacctcgactacatgaccagcatgaagcgcttcaagaacgagtccgaccccgagggcgccctgtggtga

SEQ ID NO: 8460 - RNA, 9879 nt, synthetic construct
  misc_feature 1..9879: note = derived and/or modified CDS sequence (opt1) from DENV-1__GQ868606__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagaccagcgcgggggtgaacatgtgcaccctcatcgccatggacctgggcgagttctgcgaggacacgatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagaccgtccagtacgagaacctgaagtacagcgtgatcgtgaccgtccacacgggcgaccagcaccaggtggggaacgagtccaccgagcacggcaccaccgcgaccatcacgccccaggcccccagcaccgagatccagctgaccgactacggggccctcaccctggactgcagcccccggacgggcctggacttcaacgagatggtcctcctgaccatgaaggagaagtcctggctggtgcacaagcagtggttcctcgacctgccgctgccctggaccagcggggcctccaccagccaggagacgtggaaccggaaggacctcctggtgaccttcaagaccgcccacgcgaagaagcaggaggtcgtggtgctgggctcccaggagggcgccatgcacaccgccctcacgggggccaccgagatccagaccagcggcaccacgaccatcttcgccgggcacctgaagtgccgcctgaagatggacaagctcaccctgaagggcatgtcctacgtcatgtgcaccgggagcttcaagctggagaaggaggtggcggagacgcagcacggcaccgtgctcgtccagatcaagtacgagggcaccgacgccccctgcaagatccccttctccacccaggacgagaagggggtgacgcagaacggccggctgatcaccgccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacacggcctgggacttcgggagcatcggcggcgtgttcacctccgtcgggaagctggtgcaccagatcttcggcaccgcctacggggtgctgttcagcggcgtctcctggaccatgaagatcgggatcggcgtgctcctgacgtggctgggcctcaacagccgctccaccagcctgtccatgacctgcatcgccgtggggctggtcaccctctacctgggcgtgatggtgcaggccgacagcgggtgcgtcatcaactggaagggccgggagctgaagtgcgggagcggcatcttcgtgacgaacgaggtgcacacctggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagttcaccgtggtggtcggggacgtggcgggcatcctggcccaggggaagaagatgatccggccccagcccatggagtacaagtactcctggaagtcctggggcaaggccaagatcatcggcgccgacgtgcagaacacgaccttcatcatcgacgggcccaacaccccggagtgccccgacgaccagcgcgcgtggaacatctgggaggtcgaggactacggcttcgggatcttcaccacgaacatctggctcaagctgcgggactcctacacccaggtgtgcgaccaccgcctgatgagcgccgccatcaaggactccaaggccgtgcacgccgacatgggctactggatcgagagcgagaagaacgagacctggaagctcgcgcgggcctccttcatcgaggtcaagacctgcatctggcccaagagccacacgctgtggtccaacggcgtgctggagagcgagatgatcatccccaagatctacgggggcccgatctcccagcacaaccaccgccccgggtacttcacccagaccgccggcccctggcacctcgggaagctggagctggacttcgacctctgcgagggcaccacggtggtcgtggacgagcactgcggcaaccgggggccgagcctgcgcaccaccaccgtgacgggcaagatcatccacgagtggtgctgccggtcctgcaccctgccgcccctgcgcttcaagggggaggacggctgctggtacgggatggagatccggcccgtcaaggagaaggaggagaacctggtcaagagcatggtgagcgccggctccggcgaggtcgacagcttctccctggggctcctgtgcatcagcatcatgatcgaggaggtgatgcgctcccggtggagccgcaagatgctgatgaccggcaccctcgccgtgttcttcctgctgatcatggggcagctcacgtggaacgacctgatccggctgtgcatcatggtcggcgcgaacgcctccgaccgcatggggatgggcaccacctacctcgccctgatggccaccttcaagatgcgcccgatgttcgccgtggggctcctgttccggcgcctgacgagccgggaggtgctgctcctgaccatcgggctgtccctcgtcgcgagcgtggagctgcccaactccctggaggagctcggcgacgggctggccatgggcatcatgatcctgaagctcctgaccgacttccagagccaccagctgtgggccaccctcctgtccctgacgttcatcaagaccaccttcagcctccactacgcctggaagaccatggcgatggtcctgtccatcgtgagcctgttccccctctgcctgtccacgaccagccagaagaccacctggctgcccgtgctcctgggctccctggggtgcaagccgctcacgatgttcctgatcgccgagaacaagatctggggccgcaagagctggcccctgaacgaggggatcatggccgtcggcatcgtgagcatcctcctgtccagcctgctcaagaacgacgtgcccctggccgggcccctgatcgccggcggcatgctcatcgcgtgctacgtcatctccgggagctccgccgacctgagcctggagaaggccgccgaggtgtcctgggaggaggaggccgagcacagcggcgcgtcccacaacatcctcgtggaggtccaggacgacgggaccatgaagatcaaggacgaggagcgggacgacaccctgaccatcctgctcaaggccaccctgctggccgtgagcggcgtgtacccgctctccatccccgccacgctgttcgtctggtacttctggcagaagaagaagcagcgcagcggggtgctgtgggacacccccagcccgcccgaggtggagcgggccgtcctcgacgacggcatctaccgcatcatgcagcggggcctgctggggcgcagccaggtgggcgtgggggtcttccaggagaacgtgttccacaccatgtggcacgtgacccggggcgcggtcctgatgtaccaggggaagcgcctcgagccctcctgggccagcgtgaagaaggacctgatctcctacggcggcgggtggcggctgcagggcagctggaacacgggggaggaggtgcaggtcatcgccgtggagcccggcaagaaccccaagaacgtgcagaccgcccccgggaccttcaagacctccgagggcgaggtcggcgccatcgcgctcgacttcaagcccgggacgagcggcagccccatcgtgaaccgcgaggggaagatcgtgggcctgtacggcaacggggtcgtgaccacctccggcacctacgtgagcgccatcgcccaggccaaggcgtcccaggaggggcccctgccggagatcgaggacgaggtcttccggaagcgcaacctcacgatcatggacctgcaccccggcagcgggaagacccggcgctacctgcccgccatcgtgcgggaggccatcaagcgcaagctccggaccctgatcctggccccgacccgcgtggtcgcctccgagatggcggaggccctcaagggcatgcccatccgctaccagacgaccgccgtcaagagcgagcacaccggcaaggagatcgtggacctgatgtgccacgccaccttcacgatgcggctgctctcccccgtccgcgtgcccaactacaacatgatcatcatggacgaggcccacttcaccgacccgagctccatcgcggcccgggggtacatcagcacccgcgtgggcatgggggaggccgccgccatcttcatgaccgcgacgccgcccggctccgtcgaggccttcccccagagcaacgccgtgatccaggacgaggagcgggacatcccggagcgctcctggaacagcgggtacgagtggatcaccgacttccccggcaagaccgtgtggttcgtcccctccatcaagagcggcaacgacatcgccaactgcctgcggaagaacgggaagcgcgtgatccagctgtcccggaagaccttcgacacggagtaccagaagaccaagaacaacgactgggactacgtggtcaccaccgacatcagcgagatgggcgcgaacttccgcgccgaccgggtgatcgacccccgccggtgcctcaagccggtgatcctgaaggacgggcccgagcgcgtcatcctggccggccccatgcccgtgacggtcgcctccgccgcgcagcggcgcgggcggatcggccgcaaccacaacaaggagggcgaccagtacatctacatggggcagccgctcaacaacgacgaggaccacgcccactggaccgaggccaagatgctgctggacaacatcaacacccccgagggcatcatccccgccctcttcgagcccgagcgggagaagtccgccgcgatcgacggggagtaccgcctgcgcggcgaggcccggaagaccttcgtggagctgatgcgccgcggggacctcccggtgtggctgagctacaaggtcgcctccgagggcttccagtacagcgaccgccggtggtgcttcgacggcgagcgcaacaaccaggtgctggaggagaacatggacgtggagatctggacgaaggagggggagcggaagaagctccgcccccggtggctggacgcccgcacctactccgaccccctggccctccgggagttcaaggagttcgcggccggccgccggagcgtctccggggacctgatcctggagatcggcaagctcccccagcacctgacccagcgcgcccagaacgccctggacaacctcgtgatgctgcacaacagcgagcagggcgggcgggcgtaccgccacgccatggaggagctgccggacaccatcgagacgctcatgctgctggccctcatcgccgtgctgaccggcggggtcaccctgttcttcctctccggccgggggctgggcaagaccagcatcggcctgctctgcgtgatggcctccagcgtgctgctgtggatggcgtccgtcgagccccactggatcgccgccagcatcatcctcgagttcttcctgatggtgctgctcatccccgagcccgaccgccagcggaccccgcaggacaaccagctggcctacgtggtcatcgggctcctcttcatgatcctgacggtggccgcgaacgagatgggcctgctcgagaccaccaagaaggacctggggatcggccacgtggccgtcgagaaccaccaccacgccgccatgctggacgtggacctccaccccgcctccgcgtggaccctgtacgccgtggccacgaccatcatcacccccatgatgcgccacaccatcgagaacacgaccgccaacatcagcctgaccgccatcgcgaaccaggccgccatcctcatggggctggacaagggctggccgatctccaagatggacatcggcgtccccctgctcgccctggggtgctacagccaggtgaaccccctgaccctcacggcggccgtgctgatgctggtcgcccactacgccatcatcggccccgggctccaggccaaggcgacccgggaggcccagaagcgcaccgccgccggcatcatgaagaacccgaccgtggacgggatcgtggccatcgacctggaccccgtcgtgtacgacgcgaagttcgagaagcagctgggccagatcatgctcctgatcctgtgcacgtcccagatcctcctgatgcgcaccacctgggccctgtgcgagagcatcaccctcgccacgggccccctgaccaccctgtgggaggggtcccccggcaagttctggaacaccacgatcgccgtgagcatggccaacatcttccgggggagctacctcgcgggcgccggcctggccttctccctgatgaagtccctcgggggcgggcgccggggcaccggggcccagggcgagaccctgggcgagaagtggaagcgccagctgaaccagctctccaagagcgagttcaacacctacaagcggtccgggatcatggaggtcgaccgcagcgaggcgaaggagggcctgaagcgcggggagacgaccaagcacgccgtgtcccgcggcaccgccaagctgcggtggttcgtggagcgcaacctcgtcaagccggaggggaaggtgatcgacctgggctgcggccgcggcgggtggagctactactgcgccgggctgaagaaggtgaccgaggtcaaggggtacacgaagggcgggcccggccacgaggagcccatccccatggccacctacgggtggaacctggtgaagctccactccggcaaggacgtgttcttcatcccgcccgagaagtgcgacaccctgctgtgcgacatcggggagagctcccccaaccccaccatcgaggagggccgcacgctccgggtcctgaagatggtggagccgtggctgcgcgggaaccagttctgcatcaagatcctcaacccctacatgcccagcgtggtcgagaccctggagcagatgcagcggaagcacggcggcatgctggtgcgcaaccccctctcccggaacagcacccacgagatgtactgggtgtcctgcgggaccggcaacatcgtcagcgcggtgaacatgacctcccgcatgctgctgaaccggttcacgatggcccaccgcaagccgacctacgagcgcgacgtggacctcggggccggcacccggcacgtcgccgtggagcccgaggtggccaacctggacatcatcggccagcgcatcgagaacatcaagcacgagcacaagagcacctggcactacgacgaggacaacccctacaagacgtgggcgtaccacgggtcctacgaggtcaagcccagcggcagcgcctccagcatggtgaacggggtcgtgaagctgctcaccaagccgtgggacgtgatccccatggtcacccagatcgccatgaccgacacgacccccttcggccagcagcgggtgttcaaggagaaggtggacacccgcacccccaaggccaagcgggggacggcccagatcatggaggtcaccgcgaagtggctgtggggcttcctgtcccgcaacaagaagccgcggatctgcacccgcgaggagttcacccggaaggtgcgcagcaacgccgccatcggcgccgtgttcgtcgacgagaaccagtggaactccgcgaaggaggccgtggaggacgagcggttctgggacctcgtgcaccgcgagcgggagctgcacaagcaggggaagtgcgccacgtgcgtctacaacatgatgggcaagcgcgagaagaagctgggggagttcggcaaggccaaggggagccgggccatctggtacatgtggctcggcgcgcgcttcctggagttcgaggccctgggcttcatgaacgaggaccactggttctcccgggagaacagcctctccggggtggagggcgaggggctgcacaagctgggctacatcctccgcgacatcagcaagatccccgggggcaacatgtacgccgacgacaccgccggctgggacacccggatcaccgaggacgacctgcagaacgaggccaagatcacggacatcatggagcccgagcacgcgctgctcgccaagtccatcttcaagctgacctaccagaacaaggtggtccgcgtgcagcggccggcccgcaacgggaccgtgatggacgtcatcagccgccgggaccagcgcggctccggccaggtgggcacctacggcctgaacacgttcaccaacatggaggcccagctcatccggcagatggagagcgaggggatcttctcccccagcgagctggagacccccaacctggccggccgcgtgctcgactggctggagaagcacggggtcgagcggctgaagcgcatggcgatctccggcgacgactgcgtggtgaagcccatcgacgaccggttcgccaccgccctcacggccctgaacgacatggggaaggtccgcaaggacatcccgcagtgggagcccagcaagggctggaacgactggcagcaggtccccttctgcagccaccacttccaccagctgatcatgaaggacggccgggagatcgtggtcccctgccgcaaccaggacgagctcgtggggcgggcccgcgtgtcccagggcgcggggtggagcctgcgggagaccgcctgcctgggcaagtcctacgcccagatgtggcagctcatgtacttccaccgccgggacctgcgcctggccgcgaacgccatctgcagcgccgtcccggtggactgggtgcccacctcccggaccacgtggagcatccacgcccaccaccagtggatgaccaccgaggacatgctctccgtctggaaccgcgtgtggatcgaggagaacccctggatggaggacaagacccacatcagctcctggggcgacgtgccctacctgggcaagcgggaggaccagtggtgcggcagcctgatcgggctcacggcccgcgcgacctgggccaccaacatccaggtcgccatcaaccaggtgcgccggctgatcggcaacgagaactacctggactacatgacctccatgaagcgcttcaagaacgagagcgacccggagggggccctctggtga

SEQ ID NO: 8461 - RNA, 9879 nt, synthetic construct
  misc_feature 1..9879: note = derived and/or modified CDS sequence (opt1) from DENV-1__FJ882539__SS-prME
  source 1..9879: mol_type = other RNA
agcgtgaccatgctgctcatgctgatgcccaccgccctggccttccacctcacgacccggggcggggagccccacatgatcgtgtccaagcaggagcggggcaagagcctgctgttcaagacctccgccggggtgaacatgtgcaccctcatcgccatggacctgggcgagttctgcgaggacaccatgacctacaagtgcccccgcatcaccgaggccgagcccgacgacgtggactgctggtgcaacgccaccgacacgtgggtcacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtcgagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagaccgtccagtacgagaacctgaagtacagcgtgatcgtgaccgtccacacgggcgaccagcaccaggtggggaacgagtccaccgagcacggcaccaccgcgaccatcacgccccaggcccccagcaccgagatccagctgaccgactacggggccctcaccctggactgcagcccccggacgggcctggacttcaacgagatggtcctcctgaccatgaaggagaagtcctggctggtgcacaagcagtggttcctcgacctgccgctgccctggaccagcggggccctcgcctcccaggagacctggaaccggaaggacctgctggtgacgttcaagaccgcgcacgccaagaagcaggaggtcgtggtgctcggcagccaggagggcgccatgcacaccgccctgaccggggccacggagatccagacctccggcaccaccacgatcttcgcggggcacctgaagtgccgcctcaagatggacaagctgaccctgaagggcatgagctacgtcatgtgcaccgggtccttcaagctcgagaaggaggtggccgagacccagcacggcacggtgctggtccagatcaagtacgagggcaccgacgccccctgcaagatccccttcagcacccaggacgagaaggggatcacccagaacggccggctgatcacggccaacccgatcgtgaccgacaaggagaagcccgtgaacatcgaggcggagccgcccttcggggagtcctacatcgtcatcggcgccggcgagaaggccctgaagctcagctggttcaagaaggggtccagcatcggcaagatgttcgaggccaccgcccgcggggcgcggcgcatggccatcctgggcgacaccgcctgggacttcgggtccatcggcggcgtgttcacgagcgtggggaagctggtccaccagatcttcggcaccgcctacggggtgctgttctccggcgtgagctggaccatgaagatcgggatcggcgtcctgctgacctggctcggcctgaactcccgcagcacgtccctgagcatgacctgcatcgccgtggggctcgtgaccctgtacctgggcgtcatggtgcaggcggactccgggtgcgtgatcaactggaagggccgggagctcaagtgcgggagcggcatcttcgtcaccaacgaggtgcacacgtggaccgagcagtacaagttccaggccgacagcccgaagcgcctgtccgccgccatcggcaaggcctgggaggagggggtgtgcggcatccggagcgcgacccgcctggagaacatcatgtggaagcagatctccaacgagctcaaccacatcctgctggagaacgacatgaagttcaccgtcgtggtgggggacgtcgccggcatcctcgcccaggggaagaagatgatccggccccagcccatggagtacaagtacagctggaagtcctggggcaaggccaagatcatcggcgcggacgtgcagaacaccacgttcatcatcgacgggcccaacaccccggagtgccccgacgaccagcgcgcctggaacatctgggaggtggaggactacggcttcgggatcttcaccaccaacatctggctgaagctgcgggacagctacacgcaggtctgcgaccaccgcctcatgtccgccgccatcaaggacagcaaggccgtgcacgcggacatgggctactggatcgagtccgagaagaacgagacctggaagctggcccgggccagcttcatcgaggtgaagacctgcatctggcccaagtcccacaccctgtggagcaacggcgtcctcgagtccgagatgatcatccccaagatctacgggggcccgatcagccagcacaaccaccgccccgggtacttcacgcagaccgccggcccctggcacctggggaagctggagctcgacttcgacctgtgcgagggcaccaccgtggtggtcgacgagcactgcggcaaccgggggccgtccctgcgcacgaccaccgtgaccggcaagatcatccacgagtggtgctgccggagctgcacgctgccgcccctccgcttcaagggggaggacggctgctggtacgggatggagatccggcccgtgaaggagaaggaggagaacctggtcaagtccatggtgagcgccggcagcggcgaggtggactccttcagcctcgggctgctgtgcatctccatcatgatcgaggaggtcatgcgcagccggtggtcccgcaagatgctcatgaccggcaccctggcggtgttcttcctgctcatcatggggcagctgacctggaacgacctgatccggctctgcatcatggtgggcgccaacgccagcgaccgcatggggatgggcacgacctacctggccctgatggccaccttcaagatgcgcccgatgttcgcggtcggcctcctgttccggcgcctgacctcccgggaggtgctcctgctgacgatcgggctcagcctggtggcctccgtcgagctgcccaacagcctcgaggagctgggcgacgggctggccatgggcatcatgatcctcaagctgctgaccgacttccagtcccaccagctctgggccaccctgctgagcctcaccttcatcaagacgaccttctccctgcactacgcgtggaagaccatggccatggtgctgagcatcgtctccctcttccccctgtgcctgagcaccacgtcccagaagaccacctggctccccgtgctgctgggcagcctcgggtgcaagccgctgaccatgttcctgatcgccgagaacaagatctggggccgcaagtcctggcccctcaacgaggggatcatggccgtgggcatcgtcagcatcctgctgagctccctcctgaagaacgacgtgcccctggccgggcccctcatcgcgggcggcatgctgatcgcctgctacgtgatcagcgggtccagcgccgacctgtccctcgagaaggccgccgaggtcagctgggaggaggaggcggagcactccggcgccagccacaacatcctggtggaggtgcaggacgacgggacgatgaagatcaaggacgaggagcgggacgacaccctgaccatcctcctgaaggccaccctgctcgccgtctccggcgtgtacccgctgagcatccccgccaccctgttcgtgtggtacttctggcagaagaagaagcagcgctccggggtcctctgggacacgcccagcccgcccgaggtggagcgggcggtgctggacgacggcatctaccgcatcatgcagcggggcctgctggggcgctcccaggtcggcgtgggggtgttccaggagaacgtcttccacaccatgtggcacgtgacccggggcgccgtgctcatgtaccaggggaagcgcctggagcccagctgggcctccgtcaagaaggacctgatcagctacggcggcgggtggcggctccagggctcctggaacaccggggaggaggtccaggtgatcgccgtcgagcccggcaagaaccccaagaacgtgcagacggcccccgggaccttcaagaccagcgagggcgaggtgggcgcgatcgccctggacttcaagcccgggacctccggcagccccatcgtcaaccgcgaggggaagatcgtgggcctgtacggcaacggggtggtcacgaccagcggcacctacgtgtccgccatcgcccaggcgaaggccagccaggaggggcccctcccggagatcgaggacgaggtgttccggaagcgcaacctgaccatcatggacctgcaccccggctccgggaagacgcggcgctacctccccgccatcgtccgggaggccatcaagcgcaagctgcggaccctgatcctcgccccgacccgcgtggtggcgagcgagatggccgaggccctgaagggcatgcccatccgctaccagaccacggccgtcaagtccgagcacaccggcaaggagatcgtggacctgatgtgccacgccaccttcaccatgcggctcctgagccccgtgcgcgtccccaactacaacatgatcatcatggacgaggcgcacttcacggacccgtccagcatcgccgcccgggggtacatctccacccgcgtgggcatgggggaggccgccgcgatcttcatgaccgccacgccgcccggcagcgtggaggccttcccccagtccaacgccgtcatccaggacgaggagcgggacatcccggagcgcagctggaactccgggtacgagtggatcacggacttccccggcaagaccgtgtggttcgtgcccagcatcaagtccggcaacgacatcgcgaactgcctgcggaagaacgggaagcgcgtcatccagctcagccggaagaccttcgacaccgagtaccagaagacgaagaacaacgactgggactacgtggtgaccaccgacatctccgagatgggcgccaacttccgcgccgaccgggtcatcgacccccgccggtgcctgaagccggtgatcctgaaggacgggcccgagcgcgtgatcctcgccggccccatgcccgtcaccgtggccagcgcggcccagcggcgcgggcggatcggccgcaaccacaacaaggagggcgaccagtacatctacatggggcagccgctgaacaacgacgaggaccacgcccactggacggaggccaagatgctgctcgacaacatcaacacccccgagggcatcatccccgccctgttcgagcccgagcgggagaagtccgcggccatcgacggggagtaccgcctgcgcggcgaggcccggaagaccttcgtcgagctcatgcgccgcggggacctgccggtgtggctgagctacaaggtggccagcgagggcttccagtactccgaccgccggtggtgcttcgacggcgagcgcaacaaccaggtcctcgaggagaacatggacgtggagatctggaccaaggagggggagcggaagaagctgcgcccccggtggctggacgcccgcacgtacagcgaccccctcgcgctgcgggagttcaaggagttcgccgccggccgccggtccgtgagcggggacctgatcctcgagatcggcaagctgccccagcacctgacccagcgcgcccagaacgcgctcgacaacctggtcatgctgcacaactccgagcagggcgggcgggcctaccgccacgccatggaggagctcccggacaccatcgagaccctgatgctgctcgccctgatcgccgtgctgacgggcggggtgaccctcttcttcctgagcggccgggggctgggcaagacctccatcggcctcctgtgcgtcatggcgagctccgtgctgctctggatggccagcgtggagccccactggatcgccgcctccatcatcctggagttcttcctgatggtcctcctgatccccgagcccgaccgccagcggaccccgcaggacaaccagctggcctacgtggtgatcgggctcctgttcatgatcctgaccgtcgcggccaacgagatgggcctcctggagacgaccaagaaggacctggggatcggccacgtggccgtggagaaccaccaccacgccgccatgctcgacgtcgacctgcaccccgcgagcgcctggaccctgtacgccgtggccaccacgatcatcacccccatgatgcgccacaccatcgagaacaccacggccaacatctccctcaccgcgatcgccaaccaggccgccatcctgatggggctggacaagggctggccgatcagcaagatggacatcggcgtgcccctcctggcgctggggtgctactcccaggtcaaccccctcaccctgaccgccgccgtgctgatgctcgtggcccactacgccatcatcggccccgggctgcaggcgaaggccacgcgggaggcccagaagcgcaccgccgccggcatcatgaagaacccgaccgtcgacgggatcgtggcgatcgacctggaccccgtggtctacgacgccaagttcgagaagcagctcggccagatcatgctgctgatcctctgcaccagccagatcctgctgatgcgcacgacctgggccctctgcgagtccatcaccctggccaccggccccctgacgaccctctgggaggggagccccggcaagttctggaacaccaccatcgccgtgtccatggcgaacatcttccgggggagctacctggccggcgccggcctggccttcagcctcatgaagtccctcgggggcgggcgccgggggacgggggcgcagggcgagaccctgggcgagaagtggaagcgccagctcaaccagctgagcaagtccgagttcaacacctacaagcggagcgggatcatggaggtggaccgctccgaggccaaggagggcctgaagcgcggggagaccacgaagcacgccgtcagccgcggcaccgccaagctccggtggttcgtggagcgcaacctggtgaagccggaggggaaggtcatcgacctgggctgcggccgcggcgggtggtcctactactgcgccgggctgaagaaggtgaccgaggtgaaggggtacaccaagggcggccccggccacgaggagcccatccccatggcgacgtacgggtggaacctcgtcaagctgcacagcggcaaggacgtgttcttcatcccgcccgagaagtgcgacaccctgctctgcgacatcggggagtccagccccaaccccaccatcgaggagggccgcaccctgcgggtgctgaagatggtcgagccgtggctccgcgggaaccagttctgcatcaagatcctgaacccctacatgccctccgtggtggagacgctggagcagatgcagcggaagcacggcggcatgctcgtccgcaaccccctgagccggaactccacccacgagatgtactgggtgagctgcgggaccggcaacatcgtgtccgccgtcaacatgaccagccgcatgctgctcaaccggttcaccatggcccaccgcaagccgacgtacgagcgcgacgtggacctgggggccggcacccggcacgtggccgtcgagcccgaggtggcgaacctggacatcatcggccagcgcatcgagaacatcaagcacgagcacaagtccacctggcactacgacgaggacaacccctacaagacctgggcctaccacgggagctacgaggtgaagccctccggcagcgccagctccatggtcaacggggtggtcaagctcctgacgaagccgtgggacgtgatccccatggtgacccagatcgccatgaccgacaccacgcccttcggccagcagcgggtcttcaaggagaaggtggacacccgcacccccaaggccaagcgggggaccgcgcagatcatggaggtgacggccaagtggctgtggggcttcctcagccgcaacaagaagccgcggatctgcacccgcgaggagttcacccggaaggtccgctccaacgccgccatcggcgcggtgttcgtggacgagaaccagtggaacagcgccaaggaggccgtcgaggacgagcggttctgggacctggtgcaccgcgagcgggagctgcacaagcaggggaagtgcgcgacctgcgtgtacaacatgatgggcaagcgcgagaagaagctcggggagttcggcaaggccaaggggtcccgggcgatctggtacatgtggctgggcgcccgcttcctggagttcgaggccctcggcttcatgaacgaggaccactggttcagccgggagaactccctgagcggggtcgagggcgaggggctgcacaagctcggctacatcctgcgcgacatctccaagatccccgggggcaacatgtacgccgacgacacggccggctgggacacccggatcaccgaggacgacctgcagaacgaggcgaagatcaccgacatcatggagcccgagcacgccctcctggccaagagcatcttcaagctgacgtaccagaacaaggtggtgcgcgtccagcggccggccaagaacgggaccgtgatggacgtgatctcccgccgcgaccagcggggcagcgggcaggtcggcacctacggcctcaacaccttcacgaacatggaggcccagctgatccgccagatggagtccgaggggatcttcagcccctccgagctggagacccccaacctcgcgggccgggtgctggactggctggagaagcacggggtggagcgcctcaagcggatggccatcagcggcgacgactgcgtcgtgaagcccatcgacgaccgcttcgccaccgccctgaccgccctgaacgacatggggaaggtgcggaaggacatcccgcagtgggagccctccaagggctggaacgactggcagcaggtccccttctgcagccaccacttccaccagctcatcatgaaggacggccgcgagatcgtggtgccctgccggaaccaggacgagctggtcgggcgcgcgcgggtgagccagggcgccgggtggtccctgcgcgagacggcctgcctcggcaagagctacgcccagatgtggcagctgatgtacttccaccggcgcgacctgcggctcgcggccaacgccatctgctccgccgtgccggtcgactgggtgcccaccagccgcaccacctggtccatccacgcccaccaccagtggatgacgaccgaggacatgctgagcgtgtggaaccgggtctggatcgaggagaacccctggatggaggacaagacccacatctccagctggggcgacgtgccctacctgggcaagcgcgaggaccagtggtgcggctccctcatcgggctgaccgcgcgggccacgtgggccaccaacatccaggtggccatcaaccaggtccgccgcctgatcggcaacgagaactacctcgactacatgaccagcatgaagcggttcaagaacgagtccgacccggagggggccctgtggtga

SEQ ID NO: 8462 - RNA, 9879 nt, synthetic construct
  misc_feature 1..9879: note = derived and/or modified CDS sequence (opt1) from DENV-1__FJ882541__SS-prME
  source 1..9879: mol_type = other RNA
agcgtgaccatgctgctcatgctgatccccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgaggtggagcccgacgacgtggactgctggtgcaacaccacggacacctgggtgacctacgggacctgcagccagacgggcgagcaccggcgcgacaagcggagcgtggccctcgcgccccacgtcggcctggggctggagacccgcgccgagacctggatgagctccgagggcgcgtggaagcagatccagaaggtggagacctgggccctccggcaccccgggttcacggtgatcgccctgttcctggcccacgcgatcggcaccagcatcacccagaaggggatcatcttcatcctcctgatgctggtcaccccctccatggccatgcgctgcgtgggcatcggcagccgggacttcgtggaggggctctccggcgccacgtgggtcgacgtggtgctggagcacgggagctgcgtcaccaccatggccaaggacaagcccaccctggacatcgagctcctgaagacggaggtgaccaaccccgccgtgctgcgcaagctctgcatcgaggcgaagatctccaacaccaccacggacagccggtgcccgacccagggcgaggccaccctggtcgaggagcaggacgccaacttcgtgtgccgccggaccttcgtggaccgcggctgggggaacggctgcgggctgttcggcaaggggtccctcatcacgtgcgccaagttcaagtgcgtcaccaagctggagggcaagatcgtgcagtacgagaacctgaagtacagcgtgatcgtcaccgtgcacaccggcgaccagcaccaggtcgggaacgagtccacggagcacggcaccaccgccaccatcacgccccaggcgcccacgagcgagatccagctcaccgactacggggccctgaccctggactgcagcccccggaccggcctcgacttcaacgagatggtgctgctgacgatgaaggggaagtcctggctcgtgcacaagcagtggttcctggacctgcccctcccctggaccagcggcgcctccaccagccaggagacctggaaccgccaggacctgctggtcacgttcaagaccgcccacgccaagaagcaggaggtggtggtcctcggctcccaggagggggcgatgcacaccgccctgaccggcgccacggagatccagaccagcgggaccaccacgatcttcgccggccacctgaagtgccggctcaagatggacaagctgaccctgaaggggatgtcctacgtgatgtgcaccggcagcttcaagctcgagaaggaggtggccgagacccagcacggcacggtcctggtgcagatcaagtacgaggggaccgacgcgccctgcaagatccccttctccacccaggacgagaagggcgtgacccagaacgggcgcctgatcacggccaacccgatcgtcaccgacaaggagaagcccgtgaacatcgaggccgagccgcccttcggcgagagctacatcgtgatcggcgccggggagaaggcgctgaagctctcctggttcaagaagggcagctccatcgggaagatgttcgaggccaccgcccggggcgcccgccggatggccatcctgggggacaccgcgtgggacttcggcagcatcggcggggtcttcacgtccgtgggcaagctggtgcaccagatcttcgggaccgcctacggcgtcctcttcagcggggtgtcctggaccatgaagatcggcatcggcgtgctgctgacctggctcgggctgaacagccgctccacgagcctgtccatgacctgcatcgccgtcggcctcgtgaccctgtacctgggggtgatggtccaggccgacagcggctgcgtgatcaactggaaggggcgcgagctcaagtgcggcagcggcatcttcgtgaccaacgaggtccacacgtggaccgagcagtacaagttccaggccgactccccgaagcggctgagcgcggccatcgggaaggcctgggaggagggcgtgtgcgggatccgctccgccacccggctggagaacatcatgtggcgccagatcagcaacgagctcaaccacatcctgctggagaacgacatgaagttcaccgtggtcgtgggcgacgtggtcgggatcctcgcccagggcaagaagatgatccggccccagcccatggagcacaagtactcctggaagtcctggggcaaggcgaagatcatcggggccgacgtgcagaacaccacgttcatcatcgacggccccaacaccccggagtgccccgacgaccagcgcgcctggaacatctgggaggtggaggactacgggttcggcatcttcaccaccaacatctggctgaagctgcgggactcctacacgcaggtctgcgaccaccgcctcatgagcgccgcgatcaaggactccaaggccgtgcacgccgacatgggctactggatcgagagcgagaagaacgagacctggaagctggcccgggcctccttcatcgaggtgaagacctgcatctggcccaagagccacaccctgtggtccaacggggtcctcgagagcgagatgatcatccccaagatctacggcgggccgatctcccagcacaactaccgccccggctacttcacgcagaccgcggggccctggcacctgggcaagctggagctcgacttcgacctgtgcgagggcaccaccgtggtggtcgacgagcactgcgggaaccggggcccgagcctgcgcacgaccaccgtgaccgggaagatcatccacgagtggtgctgccggtcctgcacgctgccgcccctccgcttcaagggcgaggacgggtgctggtacggcatggagatccggcccgtgaaggagaaggaggagaacctggtcaagagcatggtgagcgccggctccggggaggtggacagcttctccctcggcctgctgtgcatcagcatcatgatcgaggaggtcatgcgctcccggtggagccgcaagatgctcatgaccgggaccctggccgtgttcttcctgctcatcatgggccagctgacctggaacgacctgatccggtcctgcatcatggtgggggccaacgccagcgaccgcatgggcatgggcacgacctacctcgcgctgatggccaccttcaagatgcgcccgatgttcgccgtcgggctcctgttccggcgcctgacctcccgggaggtgctgctcctgacgatcggcctgagcctcgtcgcctccgtggagctgcccaacagcctggaggagctcggggacggcctggccatgggcatcatgatcctgaagctcctgaccgacttccagtcctaccagctgtgggcgaccctcctgagcctgaccttcatcaagacgaccttctccctccactacgcctggaagaccatggccatggtgctgagcatcgtctccctgctccccctgtgcctgagcaccacgtcccagaagaccacctggctccccgtgctgctggggagcctcggctgcaagccgctgaccatgttcctgatcgccgagaacaagatctgggggcgcaagagctggcccctcaacgagggcatcatggcggtggggatcgtctccatcctgctgagctccctcctgaagaacgacgtgcccctggccggccccctcatcgccggcgggatgctgatcgcctgctacgtgatcagcggctccagcgccgacctgtccctcgagaaggcggccgaggtcagctgggaggaggaggccgagcactccggggccagccacaacatcctggtggaggtgcaggacgacggcacgatgaagatcaaggacgaggagcgggacgacaccctgaccatcctcctgaaggccaccctgctcgcggtctccggggtgtacccgctgagcatccccgccaccctgttcgtgtggtacttctggcagaagaagaagcagcgctccggcgtcctctgggacacgcccagcccgcccgaggtggagcgggccgtgctggacgacggcatctaccgcatcatgcagcgggggctgctgggccgctcccaggtcggggtgggcgtgttccaggagaacgtcttccacaccatgtggcacgtgacccgcggggccgtgctcatgtaccagggcaagcgcctggagcccagctgggcctccgtcaagaaggacctgatcagctacggcgggggctggcggctccaggggtcctggaacaccggcgaggaggtccaggtgatcgcggtcgagcccgggaagaaccccaagaacgtgcagacggcccccggcaccttcaagacccccgagggcgaggtgggggccatcgccctggacttcaagcccggcaccagcgggagccccatcgtcaaccgcgagggcaagatcgtgggcctgtacgggaacggcgtggtcacgacctccgggacctacgtgagcgccatcgcgcaggccaaggcctcccaggagggcccgctccccgagatcgaggacgaggtgttccggaagcgcaacctgaccatcatggacctgcaccccgggagcggcaagacgcggcgctacctcccggccatcgtccgggaggcgatcaagcgcaagctgcggaccctgatcctcgcccccacccgcgtggtggcctccgagatggccgaggccctgaagggcatgcccatccgctaccagaccacggcggtcaagagcgagcacaccgggcgggagatcgtggacctgatgtgccacgccaccttcaccatgcgcctcctgtcccccgtgcgggtcccgaactacaacatgatcatcatggacgaggcccacttcacggaccccagctccatcgccgcccgcggctacatcagcacccgggtggggatgggcgaggcggccgccatcttcatgaccgccacgccgcccgggtccgtggaggccttcccgcagagcaacgcggtcatccaggacgaggagcgcgacatccccgagcggtcctggaacagcggctacgagtggatcacggacttccccggcaagaccgtgtggttcgtgccctccatcaagagcgggaacgacatcgccaactgcctgcgcaagaacggcaagcgggtcatccagctctcccgcaagaccttcgacaccgagtaccagaagacgaagaacaacgactgggactacgtggtgaccaccgacatcagcgagatgggggccaacttccgggccgaccgcgtcatcgacccgcggcgctgcctgaagcccgtgatcctgaaggacggccccgagcgggtcatcctcgcggggcccatgccggtgaccgtggcctccgccgcccagcgccggggccgcatcggccggaaccacaacaaggagggggaccagtacatctacatgggccagcccctgaacaacgacgaggaccacgcccactggacggaggcgaagatgctgctcgacaacatcaacacccccgaggggatcatccccgccctgttcgagccggagcgcgagaagtccgccgccatcgacggcgagtaccgcctgcgcggggaggcccgcaagaccttcgtcgagctcatgcggcgcggcgacctgcccgtgtggctgagctacaaggtggcgtccgagggcttccagtacagcgaccggcgctggtgcttcgacggggagcggaacaaccaggtcctcgaggagaacatggacgtggagatctggaccaaggagggcgagcgcaagaagctgcggccccgctggctggacgcccggacgtactccgaccccctcgccctgcgcgagttcaaggagttcgccgccgggcggcgcagcgtgtccggcgacctgatcctcgagatcggcaagctgccgcagcacctgacccagcgggcgcagaacgccctcgacaacctggtcatgctgcacaacagcgagcagggcgggcgcgcctaccggcacgccatggaggagctccccgacaccatcgagaccctgatgctgctcgcgctgatcgccgtgctgaccggcggggtgaccctcttcttcctgtccgggcgcgggctgggcaagaccagcatcgggctcctgtgcgtcatggcctccagcgccctgctctggatggcctccgtggagccccactggatcgcggccagcatcatcctggagttcttcctgatggtgctcctgatccccgagccggaccggcagcgcacgccccaggacaaccagctggcctacgtcgtgatcggcctcctgttcatgatcctgaccgtggccgccaacgagatggggctcctggagacgaccaagaaggacctgggcatcgggcacgtcgcggtggagaaccaccaccacgccaccatgctcgacgtggacctgcaccccgcctccgcctggaccctgtacgccgtcgcgacgaccatcatcaccccgatgatgcggcacaccatcgagaacacgaccgccaacatcagcctcaccgccatcgccaaccaggccgcgatcctgatgggcctggacaagggctggcccatctccaagatggacatcggggtgcccctcctggccctgggctgctacagccaggtgaaccccctcaccctgacggccgccgtcctgatgctcgtggcgcactacgccatcatcgggccgggcctgcaggccaaggccacccgcgaggcccagaagcgcaccgcggccgggatcatgaagaaccccaccgtggacggcatcgtcgccatcgacctggaccccgtggtgtacgacgccaagttcgagaagcagctcggccagatcatgctgctgatcctctgcacgtcccagatcctgctgatgcggaccacctgggccctctgcgagagcatcaccctggcgacggggcccctgaccaccctctgggagggctccccggggaagttctggaacaccacgatcgccgtcagcatggccaacatcttccgcggcagctacctggccggcgccgggctggcgttctccctcatgaagtccctgggcgggggccggcgcgggaccggcgcccagggcgagaccctgggggagaagtggaagcggcagctcaaccagctgtccaagagcgagttcaacacctacaagcgctccggcatcatggaggtggaccggagcgaggccaaggaggggctgcgccggggcgagacgaccaagcacgccgtgtcccgcgggaccgcgaagctccggtggttcgtcgagcgcaacctggtgaagcccgagggcaaggtgatcgacctgggctgcgggcggggcgggtggagctactactgcgccggcctgaagaaggtcaccgaggtgaaggggtacacgaagggcggccccgggcacgaggagcccatcccgatggccacctacggctggaacctcgtgaagctgcactccgggaaggacgtcttcttcatcccgcccgagaagtgcgacaccctgctctgcgacatcggcgagagctcccccaacccgaccatcgaggaggggcgcacgctgcgggtgctgaagatggtggagccctggctccgcggcaaccagttctgcatcaagatcctgaacccctacatgcccagcgtcgtggagaccctggagcagatgcagcggaagcacggcgggatgctcgtgcgcaacccgctgtcccggaacagcacccacgagatgtactgggtctcctgcggcaccgggaacatcgtgagcgccgtgaacatgacctcccgcatgctgctcaaccgcttcacgatggcccaccggaagcccacctacgagcgcgacgtcgacctgggcgcgggcacccggcacgtggccgtggagcccgaggtcgccaacctggacatcatcgggcagcgcatcgagaacatcaagcacgagcacaagagcacctggcactacgacgaggacaacccctacaagacgtgggcctaccacggctcctacgaggtgaagccgagcgggagcgcctccagcatggtcaacggcgtggtgaagctcctgaccaagccctgggacgtcatccccatggtgacccagatcgcgatgaccgacacgacccccttcgggcagcagcgggtgttcaaggagaaggtcgacacccgcaccccgaaggccaagcggggcacggcccagatcatggaggtgaccgcccgctggctgtggggcttcctctcccggaacaagaagccccgcatctgcacccgggaggagttcacccgcaaggtgcggagcaacgccgcgatcggggccgtcttcgtggacgagaaccagtggaactccgccaaggaggccgtggaggacgagcgcttctgggacctggtccaccgggagcgcgagctgcacaagcagggcaagtgcgcgacgtgcgtgtacaacatgatggggaagcgggagaagaagctcggcgagttcgggaaggccaagggcagccgcgccatctggtacatgtggctgggcgcccggttcctggagttcgaggccctcgggttcatgaacgaggaccactggttctcccgcgagaacagcctgtccggcgtggagggggagggcctgcacaagctcgggtacatcctgcgggacatcagcaagatccccggcggcaacatgtacgcggacgacaccgccgggtgggacacccgcatcaccgaggacgacctgcagaacgaggccaagatcacggacatcatggagccggagcacgccctcctggccacctccatcttcaagctgacctaccagaacaaggtcgtgcgcgtgcagcggcccgcgcgcaacggcaccgtcatggacgtgatcagccggcgcgaccagcgggggtccggccaggtgggcacgtacgggctcaacaccttcaccaacatggaggcccagctgatccgccagatggagagcgagggcatcttctcccccagcgagctggagacccccaacctcgccgagcgggtcctggactggctggagaagcacggggtggagcgcctcaagcggatggccatctccggcgacgactgcgtggtcaagccgatcgacgaccgcttcgccacggcgctgagcgccctgaacgacatggggaaggtgcggaaggacatcccccagtgggagcccagcaagggctggaacgactggcagcaggtccccttctgctcccaccacttccaccagctcatcatgaaggacggccgcgagatcgtcgtgccgtgccggaaccaggacgagctggtggggcgcgcccgggtcagccagggcgccgggtggtccctgcgcgagaccgcctgcctcggcaagagctacgcgcagatgtggcagctgatgtacttccaccggcgcgacctgcggctcgccgccaacgccatctgctccgcggtgcccgtggactgggtccccaccagccgcaccacgtggtccatccacgcccaccaccagtggatgaccaccgaggacatgctgagcgtgtggaaccgcgtgtggatcgaggagaacccctggatggaggacaagacccacatctccagctggggcgacgtcccgtacctgggcaagcgggaggaccagtggtgcggctccctcatcgggctgacggcccgcgccacctgggccaccaacatccaggtggcgatcaaccaggtgcggcgcctgatcggcaacgagaactacctcgactacatgaccagcatgaagcggttcaagaacgagtccgaccccgagggggccctgtggtga

SEQ ID NO: 8463 - RNA, 9879 nt, synthetic construct
  misc_feature 1..9879: note = derived and/or modified CDS sequence (opt1) from DENV-1__FJ882542__SS-prME
  source 1..9879: mol_type = other RNA
agcgtgaccatgctgctcatgctgatgcccaccgccctggccttccacctcaccacccggggcggggagccccacatgatcgtgaccaagcaggagcgggggaagtccctgctgttcaagaccagcgcgggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtgacctacgggacctgctcccagacgggcgagcaccggcgcgacaagcggagcgtggccctcgcgccccacgtgggcctggggctggagacccgcaccgagacctggatgtccagcgagggcgcctggaagcagatccagcgggtggagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccgtgggcggcgtgttcaccagcgtcgggaagctggtgcaccagatcttcggcaccgcctacggggtcctgttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggccgactccgggtgcgtcatcaactggaagggccgggagctcaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctggagaacatcatgtggaagcagatctccaacgagctcaaccacatcctgctggagaacgacatgaagttcaccgtggtggtcggggacgtggtgggcatcctcgcgcaggggaagaagatgatccggccccagcccatggagcacaagtacagctggaagtcctggggcaaggccaagatcatcggcgccgacgtccagaacacgaccttcatcatcgacgggcccagcaccccggagtgccccgacgaccagcgcgcctggaacatctgggaggtggaggactacggcttcgggatcttcaccacgaacatctggctgaagctgcgggactcctacacccaggtgtgcgaccaccgcctcatgagcgcggccatcaaggactccaaggccgtccacgccgacatgggctactggatcgagagcgagaagaacgagacctggaagctggcccgggcgtccttcatcgaggtgaagacctgcatctggcccaagagccacacgctgtggtccaacggcgtgctcgagagcgagatgatcatccccaagatctacgggggcccgatctcccagcacaactaccgccccgggtacttcacccagaccgccggcccctggcacctggggaagctggagctcgacttcgacctgtgcgagggcaccacggtcgtggtggacgagcactgcggcaaccgggggccgagcctgcgcaccaccaccgtcacgggcaagatcatccacgagtggtgctgccggtcctgcaccctgccgcccctccgcttcaagggggaggacggctgctggtacgggatggagatccggcccgtgaaggagaaggaggagaacctggtgaagtccatggtcagcgccggctccggcgaggtggacagcttctccctcgggctgctgtgcatcagcatcatgatcgaggaggtgatgcgctcccggtggagccgcaagatgctcatgaccggcaccctggccgtcttcctgctcctgatcatggggcagctgacgtggaacgacctcatccggctgtgcatcatggtgggcgccaacgcgtccgaccgcatggggatgggcaccacctacctggccctcatggccaccttcaagatgcgcccgatgttcgccgtgggcctgctgttccggcgcctcacgagccgggaggtcctgctgctcaccatcgggctgtccctggtggccagcgtcgagctccccaactccctggaggagctgggcgacgggctcgcgatgggcatcatgatcctgaagctgctcaccgacttccagagccaccagctgtgggccaccctgctctccctgacgttcatcaagaccaccctgagcctccactacgcctggaagaccatggccatggtgctgtccatcgcgagcctgttccccctctgcctgtccacgaccagccagaagaccacctggctgcccgtgctcctgggctccctggggtgcaagccgctcacgatgttcctgatcaccgagaccaagatctggggccgcaagagctggcccctgaacgaggggatcatggccgtcggcgtggtgagcatcctcctgtccagcctgctcaagaacgacgtccccctggccgggcccctgatcgccggcggcatgctcatcgcctgctacgtgatctccgggagctccgcggacctgagcctggagaaggccgccgaggtgtcctgggaggaggaggccgagcacagcggcgcctcccacaacatcctcgtcgtggtgcaggacgacgggaccatgaagatcaaggacgaggagcgggacgacaccctgacgatcctgctcaaggcgaccctgctggccgtcagcggcgtgtacccgctctccatccccgccaccctgttcgtgtggtacttctggcagaagaagaagcagcgcagcggggtcctgtgggacacccccagcccgcccgaggtggagcgggccgtgctggacgacggcatctaccgcatcatgcagcggggcctcctggggcgcagccaggtcggcgtgggggtgttccaggagaacgtcttccacacgatgtggcacgtgacccggggcgccgtgctgatgtaccaggggaagcgcctcgagccctcctgggcgagcgtcaagaaggacctgatctcctacggcggcgggtggcggctgcagggcagctggaacaccggggaggaggtccaggtgatcgccgtcgagcccggcaagaaccccaagaacgtgcagaccgcccccgggacgttcaagacccccgagggcgaggtgggcgccatcgccctcgacttcaagcccgggacctccggcagccccatcgtcaaccgcgaggggaagatcgtgggcctgtacggcaacggggtggtcaccacgagcggcacctacgtgtccgcgatcgcccaggccaaggccagccaggaggggccgctgcccgagatcgaggacgaggtgttccggaagcgcaacctcaccatcatggacctgcaccccggctccgggaagacccggcgctacctgccggcgatcgtccgggaggccatcaagcgcaagctccggacgctgatcctggcccccacccgcgtggtggccagcgagatggccgaggcgctcaagggcatgcccatccgctaccagaccaccgccgtcaagtccgagcacacgggcaaggagatcgtggacctgatgtgccacgccaccttcaccatgcggctgctcagccccgtgcgcgtcccgaactacaacatgatcatcatggacgaggcccacttcaccgacccctccagcatcgccgcgcgggggtacatctccacgcgcgtgggcatgggggaggccgccgccatcttcatgaccgccacgccgcccggcagcgtggaggcgttcccgcagtccaacgccgtcatccaggacgaggagcgggacatccccgagcgcagctggaactccgggtacgagtggatcaccgacttccccggcaagacggtgtggttcgtgcccagcatcaagtccggcaacgacatcgccaactgcctgcggaagaacgggaagcgcgtcatccagctgagccggaagaccttcgacaccgagtaccagaagaccaagaacaacgactgggactacgtggtgacgaccgacatctccgagatgggcgccaacttccgcgcggaccgggtcatcgacccgcgccggtgcctcaagcccgtgatcctgaaggacgggcccgagcgcgtcatcctggccggccccatgccggtgaccgtggccagcgccgcccagcggcgcgggcggatcggccgcaaccacaacaaggagggcgaccagtacatctacatggggcagcccctcaacaacgacgaggaccacgcgcactggaccgaggccaagatgctgctggacaacatcaacacgcccgagggcatcatccccgccctcttcgagccggagcgggagaagtccgccgccatcgacggggagtaccgcctgcgcggcgaggcgcggaagaccttcgtcgagctgatgcgccgcggggacctccccgtgtggctgagctacaaggtggccagcgagggcttccagtactccgaccgccggtggtgcttcgacggcgagcgcaacaaccaggtcctggaggagaacatggacgtggagatctggaccaaggagggggagcggaagaagctccgcccccggtggctggacgcccgcacctacagcgaccccctggccctccgggagttcaaggagttcgccgcgggccgccggtccgtgagcggggacctgatcctggagatcggcaagctcccgcagcacctgacgcagcgcgcccagaacgccctggacaacctcgtcatgctgcacaactccgagcagggcgggcgggcctaccgccacgcgatggaggagctgcccgacaccatcgagaccctcatgctgctggccctcatcgccgtgctgaccggcgggatgaccctgttcttcctcagcggccgggggctgggcaagacgtccatcggcctgctctgcgtgatggccagctccgtcctgctgtggatggccagcgtggagccccactggatcgcggcctccatcatcctcgagttcttcctgatggtgctgctcatccccgagccggaccgccagcggacgccccaggacaaccagctggcctacgtcgtgatcgggctcctcttcatgatcctgaccgtggccgccaacgagatgggcctgctcgagaccacgaagaaggacctggggatcggccacgtcgcggtggagaaccaccaccacgccaccatgctggacgtggacctccaccccgccagcgcctggaccctgtacgccgtcgcgaccacgatcatcaccccgatgatgcgccacaccatcgagaacaccacggccaacatctccctgaccgccatcgccaaccaggccgcgatcctcatggggctggacaagggctggcccatcagcaagatggacatcggcgtgcccctgctcgccctggggtgctactcccaggtgaaccccctgaccctcaccgccgccgtcctgatgctggtggcgcactacgccatcatcggcccggggctccaggccaaggccacgcgggaggcccagaagcgcaccgcggccggcatcatgaagaaccccaccgtggacgggatcgtcgccatcgacctggaccccgtggtgtacgacgccaagttcgagaagcagctgggccagatcatgctcctgatcctgtgcaccagccagatcctcctgatgcgcacgacctgggccctgtgcgagtccatcaccctcgcgaccggccccctgacgaccctgtgggaggggagcccgggcaagttctggaacaccaccatcgccgtctccatggccaacatcttccgggggagctacctcgccggcgccggcctggcgttcagcctgatgaagtccctcgggggcgggcgccggggcacgggggcccagggcgagaccctgggcgagaagtggaagcgccagctgaaccagctcagcaagtccgagttcaacatctacaagcggagcgggatcatggaggtggaccgctccgaggccaaggagggcctgaagcgcggggagaccacccgccacgccgtgagccggggcacggcgaagctgcgctggttcgtcgagcggaacctggtgaagcccgaggggaaggtgatcgacctcggctgcggccgcgggggctggtcctactactgcgccgggctgaagaaggtcaccgaggtgaagggctacaccaagggcgggcccggccacgaggagcccatcccgatggccacctacgggtggaacctggtgaagctccacagcggcaaggacgtcttcttcacgccgcccgagaagtgcgacaccctgctgtgcgacatcggggagtccagccccaacccgaccatcgaggagggccggaccctccgcgtgctgaagatggtggagccctggctgcgggggaaccagttctgcatcaagatcctcaacccctacatgccctccgtcgtggagaccctggagcagatgcagcgcaagcacggcggcatgctggtgcggaacccgctcagccgcaactccacgcacgagatgtactgggtcagctgcgggaccggcaacatcgtgtccgccgtgaacatgaccagccggatgctgctgaaccgcttcaccatggcccaccgcaagcccacgtacgagcgggacgtcgacctcggggcgggcacccgccacgtggccgtggagcccgaggtcgccaacctggacatcatcggccagcggatcgagaacatcaagcacgagcacaagtccacctggcactacgacgaggacaacccctacaagacctgggcctaccacgggagctacgaggtgaagccgtccggcagcgccagctccatggtcaacggggtggtgaagctgctcacgaagccctgggacgtcatccccatggtgacccagatcgcgatgaccgacaccacgcccttcggccagcagcgcgtgttcaaggagaaggtcgacacccggaccccgaaggccaagcgcgggaccgcccagatcatggaggtgacggcccggtggctgtggggcttcctgagccgcaacaagaagccccggatctgcacccgcgaggagttcacccggaaggtgcgctccaacgccgcgatcggcgccgtcttcgtggacgagaaccagtggaacagcgccaaggaggccgtggaggacgagcggttctgggacctcgtccagaaggagcgcgagctgcacaagcaggggaagtgcgcgacctgcgtgtacaacatgatgggcaagcgggagaagaagctgggggagttcggcaaggccaaggggtcccgcgccatctggtacatgtggctcggcgcccggttcctggagttcgaggccctgggcttcatgaacgaggaccactggttcagccgcgagaactccctcagcggggtggagggcgaggggctgcacaagctgggctacatcctccgggacatctccaagatccccgggggcaacatgtacgcggacgacacggccggctgggacacccgcatcaccgaggacgacctgcagaacgaggccaagatcaccgacatcatggagccggagcacgccctgctcgccacgagcatcttcaagctgacctaccagaacaaggtcgtgcgggtgcagcgccccgcgaagaacgggaccgtcatggacgtgatctcccgccgggaccagcgcggcagcggccaggtgggcacctacggcctgaacacgttcaccaacatggaggcccagctcatccggcagatggagtccgaggggatcttcctgcccagcgagctggagacccccaacctcgccgagcgcgtcctggactggctggagaagtacggcgtggagcggctcaagcgcatggccatctccggggacgactgcgtggtcaagccgatcgacgaccggttcgccaccgcgctgacggccctgaacgacatgggcaaggtgcgcaaggacatcccccagtgggagcccagcaaggggtggaacgactggcagcaggtccccttctgctcccaccacttccaccagctcatcatgaaggacggccgggagatcgtcgtgccgtgccgcaaccaggacgagctggtgggccgggcccgcgtcagccagggggccggctggagcctgcgggagaccgcctgcctcgggaagtcctacgcgcagatgtggcagctgatgtacttccaccgccgggacctgcgcctcgccgccaacgccatctgcagcgcggtgcccgtggactgggtccccacctcccggaccacgtggagcatccacgcccaccaccagtggatgaccaccgaggacatgctgtccgtgtggaaccgcgtgtggatcgaggagaacccctggatggaggacaagacccacgtcagctcctggggcgacgtgccgtacctggggaagcgggaggaccagtggtgcggcagcctcatcggcctgaccgcccgcgccacgtgggcctccaacatccaggtggcgatcaaccaggtccgccggctgatcgggaacgagaactacctcgactacatgaccagcatgaagcgcttcaagaacgagggcgaccccgagggggccctgtggtga

SEQ ID NO: 8464 - RNA, 9879 nt, synthetic construct
  misc_feature 1..9879: note = derived and/or modified CDS sequence (opt1) from DENV-1__FJ882543__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgcgggggtgaacatgtgcaccctcatcgccatggacctgggggagctgtgcgaggacaccatgacctacaagtgcccccggatcaccgaggccgagcccgacgacgtggactgctggtgcaacgccacggacacctgggtgacctacgggacctgcagccagacgggggagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgcccgacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcatcgggaagctggtgcaccagatcttcggcaccgcctacggggtcctcttctccggcgtgagctggaccatgaagatcgggatcggcgtgctgctgacgtggctcggcctgaactcccgcagcacctccctgagcatgacctgcatcgccgtcgggctcgtgaccctgtacctgggcgtgatggtccaggccgactccgggtgcgtgatcaactggaagggccgggagctcaagtgcgggagcggcatcttcgtgacgaacgaggtccacacctggaccgagcagtacaagttccaggcggacagcccgaagcgcctgtccgccgccatcggcaaggcctgggaggagggggtgtgcggcatccggagcgccacccgcctggagaacatcatgtggaagcagatctccaacgagctcaaccacatcctgctggagaacgacatgaagttcaccgtggtcgtgggggacgtggtcggcatcctcgcgcaggggaagaagatgatccggccccagcccatggagcacaagtacagctggaagtcctggggcaaggccaagatcatcggcgccgacgtgcagaacacgaccttcatcatcgacgggcccaacaccccggagtgccccgacgaccagcgcgcctggaacatctgggaggtggaggactacggcttcgggatcttcaccacgaacatctggctgaagatgcgggacagctacacccaggtctgcgaccaccgcctgatgtccgcggccatcaaggacagcaaggccgtgcacgccgacatgggctactggatcgagtccgagaagaacgagacctggaagctcgcccgggcgagcttcatcgaggtgaagacctgcatctggcccaagtcccacacgctgtggagcaacggcgtcctggagtccgagatgatcatccccaagatctacgggggcccgatcagccagcacaaccaccgccccgggtacttcacccagaccgccggcccctggcacctcgggaagctggagctggacttcgacctctgcgagggcaccacggtggtggtcgacgagcactgcggcaaccgggggccgtccctgcgcaccaccaccgtgacgggcaagatcatccacgagtggtgctgccggagctgcaccctgccgcccctgcgcttcaagggggaggacggctgctggtacgggatggagatccggcccgtgaaggagaaggaggagaacctggtcaagtccatggtgagcgccggcagcggcgaggtggactccttcagcctggggctcctgtgcatctccatcatgatcgaggaggtcatgcgcagccggtggtcccgcaagatgctgatgaccggcaccctcgccgtgttcctgctgctcatcatggggcagctgacgtggaacgacctgatccggctctgcatcatggtgggcgccaacgcgagcgaccgcatggggatgggcaccacctacctggccctgatggccaccttcaagatgcgcccgatgttcgccgtcggcctcctgttccggcgcctgacgtcccgggaggtgctcctgctgaccatcgggctcagcctggtggcctccgtcgagctgcccaacagcctcgaggagctgggcgacgggctggcgatgggcatcatgatcctcaagctgctgaccgacttccagtcccaccagctctgggccgccctgctgagcctcaccttcatcaagacgaccctgtccctgcactacgcctggaagaccatggcgatggtgctcagcatcgtctccctgatccccctgtgcctcagcaccacgtcccagaagaccacctggctgcccgtgctgctcggcagcctggggtgcaagccgctgaccatgttcctcatcgccgagaacaagatctggggccgcaagtcctggcccctgaacgaggggatcatggccgtgggcgtcgtgagcatcctgctcagctccctgctgaagaacgacgtgcccctcgccgggcccctgatcgccggcggcatgctgatcgcgtgctacgtcatcagcgggtccagcgccgacctctccctggagaaggccgccgaggtgagctgggaggaggaggccgagcactccggcgcgagccacaacatcctggtggaggtccaggacgacgggacgatgaagatcaaggacgaggagcgggacgacaccctcaccatcctgctgaaggccaccctcctggccgtgtccggcgtgtacccgctgagcatccccgccaccctcttcgtctggtacttctggcagaagaagaagcagcgctccggggtgctgtgggacacgcccagcccgcccgaggtggagcgggccgtcctggacgacggcatctaccgcatcatgcagcggggcctgctcgggcgctcccaggtgggcgtgggggtcttccaggagaacgtgttccacaccatgtggcacgtgacccggggcgcggtcctgatgtaccaggggaagcgcctggagcccagctgggcctccgtgaagaaggacctcatcagctacggcggcgggtggcggctgcagggctcctggaacaccggggaggaggtgcaggtcatcgccgtggagcccggcaagaaccccaagaacgtgcagacggcccccgggaccttcaagacccccgagggcgaggtcggcgccatcgcgctggacttcaagcccgggaccagcggctcccccatcgtgaaccgcgaggggaagatcgtgggcctctacggcaacggggtcgtgacgaccagcggcacctacgtgagcgccatcgcccaggccaaggcgtcccaggaggggccgctgcccgagatcgaggacgaggtcttccggaagcgcaacctgaccatcatggacctccaccccggcagcgggaagacgcggcgctacctgccggccatcgtgcgggaggccatcaagcgcaagctgcggaccctcatcctggcccccacccgcgtggtcgcctccgagatggcggaggccctgaagggcatgcccatccgctaccagaccacggccgtcaagagcgagcacaccggcaaggagatcgtggacctcatgtgccacgccaccttcaccatgcggctgctgtcccccgtccgcgtgccgaactacaacatgatcatcatggacgaggcccacttcacggaccccagctccatcgcggcccgggggtacatcagcacccgcgtgggcatgggggaggccgccgccatcttcatgaccgcgacgccgcccggctccgtcgaggccttcccgcagagcaacgccgtgatccaggacgaggagcgggacatccccgagcgctcctggaacagcgggtacgagtggatcacggacttcctcggcaagaccgtgtggttcgtcccctccatcaagagcggcaacgacatcgccaactgcctgcggaagaacgggaagcgcgtgatccagctgtcccggaagaccttcgacaccgagtaccagaagacgaagaacaacgactgggactacgtggtcaccaccgacatcagcgagatgggcgcgaacttccgcgccgaccgggtgatcgacccccgccggtgcctcaagccggtgatcctgaaggacgggcccgagcgcgtcatcctggccggccccatgcccgtgaccgtcgcctccgccgcgcagcggcgcgggcggatcggccgcaaccacaacaaggagggcgaccagtacatctacatggggcagccgctcaacaacgacgaggaccacgcccactggacggaggccaagatgctgctggacaacatcaacacccccgagggcatcatccccgccctcttcgagcccgagcgggagaagtccgccgcgatcgacggggagtaccgcctgcgcggcgaggcccggaagaccttcgtggagctgatgcgccgcggggacctcccggtgtggctgtcctacaaggtcgccagcgagggcttccagtacagcgaccgccggtggtgcttcgacggcgagcgcaacaaccaggtgctggaggagaacatggacgtggagatctggaccaaggagggggagcggaagaagctccgcccccggtggctggacgcccgcacgtactccgaccccctggccctccgggagttcaaggagttcgcggccggccgccggagcgtctccggggacctgatcctggagatcggcaagctcccccagcacctgacccagcgcgcccagaacgccctggacaacctcgtgatgctgcacaacagcgagcagggcgggcgggcgtaccgccacgccatggaggagctgccggacaccatcgagaccctcatgctgctggccctcatcgccgtgctgacgggcggggtcaccctgttcttcctctccggccgggggctgggcaagaccagcatcggcctgctctgcgtgatggcctccagcgtgctgctgtggatggcgtccgtcgagccccactggatcgccgccagcatcatcctcgagttcttcctgatggtgctgctcatccccgagcccgaccgccagcggaccccgcaggacaaccagctggcctacgtggtcatcgggctcctcttcatgatcctgaccgtggccgcgaacgagatgggcctgctcgagacgaccaagaaggacctggggatcggccacgtggccgtcgagaaccaccaccacgccaccatgctggacgtggacctccaccccgcctccgcctggaccctgtacgcggtggccacgaccatcatcacccccatgatgcgccacaccatcgagaacacgaccgccaacatcagcctgaccgccatcgccaaccaggcggccatcctcatggggctggacaagggctggccgatctccaagatggacatcggcgtccccctgctcgccctggggtgctacagccaggtgaaccccctgaccctcacggccgcggtgctgatgctggtcgcccactacgccatcatcggccccgggctccaggccaaggccacccgggaggcgcagaagcgcaccgccgccggcatcatgaagaacccgaccgtggacgggatcgtggccatcgacctggaccccgtcgtgtacgacgccaagttcgagaagcagctgggccagatcatgctcctgatcctgtgcacgtcccagatcctcctgatgcgcaccacctgggcgctgtgcgagagcatcaccctcgccacgggccccctgaccaccctgtgggaggggtcccccggcaagttctggaacaccacgatcgccgtgagcatggccaacatcttccgggggtcctacctcgccggcgcgggcctggccttcagcctgatgaagtccctcgggggcgggcgccggggcaccggggcccagggcgagaccctgggcgagaagtggaagcgccagctgaaccagctctccaagagcgagttcaacatctacaagcggtccgggatcatggaggtcgaccgcagcgaggccaaggagggcctgaagcgcggggagaccacgcgccacgcggtgtcccggggcaccgccaagctgcgctggttcgtggagcggaacctggtcaagccggaggggaaggtgatcgacctcggctgcggccgcgggggctggagctactactgcgccgggctgaagaaggtgaccgaggtcaagggctacaccaagggcgggcccggccacgaggagcccatccccatggccacgtacgggtggaacctggtgaagctccactccggcaaggacgtgttcttcaccccgcccgagaagtgcgacaccctgctgtgcgacatcggggagagctcccccaaccccaccatcgaggagggccggacgctccgcgtcctgaagatggtggagccgtggctgcgggggaaccagttctgcatcaagatcctcaacccctacatgcccagcgtggtcgagaccctggagcagatgcagcgcaagcacggcggcatgctggtgcggaaccccctctcccgcaacagcacccacgagatgtactgggtgtcctgcgggaccggcaacatcgtcagcgccgtgaacatgacctcccggatgctgctgaaccgcttcacgatggcgcaccgcaagccgacctacgagaaggacgtggacctcggggccggcacccggcacgtcgccgtggagcccgaggtggccaacctggacatcatcggccagcgcatcgagaacatcaagcacgagcacaagagcacctggcactacgacgaggacaacccctacaagacgtgggcctaccacgggtcctacgaggtcaagcccagcggctccgcgagcagcatggtgaacggggtcgtgaagctgctcaccaagccgtgggacgtgatccccatggtcacccagatcgccatgaccgacacgacccccttcggccagcagcgggtgttcaaggagaaggtggacacccgcacccccaaggccaagcgggggacggtccagatcatggaggtgaccgcccgctggctgtggggcttcctgtcccggaacaagaagccgcgcatctgcacccgggaggagttcacccgcaaggtgcggagcaacgccgcgatcggcgccgtcttcgtggacgagaaccagtggaactccgccaaggaggccgtggaggacgagcgcttctgggacctcgtcaagaaggagcgggagctgcacaagcaggggaagtgcgcgacgtgcgtgtacaacatgatgggcaagcgcgagaagaagctgggggagttcggcaaggccaaggggagccgggccatctggtacatgtggctcggcgcccgcttcctggagttcgaggccctgggcttcatgaacgaggaccactggttctcccgggagaacagcctctccggggtggagggcgaggggctgcacaagctgggctacatcctccgcgacatcagcaagatccccgggggcaacatgtacgcggacgacaccgccggctgggacacccggatcaccgaggacgacctgcagaacgaggccaagatcacggacatcatggagcccgagcacgccctgctcgccacctccatcttcaagctgacctaccagaacaaggtcgtgcgcgtgcagcggccggcgaagaacgggaccgtcatggacgtgatcagccgccgcgaccagcggggctccggccaggtgggcacgtacggcctgaacaccttcaccaacatggaggcccagctcatccgccagatggagagcgaggggatcttcctgccctccgagctggagacccccaacctcgccgagcgggtcctggactggctggagaagtacggcgtggagcgcctcaagcggatggccatcagcggggacgactgcgtggtcaagcccatcgacgaccgcttcgccacggcgctgaccgccctgaacgacatgggcaaggtgcggaaggacatcccgcagtgggagccctccaaggggtggaacgactggcagcaggtccccttctgcagccaccacttccaccagctcatcatgaaggacggccgcgagatcgtcgtgccctgccggaaccaggacgagctggtgggccgcgcccgggtctcccagggggccggctggagcctgcgcgagaccgcctgcctcggcaagagctacgcgcagatgtggcagctgatgtacttccaccggcgcgacctgcggctcgccgccaacgccatctgctccgcggtgccggtggactgggtccccaccagccgcacgacctggtccatccacgcccaccaccagtggatgaccaccgaggacatgctgagcgtgtggaaccgggtgtggatcgaggagaacccctggatggaggacaagacgcacgtctccagctgggaggacgtgccctacctgggcaagcgcgaggaccagtggtgcgggtccctcatcggcctgaccgcccgggccacctgggccagcaacatccaggtggcgatcaaccaggtccgccgcctgatcggcaacgagaactacctcgactacatgacctccatgaagcggttcaagaacgagggggacccggagggcgccctgtggtga

SEQ ID NO: 8465 - RNA, 9879 nt, synthetic construct
  misc_feature 1..9879: note = derived and/or modified CDS sequence (opt1) from DENV-1__FJ882544__SS-prME
  source 1..9879: mol_type = other RNA
agcgtgaccatgctgctcatgctgatgcccaccgccctggccttccacctcaccacccgcggcggggagccccacatgatcgtgagcaagcaggagcggggcaagagcctgctgttcaagacctccgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgcgacaagcggtccgtggccctcgcgccccacgtgggcctggggctggagacccgcaccgagacctggatgagctccgagggcgcgtggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcaaccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgccgtgctgcggaagctctgcatcgaggcgaagatcagcaacaccacgaccgactcccgctgcccgacccagggcgaggccaccctggtggaggagcaggacgccaacttcgtctgccggcgcacgttcgtggaccggggctgggggaacggctgcgggctgttcggcaaggggagcctcatcacgtgcgccaagttcaagtgcgtgaccaagctggagggcaagatcgtccagtacgagaacctgaagtactccgtgatcgtgaccgtccacacgggcgaccagcaccaggtggggaacgagagcaccgagcacggcaccaccgccaccatcacgccccaggcgcccaccaccgagatccagctcaccgactacggggccctgacgctggactgcagcccccggaccggcctcgacttcaacgagatggtcctgctgaccatgaaggagaagtcctggctcgtgcacaagcagtggttcctggacctgcccctcccctggacctccggggccagcacgagccaggagacctggaaccggcaggacctgctggtgaccttcaagaccgcccacgccaagaagcaggaggtcgtggtgctcggctcccaggagggcgcgatgcacacggccctgaccggggccaccgagatccagaccagcggcacgaccaccatcttcgccgggcacctgaagtgccgcctcaagatggacaagctgaccctgaagggcatgtcctacgtcatgtgcacggggagcttcaagctcgagaaggaggtggccgagacccagcacggcaccgtgctggtccagatcaagtacgagggcaccgacgcgccctgcaagatccccttctccacgcaggacgagaagggggtgacccagaacggccggctgatcaccgccaacccgatcgtgaccgacaaggggaagcccgtcaacatcgaggccgagccgcccttcggcgagagctacatcgtgatcggcgccggggagaaggcgctgaagctctcctggttcaagaagggcagctccatcgggaagatgttcgaggccacggcccgcggcgcccggcgcatggccatcctgggggacaccgcgtgggacttcggcagcatcggcggggtgttcacctccgtcggcaagctggtgcaccagatcttcgggaccgcctacggcgtgctgttcagcggggtctcctggacgatgaagatcggcatcggcgtgctgctgacctggctcgggctgaacagccgctccaccagcctgtccatgacctgcatcgccgtgggcctcgtcacgctgtacctgggggtgatggtgcaggccgacagcggctgcgtcatcaactggaaggggcgggagctcaagtgcggctccggcatcttcgtgaccaacgaggtgcacacctggaccgagcagtacaagttccaggccgacagcccgaagcgcctgagcgcggccatcgggaaggcctgggaggagggcgtctgcgggatccggtccgccacccgcctggagaacatcatgtggaagcagatcagcaacgagctcaaccacatcctgctggagaacgacatgaagttcacggtggtggtcggcgacgtggccgggatcctcgcgcagggcaagaagatgatccggccccagcccatggagtacaagtactcctggaagtcctggggcaaggccaagatcatcggggccgacgtgcagaacaccaccttcatcatcgacggccccaacaccccggagtgccccgacgaccagcgcgcctggaacatctgggaggtcgaggactacgggttcggcatcttcacgaccaacatctggctgaagctgcgggactcctacacccaggtgtgcgaccaccgcctcatgagcgcggccatcaaggactccaaggccgtgcacgccgacatgggctactggatcgagagcgagaagaacgagacctggaagctggcccgggcgtccttcatcgaggtcaagacgtgcatctggcccaagagccacaccctgtggtccaacggggtgctcgagagcgagatgatcatccccaagatctacggcgggccgatctcccagcacaactaccgccccggctacttcacccagaccgccgggccctggcacctgggcaagctggagctcgacttcgacctgtgcgagggcacgaccgtggtcgtggacgagcactgcgggaaccggggcccgagcctgcgcaccaccacggtgaccgggaagatcatccacgagtggtgctgccggtcctgcaccctgccgcccctccgcttccggggcgaggacgggtgctggtacggcatggagatccgccccgtcaaggagaaggaggagaacctggtcaagagcatggtgtccgccggcagcggggaggtcgacagcttctccctcggcctgctgtgcatcagcatcatgatcgaggaggtgatgcggtcccgctggagccggaagatgctcatgaccgggacgctggccgtgttcttcctgctcatcatgggccagctgacctggaacgacctgatccgcctctgcatcatggtcggggccaacgcgtccgaccgcatgggcatgggcaccacctacctggccctgatggccacgttcaagatgcggccgatgttcgccgtggggctcctgttccgccggctgaccagccgcgaggtgctcctgctgaccatcggcctctccctggtcgccagcgtggagctgcccaactccctcgaggagctgggggacggcctggcgatgggcatcatgatcctcaagctgctgaccgacttccagagccaccagctctgggccacgctgctgtccctcaccttcatcaagaccaccttcagcctgcactacgcctggaagacgatggccatggtcctgtccatcgtgagcctcttccccctgtgcctgtccaccaccagccagaagaccacgtggctccccgtgctgctggggtccctcggctgcaagccgctgaccatgttcctgatcgcggagaacaagatctgggggcggcgcagctggcccctcaacgagggcatcatggccgtcgggatcgtgtccatcctgctgagcagcctcctgaagaacgacgtgcccctggccggccccctcatcgccggcgggatgctgatcgcctgctacgtcatctccggcagctccgcggacctgagcctcgagaaggccgccgaggtgtcctgggaggaggaggccgagcacagcggggcctcccacaacatcctggtggaggtccaggacgacggcaccatgaagatcaaggacgaggagcgggacgacaccctgaccatcctcctgaaggcgacgctgctcgccgtgagcggggtgtacccgctgtccatccccgccaccctgttcgtctggtacttctggcagaagaagaagcagcgcagcggcgtgctctgggacacccccagcccgcccgaggtgggccgggccgtcctggacgacgggatctaccgcatcatgcagcggggcctgctggggcgcagccaggtgggcgtgggggtcttccaggagaacgtgttccacaccatgtggcacgtgacgcggggcgccgtcctcatgtaccagggcaagcgcctggagccctcctgggcgagcgtgaagaaggacctgatctcctacgggggcgggtggcggctccagggcagctggaacaccggggaggaggtgcaggtcatcgccgtggagcccggcaagaaccccaagaacgtgcagaccgcccccggcaccttcaagacgcccgagggggaggtcggcgccatcgccctggacttcaagcccgggacctccggcagccccatcgtgaaccgcgagggcaagatcgtggggctgtacggcaacggggtcgtgaccacctccggcacgtacgtgagcgcgatcgcccaggccaaggccagccaggaggggccgctccccgagatcgaggacgaggtcttccggaagcgcaacctgaccatcatggacctgcaccccggctccggcaagacccggcgctacctcccggcgatcgtgcgggaggccatcaagcgcaagctgcgcaccctgatcctcgcccccacgcgggtggtcgccagcgagatggccgaggcgctgaaggggatgcccatccgctaccagaccaccgccgtgaagtccgagcacaccggcaaggagatcgtggacctgatgtgccacgccacgttcaccatgcggctcctgagccccgtccgcgtgccgaactacaacatgatcatcatggacgaggcccacttcaccgacccctccagcatcgccgcgcgggggtacatctccacccgcgtgggcatgggggaggccgccgccatcttcatgacggccacgccgcccggcagcgtcgaggcgttcccgcagtccaacgccgtgatccaggacgaggagcgggacatccccgagcgcagctggaactccggctacgagtggatcaccgacttccccgggaagaccgtgtggttcgtccccagcatcaagtccggcaacgacatcgccaactgcctgcggaagaacgggaagcgcgtgatccagctcagccggaagacgttcgacaccgagtaccagaagaccaagaacaacgactgggactacgtggtcaccacggacatctccgagatgggcgccaacttccgcgcggaccgggtgatcgacccgcgccggtgcctgaagcccgtgatcctgaaggacgggcccgagcgcgtcatcctcgccggccccatgccggtgaccgtcgccagcgccgcccagcggcgcggccggatcgggcgcaaccacaacaaggagggcgaccagtacatctacatggggcagcccctgaacaacgacgaggaccacgcgcactggaccgaggccaagatgctgctcgacaacatcaacacccccgagggcatcatccccgccctgttcgagccggagcgcgagaagtccgccgccatcgacggggagtaccggctgcgcggcgaggcgcggaagacgttcgtggagctcatgcgccggggcgacctgcccgtgtggctgagctacaaggtcgcctccgaggggttccagtacagcgaccgccggtggtgcttcgacggcgagcgcaacaaccaggtgctcgaggagaacatggacgtggagatctggaccaaggagggggagcggaagaagctgcgcccccggtggctggacgcccgcacctacagcgaccccctcgccctgcgggagttcaaggagttcgccgcgggccgccggtccgtcagcggcgacctgatcctcgagatcgggaagctgccgcagcacctgacccagcgcgcccagaacgccctcgacaacctggtgatgctgcacaactccgagcagggcgggcgggcctaccgccacgcgatggaggagctccccgacacgatcgagaccctgatgctgctcgccctgatcgccgtgctgaccggcggggtcaccctcttcttcctgagcggccggggcctggggaagacctccatcggcctcctgtgcgtgatggccagctccgtgctgctctggatggccagcgtcgagccccactggatcgcggcctccatcatcctggagttcttcctgatggtgctcctgatccccgagccggaccgccagcggacgccccaggacaaccagctggcctacgtggtcatcgggctcctgttcatgatcctgaccgtggccgccaacgagatgggcctcctggagaccaccaagaaggacctggggatcggccacgtggcggtcgagaaccaccaccacgccgccatgctcgacgtggacctgcaccccgccagcgcctggacgctgtacgcggtggccaccaccatcatcaccccgatgatgcgccacacgatcgagaacaccaccgccaacatctccctcaccgccatcgccaaccaggcggccatcctgatgggcctggacaaggggtggcccatcagcaagatggacatcggcgtccccctcctggccctggggtgctactcccaggtgaaccccctcacgctgaccgccgcggtgctgatgctcgtcgcccactacgccatcatcggcccggggctgcaggccaaggccacccgcgaggcgcagaagcggaccgccgccggcatcatgaagaaccccacggtggacggcatcgtggccatcgacctggaccccgtcgtgtacgacgccaagttcgagaagcagctcgggcagatcatgctgctgatcctctgcaccagccagatcctgctgatgcgcaccacctgggcgctctgcgagtccatcacgctggccaccggccccctgaccaccctctgggaggggagcccgggcaagttctggaacacgaccatcgccgtgtccatggccaacatcttccggggcagctacctggccggggcgggcctggccttctccctcatgaagtccctcgggggcgggcgccgggggaccggcgcccagggggagaccctgggcgagaagtggaagcgccagctcaaccagctgagcaagtccgagttcaacacgtacaagcggagcgggatcatggaggtcgaccgctccgaggccaaggagggcctgaagcgcggggagaccaccaagcacgcggtgagccgcggcaccgccaagctccggtggttcgtggagcgcaacctggtcaagcccgagggcaaggtgatcgacctggggtgcggccgcgggggctggtcctactactgcgccgggctgaagaaggtgacggaggtcaagggctacaccaagggcgggcccggccacgaggagcccatcccgatggccacctacgggtggaacctcgtgaagctgcacagcggcaaggacgtgttcttcatcccgcccgagaagtgcgacaccctgctctgcgacatcggggagtccagccccaacccgacgatcgaggagggccgcaccctgcgggtcctgaagatggtggagccctggctccgcggcaaccagttctgcatcaagatcctgaacccctacatgccctccgtggtcgagaccctggagcagatgcagcggaagcacgggggcatgctcgtgcgcaacccgctgagccggaactccacccacgagatgtactgggtgagctgcgggaccggcaacatcgtctccgccgtgaacatgacgagccgcatgctgctcaaccgcttcaccatggcgcaccggaagcccacctacgagcgcgacgtggacctgggcgccgggacccggcacgtcgccgtggagcccgaggtggccaacctggacatcatcggccagcgcatcgagaacatcaagcacgagcacaagtccacgtggcactacgacgaggacaacccctacaagacctgggcctaccacgggagctacgaggtcaagccgtccggcagcgcgtccagcatggtgaacggggtcgtgaagctcctgaccaagccctgggacgtgatccccatggtcacccagatcgccatgacggacaccacccccttcggccagcagcgggtgttcaaggagaaggtggacacccgcacgccgaaggccaagcggggcaccgcccagatcatggaggtcaccgccaagtggctgtgggggttcctcagccgcaacaagaagccccggatctgcacccgcgaggagttcacgcggaaggtgcgctccaacgcggccatcggcgccgtgttcgtcgacgagaaccagtggaacagcgccaaggaggcggtggaggacgagcggttctgggacctggtgcaccgcgagcgggagctgcacaagcaggggaagtgcgcgacctgcgtctacaacatgatgggcaagcgcgagaagaagctcggggagttcggcaaggccaagggctcccgggccatctggtacatgtggctgggggcccgcttcctggagttcgaggcgctcggcttcatgaacgaggaccactggttcagccgggagaactccctgagcggggtggagggcgaggggctgcacaagctcggctacatcctgcgcgacatctccaacatccccggcgggaacatgtacgccgacgacaccgccggctgggacacccggatcacggaggacgacctgcagaacgaggcccgcatcaccgacatcatggagccggagcacgccctcctggccaagagcatcttcaagctgacctaccagaacaaggtggtccgcgtgcagcggcccgccaagaacgggaccgtgatggacgtcatctcccgccgggaccagcgcggcagcggccaggtggggacgtacggcctcaacaccttcaccaacatggaggcccagctgatccggcagatggagtccgaggggatcttcagcccctccgagctggagacccccaacctcgccgagcgcgtgctggactggctggagaagtacggcgtcgagcggctcaagcgcatggccatcagcggggacgactgcgtggtgaagccgatcgacgaccggttcgcgacggccctgaccgccctgaacgacatgggcaaggtccgcaaggacatcccccagtgggagccctccaagggctggaacgactggcagcaggtccccttctgcagccaccacttccaccagctcatcatgaaggacgggcgggagatcgtggtcccgtgccgcaaccaggacgagctggtgggccgggcccgcgtgtcccagggggccggctggagcctgcgggagaccgcgtgcctcggcaagagctacgcccagatgtggcagctgatgtacttccaccgccgggacctgcgcctcgccgccaacgcgatctgctccgccgtccccgtggactggatccccaccagccggacgacctggtccatccacgcccaccaccagtggatgaccaccgaggacatgctgagcgtgtggaaccgcgtctggatcgaggagaacccctggatggaggacaagacgcacatctccagctggggcgacgtgccgtacctgggcaagcgcgaggaccagtggtgcgggtccctcatcggcctgaccgcccgggccacctgggcgaccaacatccaggtggccatcaaccaggtccgccggctgatcgggaacgagaactacctcgactacatgaccagcatgaagcgcttcaagaacgagtccgaccccgagggcgccctgtggtga

SEQ ID NO: 8466 - RNA, 9879 nt, synthetic construct
  misc_feature 1..9879: note = derived and/or modified CDS sequence (opt1) from DENV-1__FJ898371__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgcgggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtgacctacgggacctgctcccagacgggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcctgacccaggacgagaagggggtcacgcagaacggccggctgatcaccgccaacccgatcgtgaccgacaaggagaagcccgtgaacatcgaggccgagccgcccttcggggagagctacatcgtcatcggcgcgggcgagaaggccctcaagctgtcctggttcaagaaggggagctccatcggcaagatgttcgaggccaccgcccgcggggcccggcgcatggcgatcctgggcgacacggcctgggacttcgggagcatcggcggcgtgttcacctccgtggggaagctcgtccaccagatcttcggcaccgcctacggggtgctgttcagcggcgtgtcctggaccatgaagatcgggatcggcgtcctgctcacgtggctgggcctgaacagccgctccaccagcctctccatgacctgcatcgccgtggggctggtgaccctgtacctcggcgtcatggtgcaggccgacagcgggtgcgtgatcaactggaagggccgggagctgaagtgcgggtccggcatcttcgtcacgaacgaggtgcacacctggaccgagcagtacaagttccaggcggacagcccgaagcgcctgagcgccgccatcggcaaggcctgggaggagggggtgtgcggcatccggtccgccacccgcctcgagaacatcatgtggaagcagatcagcaacgagctgaaccacatcctgctcgagaacgacatgaagttcaccgtcgtggtgggggacgtcgtgggcatcctggcgcaggggaagaagatgatccggccccagcccatggagcacaagtactcctggaagtcctggggcaaggccaagatcatcggcgccgacgtgcagaacacgaccttcatcatcgacgggcccaacaccccggagtgccccgacgaccagcgcgcctggaacatctgggaggtcgaggactacggcttcgggatcttcaccacgaacatctggctgaagctccgggactcccacacccaggtgtgcgaccaccgcctgatgagcgcggccatcaaggactccaaggccgtgcacgccgacatgggctactggatcgagagcgagaagaacgagacctggaagctggcccgggcgtccttcatcgaggtcaagacctgcatctggcccaagagccacacgctctggtccaacggcgtgctggagagcgagatgatcatccccaagatctacgggggcccgatctcccagcacaactaccgccccgggtacttcacccagaccgccggcccctggcacctggggaagctcgagctggacttcgacctgtgcgagggcaccacggtggtcgtggacgagcactgcggcaaccgggggccgagcctccgcaccaccaccgtgacgggcaagatcatccacgagtggtgctgccggtcctgcaccctgccgcccctgcgcttcaagggggaggacggctgctggtacgggatggagatccggcccgtcaaggagaaggaggagaacctcgtcaagagcatggtgtccgccggcagcggcgaggtcgacagcttctccctggggctgctctgcatcagcatcatgatcgaggaggtgatgcgctcccggtggagccgcaagatgctgatgaccggcaccctggccgtgttcctcctgctgatcatggggcagctcacgtggaacgacctgatccggctgtgcatcatggtcggcgccaacgcgtccgaccgcatggggatgggcaccacctacctcgccctgatggccaccttcaagatgcgcccgatgttcgccgtggggctgctgttccggcgcctgacgagccgggaggtgctgctcctgaccatcgggctgtccctcgtcgccagcgtggagctgcccaactccctggaggagctcggcgacgggctggcgatgggcatcatgatcctgaagctcctgaccgacttccagagccaccagctgtgggccaccctcctgtccctgacgttcatcaagaccaccctcagcctgcactacgcctggaagaccatggccatggtcctgtccatcgtgagcctcttccccctgtgcctgtccacgaccagccagaagaccacctggctccccgtgctgctgggctccctcgggtgcaagccgctgacgatgttcctgatcgcggagaacaagatctggggccgcaagagctggcccctcaacgaggggatcatggccgtcggcgtggtgtccatcctgctgagcagcctcctgaagaacgacgtccccctggccgggcccctcatcgccggcggcatgctgatcgcctgctacgtgatctccgggagctccgcggacctgagcctcgagaaggccgccgaggtgtcctgggaggaggaggccgagcacagcggcgcctcccacaacatcctggtcgaggtgcaggacgacgggaccatgaagatcaaggacgaggagcgggacgacaccctgaccatcctcctgaaggcgaccctgctcgccgtgagcggcgtctacccgctgtccatccccgccacgctgttcgtgtggtacttctggcagaagaagaagcagcgcagcggggtgctgtgggacacccccagcccgcccgaggtcgagcgggccgtgctcgacgacggcatctaccgcatcatgcagcggggcctgctggggcgcagccaggtgggcgtcggggtgttccaggagaacgtgttccacaccatgtggcacgtcacccggggcgccgtgctcatgtaccaggggaagcgcctggagccctcctgggcgagcgtgaagaaggacctgatctcctacggcggcgggtggcggctccagggcagctggaacacgggggaggaggtccaggtgatcgccgtggagcccggcaagaaccccaagaacgtccagaccgcccccgggaccttcaagacccccgagggcgaggtgggcgccatcgccctggacttcaagcccgggacgtccggcagccccatcgtgaaccgcgaggggaagatcgtcggcctgtacggcaacggggtggtgaccacctccggcacctacgtcagcgcgatcgcccaggccaaggccagccaggaggggccgctccccgagatcgaggacgaggtgttccggaagcgcaacctgacgatcatggacctgcaccccggctccgggaagacccggcgctacctcccggcgatcgtgcgggaggccatcaagcgcaagctgcggaccctgatcctcgcccccacccgcgtcgtggccagcgagatggccgaggcgctgaagggcatgcccatccgctaccagacgaccgccgtgaagtccgagcacaccggcaaggagatcgtcgacctgatgtgccacgccaccttcacgatgcggctcctgagccccgtgcgcgtgccgaactacaacatgatcatcatggacgaggcccacttcaccgacccctccagcatcgccgcgcgggggtacatctccacccgcgtcggcatgggggaggccgccgccatcttcatgaccgccacgccgcccggcagcgtggaggcgttcccgcagtccaacgccgtgatccaggacgaggagcgggacatccccgagcgcagctggaactccgggtacgagtggatcaccgacttccccggcaagaccgtctggttcgtgcccagcatcaagtccggcaacgacatcgccaactgcctgcggaagaacgggaagcgcgtgatccagctcagccggaagaccttcgacacggagtaccagaagaccaagaacaacgactgggactacgtcgtgaccaccgacatctccgagatgggcgccaacttccgcgcggaccgggtgatcgacccgcgccggtgcctgaagcccgtcatcctgaaggacgggcccgagcgcgtgatcctcgccggccccatgccggtcacggtggccagcgccgcccagcggcgcgggcggatcggccgcaaccacaacaaggagggcgaccagtacatctacatggggcagcccctgaacaacgacgaggaccacgcgcactggaccgaggccaagatgctgctcgacaacatcaacacccccgagggcatcatccccgccctgttcgagccggagcgggagaagtccgccgccatcgacggggagtaccgcctgcgcggcgaggcgcggaagaccttcgtggagctcatgcgccgcggggacctgcccgtctggctgagctacaaggtggcctccgagggcttccagtacagcgaccgccggtggtgcttcgacggcgagcgcaacaaccaggtgctcgaggagaacatggacgtcgagatctggacgaaggagggggagcggaagaagctgcgcccccggtggctggacgcccgcacctacagcgaccccctcgccctgcgggagttcaaggagttcgccgcgggccgccggtccgtgagcggggacctgatcctcgagatcggcaagctgccgcagcacctgacccagcgcgcccagaacgccctcgacaacctggtgatgctgcacaactccgagcagggcgggcgggcctaccgccacgcgatggaggagctccccgacaccatcgagacgctgatgctgctcgccctgatcgccgtcctgaccggcggggtgaccctcttcttcctgagcggccgggggctgggcaagacctccatcggcctcctgtgcgtgatggccagctccgtcctgctctggatggccagcgtggagccccactggatcgcggcctccatcatcctggagttcttcctgatggtgctcctgatccccgagccggaccgccagcggacgccccaggacaaccagctggcctacgtcgtgatcgggctcctgttcatgatcctgacggtggccgccaacgagatgggcctcctggagaccaccaagaaggacctggggatcggccacgtcgcggtggagaaccaccaccacgccaccatgctcgacgtggacctgcaccccgccagcgcctggacgctgtacgccgtcgcgaccaccatcatcaccccgatgatgcgccacacgatcgagaacaccaccgccaacatctccctcaccgccatcgccaaccaggccgcgatcctgatggggctggacaagggctggcccatcagcaagatggacatcggcgtgcccctcctggccctggggtgctactcccaggtgaaccccctcacgctgaccgccgccgtcctgatgctcgtggcgcactacgccatcatcggcccggggctgcaggccaaggccacccgggaggcccagaagcgcaccgcggccggcatcatgaagaaccccacggtggacgggatcgtcgccatcgacctggaccccgtggtgtacgacgccaagttcgagaagcagctcggccagatcatgctgctgatcctctgcaccagccagatcctgctgatgcgcaccacctgggccctctgcgagtccatcacgctggcgaccggccccctgaccaccctctgggaggggagcccgggcaagttctggaacacgaccatcgccgtctccatggccaacatcttccgggggagctacctggccggcgccggcctggcgttctccctcatgaagtccctcgggggcgggcgccgggggaccggggcccagggcgagaccctgggcgagaagtggaagcgccagctcaaccagctgagcaagtccgagttcaacatctacaagcggagcgggatcatggaggtggaccgctccgaggccaaggagggcctgaagcgcggggagacgacccgccacgccgtgagccggggcaccgcgaagctgcgctggttcgtcgagcggaacctcgtgaagcccgaggggaaggtgatcgacctgggctgcggccgcgggggctggtcctactactgcgccgggctgaagaaggtcaccgaggtgaagggctacacgaagggcgggcccggccacgaggagcccatcccgatggccacctacgggtggaacctcgtgaagctgcacagcggcaaggacgtcttcttcacgccgcccgagaagtgcgacaccctgctctgcgacatcggggagtccagccccaacccgacgatcgaggagggccggaccctgcgcgtgctgaagatggtggagccctggctccgggggaaccagttctgcatcaagatcctgaacccctacatgccctccgtcgtggagaccctggagcagatgcagcgcaagcacggcggcatgctcgtgcggaacccgctgagccgcaactccacccacgagatgtactgggtcagctgcgggaccggcaacatcgtgtccgccgtgaacatgacgagccggatgctgctcaaccgcttcaccatggcccaccgcaagcccacctacgagcgggacgtcgacctgggggcgggcacccgccacgtggccgtggagcccgaggtcgccaacctggacatcatcggccagcggatcgagaacatcaagcacgagcacaagtccacgtggcactacgacgaggacaacccctacaagacctgggcctaccacgggagctacgaggtgaagccgtccggcagcgcctccagcatggtcaacggggtggtgaagctcctgaccaagccctgggacgtcatccccatggtgacccagatcgcgatgacggacaccacccccttcggccagcagcgcgtgttcaaggagaaggtcgacacccggacgccgaaggccaagcgcgggaccgcccagatcatggaggtgaccgcccggtggctgtggggcttcctcagccgcaacaagaagccccggatctgcacccgcgaggagttcacgcggaaggtgcgctccaacgccgcgatcggcgccgtcttcgtggacgagaaccagtggaacagcgccaaggaggccgtggaggacgagcggttctgggacctggtccagaaggagcgcgagctgcacaagcaggggaagtgcgcgacctgcgtgtacaacatgatgggcaagcgggagaagaagctcggggagttcggcaaggccaaggggtcccgcgccatctggtacatgtggctgggcgcccggttcctggagttcgaggccctcggcttcatgaacgaggaccactggttcagccgcgagaactccctgagcggggtggagggcgaggggctgcacaagctcggctacatcctgcgggacatctccaagatccccgggggcaacatgtacgcggacgacaccgccggctgggacacccgcatcacggaggacgacctgcagaacgaggccaagatcaccgacatcatggagccggagcacgccctcctggccaccagcatcttcaagctgacctaccagaacaaggtcgtgcgggtgcagcgccccgcgaagaacgggacggtcatggacgtgatctcccgccgggaccagcgcggcagcggccaggtgggcacctacggcctcaacaccttcaccaacatggaggcccagctgatccggcagatggagtccgaggggatcttcctgcccagcgagctcgagacgcagaacctggccgagcgcgtcctggactggctcgagaagtacggcgtggagcggctgaagcgcatggccatctccggggacgactgcgtggtcaagcccatcgacgaccggttcgccaccgcgctgaccgccctcaacgacatgggcaaggtgcgcaaggacatcccgcagtgggagcccagcaaggggtggaacgactggcagcaggtccccttctgctcccaccacttccaccagctgatcatgaaggacggccgggagatcgtcgtgccctgccgcaaccaggacgagctggtgggccgggcccgcgtcagccagggggccggctggtccctccgggagaccgcctgcctgggcaagagctacgcgcagatgtggcagctgatgtacttccaccgccgggacctccgcctggccgccaacgccatctgcagcgcggtgccggtggactgggtccccacgtcccggaccacctggagcatccacgcccaccaccagtggatgaccacggaggacatgctgtccgtgtggaaccgcgtgtggatcgaggagaacccctggatggagaacaagacccacgtcagctcctggggcgacgtgccctacctcgggaagcgggaggaccagtggtgcggcagcctgatcggcctgaccgcccgcgccacctgggcctccaacatccaggtggcgatcaaccaggtccgccggctcatcgggaacgagaactacctggactacatgaccagcatgaagcgcttcaagaacgagggcgacccggagggggccctgtggtga

SEQ ID NO: 8467 - RNA, 9879 nt, synthetic construct
  misc_feature 1..9879: note = derived and/or modified CDS sequence (opt1) from DENV-1__FJ882545__SS-prME
  source 1..9879: mol_type = other RNA
agcgtgaccatgctgctcatgctgatgcccaccgccctggccttccacctcaccacccgcggcggggagccccacatgatcgtgagcaagcaggagcggggcaagagcctgctgttcaagaccagcgccggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtcctcttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggccgactccgggtgcgtcatcaactggaagggccgggagctcaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctggagaacatcatgtggaagcagatctccaacgagctcaaccacatcctgctggagaacgacatgaagctcaccgtggtggtcggggacgtggcgggcatcctggggcagggcaagaagatgatccggccccagcccatggagtacaagtacagctggaagtcctggggcaaggccaagatcatcggggccgacgcccagaacacgaccttcatcatcgacggccccaacaccccggagtgccccgacgaccagcgcgcgtggaacatctgggaggtggaggactacgggttcggcatcttcaccacgaacatctggctgaagctccgggacagctacacccaggtctgcgaccaccgcctgatgtccgccgccatcaaggacagcaaggccgtgcacgccgacatgggctactggatcgagtccgagaagaacgagacctggaagctggcgcgggccagcttcatcgaggtgaagacctgcatctggcccaagtcccacacgctctggagcaacggggtcctggagtccgagatgatcatccccaagatctacggcgggccgatcagccagcacaactaccgccccggctacttcacccagaccgccgggccctggcacctgggcaagctcgagctggacttcgacctgtgcgagggcaccacggtggtggtcgacgagcactgcgggaaccggggcccgtccctccgcaccaccaccgtgacggggaagatcatccacgagtggtgctgccggagctgcaccctgccgcccctgcgcttccggggcgaggacgggtgctggtacggcatggagatccgccccgtgaaggagaaggaggagaacctcgtcaagtccatggtgagcgccggcagcggggaggtggactccttcagcctgggcctgctctgcatctccatcatgatcgaggaggtcatgcggagccgctggtcccggaagatgctgatgaccgggaccctggccgtgttcttcctcctgatcatgggccagctgacgtggaacgacctcatccgcctgtgcatcatggtgggggcgaacgccagcgaccgcatgggcatgggcaccacctacctggccctcatggccaccttcaagatgcggccgatgttcgccgtcgggctgctgttccgccggctcacgtcccgcgaggtgctgctgctcaccatcgggctgagcctggtggcgtccgtcgagctccccaacagcctggaggagctgggggacggcctcgccatgggcatcatgatcctgaagctgctcaccgacttccagtcccaccagctgtgggccaccctgctcagcctgacgttcatcaagaccaccttctccctgcactacgcctggaagaccatggcgatggtgctcagcatcgtctccctgttccccctgtgcctcagcacgacctcccagaagaccacctggctgcccgtgctgctcgggagcctgggctgcaagccgctgacgatgttcctcatcgccgagaacaagatctgggggcggaagtcctggcccctgaacgagggcatcatggccgtggggatcgtcagcatcctgctcagctccctgctgaagaacgacgtgcccctcgccggccccctgatcgccggcgggatgctgatcgcgtgctacgtgatcagcggctccagcgccgacctctccctggagaaggccgccgaggtcagctgggaggaggaggccgagcactccggggcgagccacaacatcctggtggaggtgcaggacgacggcaccatgaagatcaaggacgaggagcgcgacgacaccctcaccatcctgctgaaggccaccctcctggccgtctccggggtgtacccgctgagcatccccgccaccctcttcgtgtggtacttctggcagaagaagaagcagcggtccggcgtcctgtgggacacccccagcccgcccgaggtggagcgcgccgtgctggacgacggcatctaccggatcatgcagcgcgggctgctcggccggtcccaggtcggggtgggcgtgttccaggagaacgtcttccacaccatgtggcacgtgacccgcggggcggtgctgatgtaccagggcaagcggctggagcccagctgggcctccgtcaagaaggacctcatcagctacggcgggggctggcgcctgcgggggtcctggaacacgggcgaggaggtccaggtgatcgccgtcgagcccgggaagaaccccaagaacgtgcagaccgcccccggcaccttcaagacccccgagggcgaggtgggggccatcgcgctggacttcaagcccggcacgagcgggtcccccatcgtcaaccgcgagggcaagatcgtgggcctctacgggaacggcgtggtcaccaccagcgggacctacgtgagcgccatcgcccaggccaaggcgtcccaggagggcccgctgcccgagatcgaggacgaggtgttccggaagcgcaacctgacgatcatggacctccaccccgggagcggcaagacccggcgctacctgccggccatcgtccgggaggccatcaagcgcaagctgcgcaccctcatcctggcccccacccgggtggtggcctccgagatggcggaggccctgaagggcatgcccatccgctaccagacgaccgccgtcaagagcgagcacaccgggaaggagatcgtggacctcatgtgccacgccaccttcacgatgcggctgctgtcccccgtgcgcgtcccgaactacaacatgatcatcatggacgaggcccacttcaccgaccccagctccatcgcggcccggggctacatcagcacccgcgtggggatgggcgaggccgccgccatcttcatgaccgcgacgccgcccgggtccgtggaggccttcccgcagagcaacgccgtcatccaggacgaggagcgggacatccccgagcgctcctggaacagcggctacgagtggatcaccgacttccccggcaagaccgtgtggttcgtgccctccatcaagagcgggaacgacatcgccaactgcctccggaagaacggcaagcgcgtcatccagctgtcccggaagaccttcgacacggagtaccagaagaccaagaacaacgactgggactacgtggtgaccaccgacatcagcgagatgggggcgaacttccgcgccgaccgggtcatcgacccgcgccggtgcctgaagcccgtgatcctcaaggacggccccgagcgcgtgatcctggccgggcccatgccggtcacggtggcctccgccgcgcagcggcgcggccggatcggccgcaaccacaacaaggagggggaccagtacatctacatgggccagcccctgaacaacgacgaggaccacgcccactggaccgaggccaagatgctcctggacaacatcaacacccccgaggggatcatccccgccctgttcgagccggagcgcgagaagtccgccgcggtcgacggcgagtaccggctccgcggggaggcccggaagaccttcgtggagctgatgcgccggggcgacctgcccgtgtggctctcctacaaggtcgccagcgagggcttccagtacagcgaccgccggtggtgcttcgacggggagcgcaacaaccaggtgctggaggagaacatggacgtggagatctggacgaaggagggcgagcggaagaagctgcgcccccggtggctcgacgcccgcacctactccgaccccctggccctgcgggagttcaaggagttcgcggccgggcgccggagcgtctccggcgacctcatcctggagatcggcaagctgccgcagcacctcacccagcgcgcccagaacgccctggacaacctggtgatgctccacaacagcgagcagggcgggcgggcgtaccgccacgccatggaggagctgcccgacaccatcgagacgctgatgctcctggccctgatcgccgtgctcaccgggggcgtcaccctgttcttcctgtccgggcggggcctcggcaagaccagcatcgggctgctgtgcgtgatggcctccagcgtgctcctgtggatggcgtccgtcgagccccactggatcgccgccagcatcatcctggagttcttcctcatggtgctgctgatccccgagccggaccgccagcggacgccccaggacaaccagctcgcctacgtggtcatcggcctgctgttcatgatcctcacggtggccgcgaacgagatggggctgctggagaccaccaagaaggacctcggcatcgggcacgtggccgtcgagaaccaccaccacgccgccatgctggacgtggacctgcaccccgcctccgcgtggaccctctacgccgtggccacgaccatcatcaccccgatgatgcgccacaccatcgagaacacgaccgccaacatcagcctgaccgccatcgcgaaccaggccgccatcctgatgggcctcgacaagggctggcccatctccaagatggacatcggggtccccctgctggccctcggctgctacagccaggtgaaccccctgaccctgacggcggccgtgctcatgctggtcgcccactacgccatcatcgggccgggcctgcaggccaaggcgacccgcgaggcccagaagcggaccgccgccgggatcatgaagaaccccaccgtggacggcatcgtggccatcgacctcgaccccgtcgtgtacgacgcgaagttcgagaagcagctgggccagatcatgctgctcatcctgtgcacgtcccagatcctgctcatgcgcaccacctgggccctgtgcgagagcatcaccctggccacggggcccctcaccaccctgtgggagggctccccggggaagttctggaacaccacgatcgccgtgagcatggccaacatcttccggggctcctacctggcgggcgccgggctcgccttcagcctgatgaagtccctgggcgggggccgccgggggaccggcgcccagggcgagaccctcggggagaagtggaagcgccagctgaaccagctgtccaagagcgagttcaacacctacaagcggtccggcatcatggaggtcgaccgcagcgaggcgaaggaggggctcaagcggggcgagacgaccaagcacgccgtgtcccgcgggaccgccaagctgcggtggttcgtggagcgcaacctggtcaagcccgagggcaaggtgatcgacctgggctgcgggcggggcgggtggagctactactgcgccggcctcaagaaggtgaccgaggtcaaggggtacacgaagggcggccccgggcacgaggagcccatcccgatggccacctacggctggaacctggtgaagctgcactccgggaaggacgtgttcttcatcccgcccgagaagtgcgacaccctcctgtgcgacatcggcgagagctcccccaacccgaccatcgaggaggggcgcacgctgcgggtcctcaagatggtggagccctggctgcgcggcaaccagttctgcatcaagatcctgaacccctacatgcccagcgtggtcgagaccctcgagcagatgcagcggaagcacggcgggatgctggtgcgcaacccgctgtcccggaacagcacccacgagatgtactgggtgtcctgcggcaccgggaacatcgtcagcgcggtgaacatgacctcccgcatgctcctgaaccgcttcacgatggcccaccggaagcccacctacgagcgcgacgtggacctgggcaccggcacccggcacgtcgccgtggagcccgaggtggccaacctcgacatcatcgggcagcgcatcgagaacatcaagcacgagcacaagagcacgtggcactacgacgaggacaacccctacaagacctgggcctaccacggctcctacgaggtcaagccgagcgggtccgcgagcagcatggtgaacggcgtcgtgaagctgctgaccaagccctgggacgtgatccccatggtcacccagatcgccatgacggacaccacccccttcgggcagcagcgggtgttcaaggagaaggtggacacccgcacgccgaaggccaagcggggcaccgcccagatcatggaggtcaccgcccgctggctctggggcttcctgtcccggaacaagaagccccgcatctgcacccgggaggagttcacgcgcaaggtgcggagcaacgcggccatcggggccgtgttcgtcgacgagaaccagtggaactccgccaaggaggcggtggaggacgagcgcttctgggacctggtgcaccgggagcgcgagctccacaagcagggcaagtgcgcgacctgcgtctacaacatgatggggaagcgggagaagaagctgggcgagttcgggaaggccaagggcagccgcgccatctggtacatgtggctgggcgcccggttcctcgagttcgaggcgctggggttcatgaacgaggaccactggttctcccgcgagaacagcctgtccggcgtggagggggagggcctccacaagctggggtacatcctgcgggacatcagcaagatccccggcggcaacatgtacgccgacgacaccgccgggtgggacacccgcatcacggaggacgacctccagaacgaggccaagatcaccgacatcatggagccggagcacgccctgctggcgaaggccatcttcaagctcacctaccagaacaaggtggtccgcgtgcagcggcccgccaagaacggcaccgtgatggacgtcatctcccgccgggaccagcgcgggagcggccaggtgggcacgtacgggctgaacaccttcaccaacatggaggcccagctgatccggcagatggagtccgagggcatcttcagcccctccgagctcgagacccccaacctggccgagcgcgcgctggactggctcgggaagtacggcgtggagcggctgaagcgcatggccatcagcggggacgactgcgtcgtgaagccgatcgacgaccggttcgccacggccctgaccgccctcaacgacatgggcaaggtgcgcaaggacatcccccagtgggagccctccaagggctggaacgactggcagcaggtccccttctgcagccaccacttccaccagctgatcatgaaggacgggcgggagatcgtggtgccgtgccgcaaccaggacgagctggtcggccgggcgcgcgtgtcccagggggccggctggagcctccgggagaccgcctgcctgggcaagagctacgcccagatgtggcagctgatgtacttccaccgccgggacctccgcctggcggccaacgccatctgctccgccgtgcccgtcgactgggtgcccaccagccggacgacctggtccatccacgcccaccaccagtggatgaccaccgaggacatgctgagcgtgtggaaccgcgtctggatcgaggagaacccctggatggaggacaagacgcacatctccagctgggaggacgtgccgtacctcggcaagcgcgaggaccagtggtgcggctccctgatcgggctgaccgcgcgggccacctgggccaccaacatccaggtggccatcaaccaggtccgccggctcatcggcaacgagaactacctggactacatgaccagcatgaagcgcttcaagaacgagtccgaccccgagggggccctgtggtga

SEQ ID NO: 8468 - RNA, 9879 nt, synthetic construct
  misc_feature 1..9879: note = derived and/or modified CDS sequence (opt1) from DENV-1__FJ898372__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgcgggggtgaacatgtgcaccctcatcgccatggacctgggcgagctgtgcgaggacacgatgacctacaagtgcccccggatcaccgaggccgagcccgacgacgtggactgctggtgcaacgccaccgacacgtgggtgacctacgggacctgcagccagaccggcgagcaccggcgggacaagcggtccgtggccctcgcgccccacgtgggcctggggctggagacgcgcaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggcccgggacaagcccaccctggacatcgagctcctgaagacggaggtcaccaaccccgcggtgctgcgcaagctctgcatcgaggccaagatctccaacaccaccacggacagccggtgcccgacccagggcgaggccaccctggtggaggagcaggacgccaacttcgtctgccgccggaccttcgtggaccgcggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccggacgggcctcgacttcaacgagatggtcctgctgaccatgaaggagaagtcctggctcgtgcacaagcagtggttcctggacctgcccctcccctggaccagcggggccagcacctcccaggagacgtggaaccgccaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccggctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccgcctgatcaccgccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccgccgcatggcgatcctgggcgacacggcctgggacttcgggtccatcggcggcgtgttcaccagcgtcgggaagctggtgcaccagatcttcggcaccgcctacggggtcctcttctccggcgtcagctggaccatgaagatcgggatcggcgtgctgctgacgtggctcggcctgaactcccggagcacctccctgagcatgacctgcatcgccgtggggctcgtcaccctgtacctgggcgtgatggtgcaggccgactccgggtgcgtcatcaactggaagggccgcgagctcaagtgcgggagcggcatcttcgtgacgaacgaggtgcacacctggaccgagcagtacaagttccaggcggacagcccgaagcggctgtccgccgccatcggcaaggcctgggaggagggggtctgcggcatccgcagcgccacccggctggagaacatcatgtggaagcagatctccaacgagctcaaccacatcctgctggagaacgacatgaagctcaccgtggtggtcggggacgtggcgggcatcctggggcagggcaagaagatgatccgcccccagcccatggagtacaagtacagctggaagtcctggggcaaggccaagatcatcggggccgacgcccagaacacgaccttcatcatcgacggccccaacaccccggagtgccccgacgaccagcgggcgtggaacatctgggaggtggaggactacgggttcggcatcttcaccacgaacatctggctgaagctccgcgacagctacacccaggtctgcgaccaccggctgatgtccgccgccatcaaggacagcaaggccgtgcacgccgacatgggctactggatcgagtccgagaagaacgagacctggaagctggcgcgcgccagcttcatcgaggtgaagacctgcatctggcccaagtcccacacgctctggagcaacggggtcctggagtccgagatgatcatccccaagatctacggcgggccgatcagccagcacaactaccggcccggctacttcacccagaccgccgggccctggcacctgggcaagctcgagctggacttcgacctgtgcgagggcaccacggtggtggtcgacgagcactgcgggaaccgcggcccgtccctccggaccaccaccgtgacggggaagatcatccacgagtggtgctgccgcagctgcaccctgccgcccctgcggttccgcggcgaggacgggtgctggtacggcatggagatccggcccgtgaaggagaaggaggagaacctcgtcaagtccatggtgagcgccggcagcggggaggtggactccttcagcctgggcctgctctgcatctccatcatgatcgaggaggtcatgcgcagccggtggtcccgcaagatgctgatgaccgggaccctggccgtgttcttcctcctgatcatgggccagctgacgtggaacgacctcatccgcctgtgcatcatggtgggggcgaacgccagcgaccggatgggcatgggcaccacctacctggccctcatggccaccttcaagatgcgcccgatgttcgccgtcgggctgctgttccggcgcctcacgtcccgggaggtgctgctgctcaccatcggcctgagcctggtggcgtccgtcgagctccccaacagcctggaggagctgggggacggcctcgccatgggcatcatgatcctgaagctgctcaccgacttccagtcccaccagctgtgggccaccctgctcagcctgacgttcatcaagaccaccttctccctgcactacgcctggaagaccatggcgatggtgctcagcatcgtctccctgttccccctgtgcctcagcacgacctcccagaagaccacctggctgcccgtgctgctcgggagcctgggctgcaagccgctgacgatgttcctcatcgccgagaacaagatctgggggcgcaagtcctggcccctgaacgagggcatcatggccgtggggatcgtcagcatcctgctcagctccctgctgaagaacgacgtgcccctcgccggccccctgatcgccggcgggatgctgatcgcgtgctacgtgatcagcggctccagcgccgacctctccctggagaaggccgccgaggtcagctgggaggaggaggccgagcactccggggcgagccacaacatcctggtggaggtgcaggacgacggcaccatgaagatcaaggacgaggagcgggacgacaccctcaccatcctgctgaaggccaccctcctggccgtctccggggtgtacccgctgagcatccccgccaccctcttcgtgtggtacttctggcagaagaagaagcagcgctccggcgtcctgtgggacacccccagcccgcccgaggtggagcgggccgtgctggacgacggcatctaccgcatcatgcagcgggggctgctcggccgctcccaggtcggggtgggcgtgttccaggagaacgtcttccacaccatgtggcacgtgacccgcggggccgtgctgatgtaccagggcaagcgcctggagcccagctgggcctccgtcaagaaggacctcatcagctacggcgggggctggcggctgcgcgggtcctggaacacgggcgaggaggtccaggtgatcgccgtcgagcccgggaagaaccccaagaacgtgcagaccgcccccggcaccttcaagacccccgagggcgaggtgggggccatcgcgctggacttcaagcccggcacgagcgggtcccccatcgtcaaccgggagggcaagatcgtgggcctctacgggaacggcgtggtcaccaccagcgggacctacgtgagcgccatcgcccaggccaaggcgtcccaggagggcccgctgcccgagatcgaggacgaggtgttccgcaagcggaacctgacgatcatggacctccaccccgggagcggcaagacccgccggtacctgccggccatcgtccgcgaggccatcaagcgcaagctgcggaccctcatcctggcccccacccgcgtggtggcctccgagatggcggaggccctgaagggcatgcccatccggtaccagacgaccgccgtcaagagcgagcacaccgggaaggagatcgtggacctcatgtgccacgccaccttcacgatgcgcctgctgtcccccgtgcgggtcccgaactacaacatgatcatcatggacgaggcccacttcaccgaccccagctccatcgcggcccgcggctacatcagcacccgggtggggatgggcgaggccgccgccatcttcatgaccgcgacgccgcccgggtccgtggaggccttcccgcagagcaacgccgtcatccaggacgaggagcgcgacatccccgagcggtcctggaacagcggctacgagtggatcaccgacttccccggcaagaccgtgtggttcgtgccctccatcaagagcgggaacgacatcgccaactgcctccgcaagaacggcaagcgggtcatccagctgtcccgcaagaccttcgacacggagtaccagaagaccaagaacaacgactgggactacgtggtgaccaccgacatcagcgagatgggggcgaacttccgggccgaccgcgtcatcgacccgcggcgctgcctgaagcccgtgatcctcaaggacggccccgagcgggtgatcctggccgggcccatgccggtcacggtggcctccgccgcgcagcgccggggccgcatcggccgcaaccacaacaaggagggggaccagtacatctacatgggccagcccctgaacaacgacgaggaccacgcccactggaccgaggccaagatgctcctggacaacatcaacacccccgaggggatcatccccgccctgttcgagccggagcgggagaagtccgccgcggtcgacggcgagtaccgcctccgcggggaggcccgcaagaccttcgtggagctgatgcggcgcggcgacctgcccgtgtggctctcctacaaggtcgccagcgagggcttccagtacagcgaccggcgctggtgcttcgacggggagcggaacaaccaggtgctggaggagaacatggacgtggagatctggacgaaggagggcgagcgcaagaagctgcggccccgctggctcgacgcccggacctactccgaccccctggccctgcgcgagttcaaggagttcgcggccgggcggcgcagcgtctccggcgacctcatcctggagatcggcaagctgccgcagcacctcacccagcgggcccagaacgccctggacaacctggtgatgctccacaacagcgagcagggcgggcgcgcgtaccggcacgccatggaggagctgcccgacaccatcgagacgctgatgctcctggccctgatcgccgtgctcaccgggggcgtcaccctgttcttcctgtccgggcgcggcctcggcaagaccagcatcgggctgctgtgcgtgatggcctccagcgtgctcctgtggatggcgtccgtcgagccccactggatcgccgccagcatcatcctggagttcttcctcatggtgctgctgatccccgagccggaccggcagcgcacgccccaggacaaccagctcgcctacgtggtcatcggcctgctgttcatgatcctcacggtggccgcgaacgagatggggctgctggagaccaccaagaaggacctcggcatcgggcacgtggccgtcgagaaccaccaccacgccgccatgctggacgtggacctgcaccccgcctccgcgtggaccctctacgccgtggccacgaccatcatcaccccgatgatgcgccacaccatcgagaacacgaccgccaacatcagcctgaccgccatcgcgaaccaggccgccatcctgatgggcctcgacaagggctggcccatctccaagatggacatcggggtccccctgctggccctcggctgctacagccaggtgaaccccctgaccctgacggcggccgtgctcatgctggtcgcccactacgccatcatcgggccgggcctgcaggccaaggcgacccgggaggcccagaagcgcaccgccgccgggatcatgaagaaccccaccgtggacggcatcgtggccatcgacctcgaccccgtcgtgtacgacgcgaagttcgagaagcagctgggccagatcatgctgctcatcctgtgcacgtcccagatcctgctcatgcggaccacctgggccctgtgcgagagcatcaccctggccacggggcccctcaccaccctgtgggagggctccccggggaagttctggaacaccacgatcgccgtgagcatggccaacatcttccgcggctcctacctggcgggcgccgggctcgccttcagcctgatgaagtccctgggcgggggccggcgcgggaccggcgcccagggcgagaccctcggggagaagtggaagcggcagctgaaccagctgtccaagagcgagttcaacacctacaagcgctccggcatcatggaggtcgaccggagcgaggcgaaggaggggctcaagcgcggcgagacgaccaagcacgccgtgtcccgggggaccgccaagctgcgctggttcgtggagcggaacctggtcaagcccgagggcaaggtgatcgacctgggctgcgggcgcggcgggtggagctactactgcgccggcctcaagaaggtgaccgaggtcaaggggtacacgaagggcggccccgggcacgaggagcccatcccgatggccacctacggctggaacctggtgaagctgcactccgggaaggacgtgttcttcatcccgcccgagaagtgcgacaccctcctgtgcgacatcggcgagagctcccccaacccgaccatcgaggaggggcggacgctgcgcgtcctcaagatggtggagccctggctgcggggcaaccagttctgcatcaagatcctgaacccctacatgcccagcgtggtcgagaccctcgagcagatgcagcgcaagcacggcgggatgctggtgcggaacccgctgtcccgcaacagcacccacgagatgtactgggtgtcctgcggcaccgggaacatcgtcagcgcggtgaacatgacctcccgcatgctcctgaaccggttcacgatggcccaccgcaagcccacctacgagcgggacgtggacctgggcaccggcacccgccacgtcgccgtggagcccgaggtggccaacctcgacatcatcgggcagcggatcgagaacatcaagcacgagcacaagagcacgtggcactacgacgaggacaacccctacaagacctgggcctaccacggctcctacgaggtcaagccgagcgggtccgcgagcagcatggtgaacggcgtcgtgaagctgctgaccaagccctgggacgtgatccccatggtcacccagatcgccatgacggacaccacccccttcgggcagcagcgcgtgttcaaggagaaggtggacacccggacgccgaaggccaagcgcggcaccgcccagatcatggaggtcaccgcccggtggctctggggcttcctgtcccgcaacaagaagccccggatctgcacccgcgaggagttcacgcggaaggtgcgcagcaacgcggccatcggggccgtgttcgtcgacgagaaccagtggaactccgccaaggaggcggtggaggacgagcggttctgggacctggtgcaccgcgagcgggagctccacaagcagggcaagtgcgcgacctgcgtctacaacatgatggggaagcgcgagaagaagctgggcgagttcgggaaggccaagggcagccgggccatctggtacatgtggctgggcgcccgcttcctcgagttcgaggcgctggggttcatgaacgaggaccactggttctcccgggagaacagcctgtccggcgtggagggggagggcctccacaagctggggtacatcctgcgcgacatcagcaagatccccggcggcaacatgtacgccgacgacaccgccgggtgggacacccgcatcacggaggacgacctccagaacgaggccaagatcaccgacatcatggagccggagcacgccctgctggcgaaggccatcttcaagctcacctaccagaacaaggtggtccgggtgcagcgccccgccaagaacggcaccgtgatggacgtcatctcccggcgcgaccagcgggggagcggccaggtgggcacgtacgggctgaacaccttcaccaacatggaggcccagctgatccgccagatggagtccgagggcatcttcagcccctccgagctcgagacccccaacctggccgagcgggcgctggactggctcgagaagtacggggtggagcgcctgaagcggatggccatcagcggcgacgactgcgtcgtgaagccgatcgacgaccgcttcgccacggccctgaccgccctcaacgacatggggaaggtgcggaaggacatcccccagtgggagccctccaagggctggaacgactggcagcaggtccccttctgcagccaccacttccaccagctgatcatgaaggacggccgcgagatcgtggtgccgtgccggaaccaggacgagctggtcgggcgcgcgcgggtgtcccagggcgccgggtggagcctccgcgagaccgcctgcctgggcaagagctacgcccagatgtggcagctgatgtacttccaccggcgcgacctccggctggcggccaacgccatctgctccgccgtgcccgtcgactgggtgcccaccagccgcacgacctggtccatccacgcccaccaccagtggatgaccaccgaggacatgctgagcgtgtggaaccgcgtctggatcgaggagaacccctggatggaggacaagacgcacatctccagctgggaggacgtgccgtacctcgggaagcgggaggaccagtggtgcggctccctgatcggcctgaccgcgcgcgccacctgggccaccaacatccaggtggccatcaaccaggtccggcgcctcatcgggaacgagaactacctggactacatgaccagcatgaagcggttcaagaacgagtccgaccccgagggcgccctgtggtga

SEQ ID NO: 8469 - RNA, 9879 nt, synthetic construct
  misc_feature 1..9879: note = derived and/or modified CDS sequence (opt1) from DENV-1__FJ898373__SS-prME
  source 1..9879: mol_type = other RNA
agcgtgaccatgctgctcatgctgatgcccaccgccctggccttccacctcaccacccggggcggggagccccacatgatcgtctccaagcaggagcggggcaagagcctgctgttcaagacctccgccggggtgaacatgtgcaccctcatcgccatggacctgggcgagctgtgcgaggacaccatgacctacaagtgcccccggatcaccgaggtggagcccgacgacgtcgactgctggtgcaacaccacggacacctgggtgacctacgggacctgcagccagacgggcgagcaccggcgcgacaagcggtccgtggccctcgcgccccacgtcggcctggggctggagacccgggccgagacctggatgagctccgagggcgcgtggaagcagatccagaaggtggagacctgggccctccggcaccccgggttcacggtgatcgccctgttcctggcccacgcgatcggcaccagcatcacccagaaggggatcatcttcatcctcctgatgctggtcaccccctccatggccatgcgctgcgtgggcatcggcagccgggacttcgtggaggggctctccggcgccacgtgggtcgacgtggtgctggagcacgggagctgcgtcaccaccatggccaaggacaagcccaccctggacatcgagctcctgaagacggaggtgaccaaccccgccgtgctgcgcaagctctgcatcgaggcgaagatctccaacaccaccacggacagccggtgcccgacccagggcgaggccaccctggtcgaggagcaggacgccaacttcgtgtgccgccggaccttcgtggaccgcggctgggggaacggctgcgggctgttcggcaaggggtccctcatcacgtgcgccaagttcaagtgcgtcaccaagctggagggcaagatcgtgcagtacgagaacctgaagtacagcgtgatcgtcaccgtgcacaccggcgaccagcaccaggtcgggaacgagtccacggagcacggcaccatcgccaccatcacgccccaggcgcccaccagcgagatccagctcacggactacggggccctgaccctggactgcagcccccggaccggcctcgacttcaacgagatggtgctgctgaccatgaaggagaagtcctggctcgtgcacaagcagtggttcctggacctgcccctcccctggacgagcggggcctccaccagccaggagacctggaaccgccaggacctgctggtcaccttcaagacggcccacgccaagaagcaggaggtggtggtcctcggctcccaggagggcgcgatgcacaccgccctgaccggggccaccgagatccagacgaccggcaccaccacgatcttcgccgggcacctgaagtgccggctcaagatggacaagctgaccctgaagggcatgagctacgtgatgtgcaccgggtccttcaagctcgagaaggaggtggccgagacccagcacggcacggtcctggtgcagatcaagtacgagggcaccgacgcgccctgcaagatccccttcagcacccaggacgagaagggggtgacccagaacggccgcctgatcacggccaacccgatcgtcaccgacaaggagaagcccgtgaacatcgaggccgagccgcccttcggggagtcctacatcgtgatcggcgccggcgagaaggcgctgaagctcagctggttcaagaaggggtccagcatcggcaagatgttcgaggccaccgcccgcggggcccgccggatggccatcctgggcgacaccgcgtgggacttcgggtccatcggcggcgtcttcacgagcgtggggaagctggtgcaccagatcttcggcaccgcctacggggtcctcttctccggcgtgagctggaccatgaagatcgggatcggcgtgctgctgacctggctcggcctgaactcccgcagcacgtccctgagcatgacctgcatcgccgtcgggctcatcaccctgtacctgggcgtgatggtgcaggccgactccgggtgcgtcatcaactggaagggccgcgagctcaagtgcgggagcggcatcttcgtgaccaacgaggtgcacacgtggaccgagcagtacaagttccaggccgacagcccgaagcggctgtccgcggccgtcggcaaggcctgggaggagggggtgtgcggcatccgcagcgccacccggctggagaacatcatgtggcgccagatctccaacgagctcaaccacatcctgctggagaacgacatgaagttcaccgtggtcgtgggggacgtggtcggcatcctcgcccaggggaagaagatggtgcggccccagcccatggagcacaagtacagctggaagtcctggggcaaggcgaagatcatcggcgccgacgtgcagaacaccacgttcatcatcgacgggcccaacaccccggagtgccccgacgaccagcgcgcctggaacatctgggaggtcgaggactacggcttcgggatcttcaccaccaacatctggctgaagctgcgggacagctacacccaggtgtgcgaccaccgcctcatgtccgccgcgatcaaggacagcaaggccgtgcacgccgacatgggctactggatcgagtccgagaagaacgagacctggaagctggcccgggccagcttcatcgaggtcaagacctgcatctggcccaagtcccacaccctgtggagcaacggcgtgctcgagtccgagatgatcatccccaagatctacgggggcccgatcagccagcacaactaccgccccgggtacttcacgcagaccgcgggcccctggcacctggggaagctggagctcgacttcgacctgtgcgagggcaccaccgtggtcgtggacgagcactgcggcaaccgggggccgtccctgcgcacgaccaccgtgaccggcaagatcatccacgagtggtgctgccggagctgcacgctgccgcccctccgcttcaagggggaggacggctgctggtacgggatggagatccggcccgtcaaggagaaggaggagaacctggtgaagtccatggtgagcgccggcagcggcgaggtcgactccttcagcctcgggctgctgtgcatctccatcatgatcgaggaggtgatgcgcagccggtggtcccgcaagatgctcatgaccggcaccctggccgtgttcttcctgctcatcatggggcagctgacctggaacgacctgatccggagctgcatcatggtcggcgccaacgcctccgaccgcatggggatgggcacgacctacctcgcgctgatggccaccttcaagatgcgcccgatgttcgccgtgggcctgctgttccggcgcctgaccagccgggaggtcctgctcctgacgatcgggctgtccctcgtggccagcgtggagctgcccaactccctggaggagctcggcgacgggctggccatgggcatcatgatcctgaagctcctgaccgacttccagagctaccagctgtgggcgaccctcctgtccctgaccttcatcaagacgaccttcagcctccactacgcctggaagaccatggccatggtcctgtccatcgtgagcctgctccccctgtgcctgtccaccacgagccagaagaccacctggctccccgtgctgctgggctccctcgggtgcaagccgctgaccatgttcctgatcgccgagaacaagatctggggccgcaagagctggcccctcaacgaggggatcatggcggtcggcatcgtgagcatcctgctgtccagcctcctgaagaacgacgtgcccctggccgggcccctcatcgccggcggcatgctgatcgcctgctacgtcatctccgggagctccgccgacctgagcctcgagaaggcggccgaggtgtcctgggaggaggaggccgagcacagcggcgcctcccacaacatcctggtggaggtccaggacgacgggacgatgaagatcaaggacgaggagcgggacgacaccctgaccatcctcctgaaggccaccctgctcgcggtgagcggcgtgtacccgctgtccatccccgccaccctgttcgtctggtacttctggcagaagaagaagcagcgcagcggggtgctctgggacacgcccagcccgcccgaggtggagcgggccgtcctggacgacggcatctaccgcatcatgcagcggggcctgctggggcgcagccaggtgggcgtgggggtcttccaggagaacgtgttccacaccatgtggcacgtgacccggggcgccgtcctcatgtaccaggggaagcgcctggagccctcctgggccagcgtgaagaaggacctgatctcctacggcggcgggtggcggctccagggcagctggaacaccggggaggaggtgcaggtcatcgcggtggagcccggcaagaaccccaagaacgtgcagacggcccccgggaccttcaagacccccgagggcgaggtcggcgccatcgccctggacttcaagcccgggacctccggcagccccatcgtgaaccgcgaggggaagatcgtgggcctgtacggcaacggggtcgtgacgaccagcggcacctacgtgtccgccatcgcgcaggccaaggccagccaggaggggccgctccccgagatcgaggacgaggtcttccggaagcgcaacctgaccatcatggacctgcaccccggctccgggaagacgcggcgctacctcccggccatcgtgcgggaggcgatcaagcgcaagctgcggaccctgatcctcgcccccacccgcgtggtcgccagcgagatggccgaggccctgaagggcatgcccatccgctaccagaccacggcggtgaagtccgagcacaccggccgggagatcgtggacctgatgtgccacgccaccttcaccatgcgcctcctgagccccgtccgggtgccgaactacaacatgatcatcatggacgaggcccacttcacggacccctccagcatcgccgcccgcgggtacatctccacccgggtgggcatgggggaggcggccgccatcttcatgaccgccacgccgcccggcagcgtcgaggccttcccgcagtccaacgcggtgatccaggacgaggagcgcgacatccccgagcggagctggaactccgggtacgagtggatcacggacttccccggcaagaccgtgtggttcgtccccagcatcaagtccggcaacgacatcgccaactgcctgcgcaagaacgggaagcgggtgatccagctcagccgcaagaccttcgacaccgagtaccagaagacgaagaacaacgactgggactacgtggtcaccaccgacatctccgagatgggcgccaacttccgggccgaccgcgtgatcgacccgcggcgctgcctgaagcccgtcatcctgaaggacgggcccgagcgggtgatcctcgcgggccccatgccggtgaccgtcgccagcgccgcccagcgccgggggcgcatcggccggaaccacaacaaggagggcgaccagtacatctacatggggcagcccctgaacaacgacgaggaccacgcccactggacggaggcgaagatgctgctcgacaacatcaacacccccgagggcatcatccccgccctgttcgagccggagcgcgagaagtccgccgccatcgacggggagtaccgcctgcggggcgaggcccgcaagaccttcgtggagctcatgcggcgcggggacctgcccgtgtggctgagctacaaggtcgcgagcgagggcttccagtactccgaccggcgctggtgcttcgacggcgagcggaacaaccaggtgctcgaggagaacatggacgtggagatctggaccaaggagggggagcgcaagaagctgcggccccgctggctggacgcccggacgtacagcgaccccctcgccctgcgcgagttcaaggagttcgccgccggccggcgctccgtcagcggggacctgatcctcgagatcggcaagctgccgcagcacctgacccagcgggcgcagaacgccctcgacaacctggtgatgctgcacaactccgagcagggcgggcgcgcctaccggcacgccatggaggagctccccgacaccatcgagaccctgatgctgctcgcgctgatcgccgtgctgacgggcggggtcaccctcttcttcctgagcggccgcgggctgggcaagacctccatcggcctcctgtgcgtgatggccagctccgccctgctctggatggccagcgtggagccccactggatcgcggcctccatcatcctggagttcttcctgatggtcctcctgatccccgagccggaccggcagcgcacgccccaggacaaccagctggcctacgtggtgatcgggctcctgttcatgatcctgaccgtcgccgccaacgagatgggcctcctggagacgaccaagaaggacctggggatcggccacgtggcggtggagaaccaccaccacgccaccatgctcgacgtcgacctgcaccccgccagcgcctggaccctgtacgccgtggcgacgaccatcatcaccccgatgatgcggcacaccatcgagaacacgaccgccaacatctccctcaccgccatcgccaaccaggccgcgatcctgatggggctggacaagggctggcccatcagcaagatggacatcggcgtgcccctcctggccctggggtgctactcccaggtcaaccccctcaccctgacggccgccgtgctgatgctcgtggcgcactacgccatcatcggcccggggctgcaggccaaggccacccgcgaggcccagaagcgcaccgcggccggcatcatgaagaaccccaccgtcgacgggatcgtggccatcgacctggaccccgtggtctacgacgccaagttcgagaagcagctcggccagatcatgctgctgatcctctgcacgagccagatcctgctgatgcggaccacctgggccctctgcgagtccatcaccctggcgacgggccccctgaccaccctctgggaggggagcccgggcaagttctggaacaccacgatcgccgtgtccatggccaacatcttccgcgggagctacctggccggcgccggcctggcgttcagcctcatgaagtccctcgggggcgggcggcgcgggaccggggcccagggcgagaccctgggcgagaagtggaagcggcagctcaaccagctgagcaagtccgagttcaacacctacaagcgcagcgggatcatggaggtggaccggtccgaggccaaggagggcctgcgccgcggggagacgaccaagcacgccgtcagccgcggcaccgcgaagctccggtggttcgtggagcgcaacctggtgaagcccgaggggaaggtcatcgacctgggctgcggccgcgggggctggtcctactactgcgccgggctgaagaaggtgaccgaggtgaagggctacacgaagggcggccccggccacgaggagcccatcccgatggccacctacgggtggaacctcgtcaagctgcacagcggcaaggacgtgttcttcatcccgcccgagaagtgcgacaccctgctctgcgacatcggggagtccagccccaacccgaccatcgaggagggccgcacgctgcgggtgctgaagatggtcgagccctggctccgcgggaaccagttctgcatcaagatcctgaacccctacatgccctccgtggtggagaccctggagcacatgcagcggaagcacggcggcatgctcgtccgcaacccgctgagccggaactccacccacgagatgtactgggtgagctgcgggaccggcaacatcgtgtccgccgtcaacatgaccagccgcatgctgctcaaccgcttcacgatggcccaccggaagcccacctacgagcgcgacgtggacctgggggcgggcacccggcacgtggccgtcgagcccgaggtggccaacctggacatcatcggccagcgcatcgagaacatcaagcacgagcacaagtccacctggcactacgacgaggacaacccctacaagacgtgggcctaccacgggagctacgaggtcaagccgtccggcagcgccagctccatggtgaacggggtggtcaagctcctgaccaagccctgggacgtgatccccatggtgacccagatcgcgatgaccgacacgacccccttcggccagcagcgggtcttcaaggagaaggtggacacccgcaccccgaaggccaagcgggggacggcccagatcatggaggtgaccgcccgctggctgtggggcttcctcagccggaacaagaagccccgcatctgcacccgggaggagttcacccgcaaggtccggtccaacgccgcgatcggcgccgtgttcgtggacgagaaccagtggaacagcgccaaggaggccgtcgaggacgagcgcttctgggacctggtgcaccgggagcgcgagctgcacaagcaggggaagtgcgcgacgtgcgtgtacaacatgatgggcaagcgggagaagaagctcggggagttcggcaaggccaaggggtcccgcgccatctggtacatgtggctgggcgcccggttcctggagttcgaggccctcggcttcatgaacgaggaccactggttcagccgcgagaactccctgagcggggtcgagggcgaggggctgcacaagctcggctacatcctgcgggacatctccaagatccccgggggcaacatgtacgcggacgacaccgccggctgggacacccgcatcaccgaggacgacctgcagaacgaggccaagatcacggacatcatggagccggagcacgccctcctggccaccagcatcttcaagctgacctaccagaacaaggtggtgcgcgtccagcggcccgcgaagaacgggaccgtgatggacgtgatctcccgccgggaccagcgcggcagcgggcaggtcggcacgtacggcctcaacaccttcaccaacatggaggcccagctgatccggcagatggagtccgaggggatcttcagcccctccgagctggagacccccaacctcgccgagcgcgtgctggactggctggagaagtacggcgtggagcggctcaagcgcatggccatcagcggggacgactgcgtcgtgaagccgatcgacgaccggttcgccacggcgctgaccgccctgaacgacatgggcaaggtgcgcaaggacatcccccagtgggagccctccaaggggtggaacgactggcagcaggtccccttctgcagccaccacttccaccagctcatcatgaaggacggccgggagatcgtggtgccgtgccgcaaccaggacgagctggtcggccgggcccgcgtgagccagggggccggctggtccctgcgggagaccgcctgcctcgggaagtcctacgcgcagatgtggcagctgatgtacttccaccgccgggacctgcgcctcgccgccaacgccatctgctccgcggtgcccgtcgactgggtgcccaccagccggacgacctggtccatccacgcccaccaccagtggatgaccaccgaggacatgctgagcgtgtggaaccgcgtctggatcgaggagaacccctggatggaggacaagacgcacatctccagctggggcgacgtgccgtacctggggaagcgcgaggaccagtggtgcggctccctcatcggcctgaccgcccgggccacctgggccaccaacatccaggtggcgatcaaccaggtccgccggctgatcgggaacgagaactacctcgactacatgaccagcatgaagcgcttcaagaacgagtccgaccccgagggcgccctgtggtga

SEQ ID NO: 8470 - RNA, 9879 nt, synthetic construct
  misc_feature 1..9879: note = derived and/or modified CDS sequence (opt1) from DENV-1__FJ898374__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgcgggggtgaacatgtgcaccctcatcgccatggacctgggggagctgtgcgaggacaccatgacctacaagtgcccccggatcaccgaggccgagcccgacgacgtggactgctggtgcaacgccaccgacacctgggtgacctacgggacctgcagccagaccggggagcaccggcgcgacaagcggagcgtggccctcgcgccccacgtgggcctggggctggagacccgcaccgagacctggatgtccagcgagggcgcctggaagcagatccagcgggtggagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcatccagaacggccggctgatcacggccaacccgatcgtgaccgacaaggagaagcccgtgaacatcgaggccgagccgcccttcggggagtcctacatcgtcatcggcgtgggcgagaaggcgctgaagctcagctggttcaagaaggggtccagcatcggcaagatgttcgaggccaccgcccgcggggcccggcgcatggccatcctgggcgacaccgcgtgggacttcgggtccatcggcggcgtgttcacgagcgtcgggaagctggtgcaccagatcttcggcaccgcctacggggtcctgttctccggcgtcagctggaccatgaagatcgggatcggcgtgctgctgacctggctcggcctgaactcccgcagcacgtccctgagcatgacctgcatcgccgtggggctcgtcaccctgtacctgggcgtgatggtgcaggccgactccgggtgcgtcatcaactggaagggccgggagctcaagtgcgggagcggcatcttcgtgaccaacgaggtgcacacgtggaccgagcagtacaagttccaggccgacagcccgaagcgcctgtccgcggccatcggcaaggcctgggaggagggggtctgcggcatccggagcgtgacccgcctggagaacatcatgtggaagcagatctccaacgagctcaaccacatcctgctggagaacgacatgaagttcaccgtggtcgtgggggacgtggtcggcatcctcgcccaggggaagaagatgatccggccccagcccatggagcacaagtacagctggaagtcctggggcaaggccaagatcatcggcgcggacgtgcagaacaccacgttcatcatcgacgggcccaacaccccggagtgccccgacgaccagcgcgcctggaacatctgggaggtggaggactacggcttcgggatcttcaccaccaacatctggctgaagctgcgggacagctacacgcaggcctgcgaccaccgcctcatgtccgccgcgatcaaggacagcaaggccgtccacgccgacatgggctactggatcgagtccgagaagaacgagacctggaagctggcccgggccagcttcatcgaggtgaagacctgcatctggcccaagtcccacaccctgtggagcaacggcgtgctcgagtccgagatggtcatccccaagatctacgggggcccgatcagccagcacaactaccgccccgggtacttcacgcagaccgcgggcccctggcacctggggaagctggagctcgacttcgacctgtgcgagggcaccaccgtggtggtcgacgagcactgcggcaaccgggggccgtccctgcgcacgaccaccgtgaccggcaagatcatccacgagtggtgctgccggagctgcacgctgccgcccctccgcttcaagggggaggacggctgctggtacgggatggagatccggcccgtgaaggagaaggaggagaacctggtcaagtccatggtgagcgccggcagcggcgaggtggactccttcagcctcgggctgctgtgcatctccatcatgatcgaggaggtcatgcgcagccggtggtcccgcaagatgctcatgaccggcaccctggccgtgttcctgctcctgatcatggggcagctgacctggaacgacctcatccggctgtgcatcatggtgggcgccaacgccagcgaccgcatggggatgggcacgacctacctggcgctcatggccaccttcaagatgcgcccgatgttcgccgtcggcctgctgttccggcgcctcacctcccgggaggtgctgctgctcacgatcgggctgagcctggtcgcctccgtggagctccccaacagcctggaggagctgggcgacgggctcgccatgggcatcatgatcctgaagctgctcaccgacttccagtcccaccagctgtgggcgaccctgctcagcctgaccttcatcaagacgaccctgtccctccactacgcctggaagaccatggccatggtgctgagcatcgtctccctgttccccctctgcctgagcaccacgtcccagaagaccacctggctgcccgtgctcctgggcagcctggggtgcaagccgctcaccatgttcctgatcgccgagaacaagatctggggccgcaagtcctggcccctgaacgaggggatcatggcggtgggcgtcgtgagcatcctcctgagctccctgctcaagaacgacgtgcccctggccgggcccctgatcgccggcggcatgctcatcgcctgctacgtcatcagcgggtccagcgccgacctgtccctggagaaggcggccgaggtgagctgggaggaggaggccgagcactccggcgccagccacaacatcctcgtggaggtccaggacgacgggacgatgaagatcaaggacgaggagcgggacgacaccctgaccatcctgctcaaggccaccctgctggcggtgtccggcgtgtacccgctcagcatccccgccaccctgttcgtctggtacttctggcagaagaagaagcagcgctccggggtgctgtgggacacgcccagcccgcccgaggtggagcgggccgtcctggacgacggcatctaccgcatcatgcagcggggcctcctggggcgctcccaggtgggcgtgggggtcttccaggagaacgtgttccacaccatgtggcacgtgacccggggcgccgtcctgatgtaccaggggaagcgcctcgagcccagctgggcctccgtgaagaaggacctgatcagctacggcggcgggtggcggctgcagggctcctggaacaccggggaggaggtgcaggtcatcgcggtggagcccggcaagaaccccaagaacgtgcagacggcccccgggaccttcaagacccccgagggcgaggtcggcgccatcgccctcgacttcaagcccgggaccagcggctcccccatcgtgaaccgcgaggggaagatcgtgggcctgtacggcaacggggtcgtgacgaccagcggcacctacgtgagcgccatcgcgcaggccaaggcctcccaggaggggccgctgcccgagatcgaggacgaggtcttccggaagcgcaacctcaccatcatggacctgcaccccggcagcgggaagacgcggcgctacctgccggccatcgtgcgggaggcgatcaagcgcaagctccggaccctgatcctggcccccacccgcgtggtcgcctccgagatggccgaggccctcaagggcatgcccatccgctaccagaccacggcggtcaagagcgagcacaccggcaaggagatcgtggacctgatgtgccacgccaccttcaccatgcggctgctctcccccgtccgcgtgccgaactacaacatgatcatcatggacgaggcccacttcacggaccccagctccatcgccgcccgggggtacatcagcacccgcgtgggcatgggggaggcggccgccatcttcatgaccgccacgccgcccggctccgtcgaggccttcccgcagagcaacgcggtgatccaggacgaggagcgggacatccccgagcgctcctggaacagcgggtacgagtggatcacggacttccccggcaagaccgtgtggttcgtcccctccatcaagagcggcaacgacatcgccaactgcctgcggaagaacgggaagcgcgtgatccagctgtcccggaagaccttcgacaccgagtaccagaagacgaagaacaacgactgggactacgtggtcaccaccgacatcagcgagatgggcgccaacttccgcgccgaccgggtgatcgacccgcgccggtgcctcaagcccgtcatcctgaaggacgggcccgagcgcgtgatcctggcgggccccatgccggtgaccgtcgcctccgccgcccagcggcgcgggcggatcggccgcaaccacaacaaggagggcgaccagtacatctacatggggcagcccctcaacaacgacgaggaccacgcccactggacggaggcgaagatgctgctggacaacatcaacacccccgagggcatcatccccgccctcttcgagccggagcgggagaagtccgccgccatcgacggggagtaccgcctgcgcggcgaggcccggaagaccttcgtggagctgatgcgccgcggggacctccccgtgtggctgtcctacaaggtcgcgagcgagggcttccagtacagcgaccgccggtggtgcttcgacggcgagcgcaacaaccaggtgctggaggagaacatggacgtggagatctggaccaaggagggggagcggaagaagctccgcccccggtggctggacgcccgcacgtactccgaccccctggccctccgggagttcaaggagttcgccgccggccgccggagcgtctccggggacctgatcctggagatcggcaagctcccgcagcacctgacccagcgcgcgcagaacgccctggacaacctcgtgatgctgcacaacagcgagcagggcgggcgggcctaccgccacgccatggaggagctgcccgacaccatcgagaccctcatgctgctggcgctcatcgccgtgctgacgggcggggtcaccctgttcttcctctccggccgggggctgggcaagaccagcatcggcctgctctgcgtgatggcctccagcgtgctgctgtggatggcctccgtcgagccccactggatcgccgcgagcatcatcctcgagttcttcctgatggtgctgctcatccccgagccggaccgccagcggacgccccaggacaaccagctggcctacgtggtcatcgggctcctcttcatgatcctgaccgtggccgccaacgagatgggcctgctcgagacgaccaagaaggacctggggatcggccacgtggccgtcgagaaccaccaccacgcgaccatgctggacgtggacctccaccccgcctccgcctggaccctgtacgccgtggccacgaccatcatcaccccgatgatgcgccacaccatcgagaacacgaccgcgaacatcagcctgaccgccatcgccaaccaggccgccatcctcatggggctggacaagggctggcccatctccaagatggacatcggcgtccccctgctcgcgctggggtgctacagccaggtgaaccccctgaccctcacggccgccgtgctgatgctggtcgcccactacgcgatcatcggcccggggctccaggccaaggccacccgggaggcccagaagcgcaccgccgcgggcatcatgaagaaccccaccgtggacgggatcgtggccatcgacctggaccccgtcgtgtacgacgccaagttcgagaagcagctgggccagatcatgctcctgatcctgtgcacgtcccagatcctcctgatgcgcaccacctgggccctgtgcgagagcatcaccctcgccacgggccccctgaccaccctgtgggaggggtccccgggcaagttctggaacaccacgatcgcggtgagcatggccaacatcttccgggggtcctacctcgccggcgccggcctggccttcagcctgatgaagtccctcgggggcgggcgccggggcaccggggcgcagggcgagaccctgggcgagaagtggaagcgccagctgaaccagctctccaagagcgagttcaacatctacaagcggtccgggatcatggaggtcgaccgcagcgaggccaaggagggcctgaagcgcggggagaccacgcgccacgccgtgtcccggggcaccgccaagctgcgctggttcgtggagcggaacctggtcaagcccgaggggaaggtgatcgacctcggctgcggccgcgggggctggagctactactgcgcggggctgaagaaggtgaccgaggtcaagggctacaccaagggcgggcccggccacgaggagcccatcccgatggccacgtacgggtggaacctggtgaagctccactccggcaaggacgtgttcttcacgccgcccgagaagtgcgacaccctgctgtgcgacatcggggagagctcccccaacccgaccatcgaggagggccggacgctccgcgtcctgaagatggtggagccctggctgcgggggaaccagttctgcatcaagatcctcaacccctacatgcccagcgtggtcgagaccctggagcagatgcagcgcaagcacggcggcatgctggtgcggaacccgctctcccgcaacagcacccacgagatgtactgggtgtcctgcgggaccggcaacatcgtcagcgccgtgaacatgacctcccggatgctgctgaaccgcttcacgatggcccaccgcaagcccacctacgagcgggacgtggacctcggggccggcacccgccacgtcgcggtggagcccgaggtcgccaacctggacatcatcggccagcggatcgagaacatcaagcacgagcacaagagcacctggcactacgacgaggacaacccctacaagacgtgggcctaccacgggtcctacgaggtgaagccgagcggctccgccagcagcatggtgaacggggtcgtgaagctgctcaccaagccctgggacgtgatccccatggtcacccagatcgccatgaccgacacgacccccttcggccagcagcgcgtgttcaaggagaaggtggacacccggaccccgaaggcgaagcgcgggacggcccagatcatggaggtcaccgcccggtggctgtggggcttcctgtcccgcaacaagaagccccggatctgcacccgcgaggagttcacccggaaggtgcgcagcaacgccgccatcggcgcggtgttcgtcgacgagaaccagtggaactccgccaaggaggccgtggaggacgagcggttctgggacctcgtgcagaaggagcgcgagctgcacaagcaggggaagtgcgccacgtgcgtctacaacatgatgggcaagcgggagaagaagctgggggagttcggcaaggcgaaggggagccgcgccatctggtacatgtggctcggcgcccggttcctggagttcgaggccctgggcttcatgaacgaggaccactggttctcccgcgagaacagcctctccggggtggagggcgaggggctgcacaagctgggctacatcctccgggacatcagcaagatccccgggggcaacatgtacgccgacgacaccgcgggctgggacacccgcatcaccgaggacgacctgcagaacgaggccaagatcacggacatcatggagccggagcacgccctgctcgccacctccatcttcaagctgacctaccagaacaaggtggtccgggtgcagcgccccgccaagaacgggaccgtgatggacgtcatcagccgccgggaccagcgcggctccggccaggtgggcacgtacggcctgaacaccttcaccaacatggaggcgcagctcatccggcagatggagagcgaggggatcttcctgccctccgagctggagacccccaacctcgccgagcgcgtgctggactggctggagaagcacggcgtcgagcggctcaagcgcatggccatcagcggggacgactgcgtggtgaagccgatcgacgaccggttcgccacggccctgaccgcgctgaacgacatgggcaaggtccgcaaggacatcccccagtgggagccctccaaggggtggaacgactggcagcaggtccccttctgcagccaccacttccaccagctcatcatgaaggacggccgggagatcgtggtcccgtgccgcaaccaggacgagctggtgggccgggcccgcgtgtcccagggggccggctggagcctgcgggagaccgcctgcctcggcaagagctacgcccagatgtggcagctgatgtacttccaccgccgggacctgcgcctcgcggccaacgccatctgctccgccgtccccgtggactgggtgcccaccagccggacgacctggtccatccacgcgcaccaccagtggatgaccaccgaggacatgctgagcgtctggaaccgcgtgtggatcgaggagaacccctggatggaggacaagacgcacgtgtccagctggggcgacgtcccgtacctggggaagcgggaggaccagtggtgcggctccctcatcggcctgaccgcccgcgccacctgggccagcaacatccaggtggccatcaaccaggtgcgccggctgatcgggaacgagaactacctcgactacatgacctccatgaagcgcttcaagaacgagggcgaccccgagggggcgctgtggtga

SEQ ID NO: 8471 - RNA, 9879 nt, synthetic construct
  misc_feature 1..9879: note = derived and/or modified CDS sequence (opt1) from DENV-1__FJ898375__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagaccagcgcgggggtgaacatgtgcaccctcatcgccatggacctgggcgagttctgcgaggacacgatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatggccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagaccgtccagtacgagaacctgaagtacagcgtgatcgtgaccgtccacacgggcgaccagcaccaggtggggaacgagtccaccgagcacggcaccaccgcgaccatcacgccccaggcccccagcaccgagatccagctgaccgactacggggccctcaccctggactgcagcccccggacgggcctggacttcaacgagatggtcctcctgaccatgaaggagaagtcctggctggtgcacaagcagtggttcctcgacctgccgctgccctggaccagcggggcctccaccagccaggagacgtggaaccggaaggacctcctggtgaccttcaagaccgcccacgcgaagaagcaggaggtcgtggtgctgggctcccaggagggcgccatgcacaccgccctcacgggggccaccgagatccagaccagcggcaccacgaccatcttcgccgggcacctgaagtgccgcctgaagatggacaagctcaccctgaagggcatgtcctacgtcatgtgcaccgggagcttcaagctggagaaggaggtggcggagacgcagcacggcaccgtgctcgtccagatcaagtacgagggcaccgacgccccctgcaagatccccttctccacccaggacgagaagggggtgacgcagaacggccggctgatcaccgccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacacggcctgggacttcgggagcatcggcggcgtgttcacctccgtcgggaagctggtgcaccagatcttcggcaccgcctacggggtgctgttcagcggcgtctcctggaccatgaagatcgggatcggcgtgctcctgacgtggctgggcctcaacagccgctccaccagcctgtccatgacctgcatcgccgtggggctggtcaccctctacctgggcgtgatggtgcaggccgacagcgggtgcgtcatcaactggaagggccgggagctgaagtgcgggagcggcatcttcgtgacgaacgaggtgcacacctggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagttcaccgtggtggtcggggacgtggcgggcatcctggcccaggggaagaagatgatccggccccagcccatggagtacaagtactcctggaagtcctggggcaaggccaagatcatcggcgccgacgtgcagaacacgaccttcatcatcgacgggcccaacaccccggagtgccccgacgaccagcgcgcgtggaacatctgggaggtcgaggactacggcttcgggatcttcaccacgaacatctggctcaagctgcgggactcctacacccaggtgtgcgaccaccgcctgatgagcgccgccatcaaggactccaaggccgtgcacgccgacatgggctactggatcgagagcgagaagaacgagacctggaagctcgcgcgggcctccttcatcgaggtcaagacctgcatctggcccaagagccacacgctgtggtccaacggcgtgctggagagcgagatgatcatccccaagatctacgggggcccgatctcccagcacaactaccgccccgggtacttcacccagaccgccggcccctggcacctcgggaagctggagctggacttcgacctctgcgagggcaccacggtggtcgtggacgagcactgcggcaaccgggggccgagcctgcgcaccaccaccgtgacgggcaagatcatccacgagtggtgctgccggtcctgcaccctgccgcccctgcgcttcaagggggaggacggctgctggtacgggatggagatccggcccgtcaaggagaaggaggagaacctggtcaagagcatggtgagcgccggctccggcgaggtcgacagcttctccctggggctcctgtgcatcagcatcatgatcgaggaggtgatgcgctcccggtggagccgcaagatgctgatgaccggcaccctcgccgtgttcttcctgctgatcatggggcagctcacgtggaacgacctgatccggctgtgcatcatggtcggcgcgaacgcctccgaccgcatggggatgggcaccacctacctcgccctgatggccaccttcaagatgcgcccgatgttcgccgtggggctcctgttccggcgcctgacgagccgggaggtgctgctcctgaccatcgggctgtccctcgtcgcgagcgtggagctgcccaactccctggaggagctcggcgacgggctggccatgggcatcatgatcctgaagctcctgaccgacttccagagccaccagctgtgggccaccctcctgtccctgacgttcatcaagaccaccttcagcctccactacgcctggaagaccatggcgatggtcctgtccatcgtgagcctgttccccctctgcctgtccacgaccagccagaagaccacctggctgcccgtgctcctgggctccctggggtgcaagccgctcacgatgttcctgatcgccgagaacaagatctggggccgcaagagctggcccctgaacgaggggatcatggccgtcggcatcgtgagcatcctcctgtccagcctgctcaagaacgacgtgcccctggccgggcccctgatcgccggcggcatgctcatcgcgtgctacgtcatctccgggagctccgccgacctgagcctggagaaggccgccgaggtgtcctgggaggaggaggccgagcacagcggcgcgtcccacaacatcctcgtggaggtccaggacgacgggaccatgaagatcaaggacgaggagcgggacgacaccctgaccatcctgctcaaggccaccctgctggccgtgagcggcgtgtacccgctctccatccccgccacgctgttcgtctggtacttctggcagaagaagaagcagcgcagcggggtgctgtgggacacccccagcccgcccgaggtggagcgggccgtcctcgacgacggcatctaccgcatcatgcagcggggcctgctggggcgcagccaggtgggcgtgggggtcttccaggagaacgtgttccacaccatgtggcacgtgacccggggcgcggtcctgatgtaccaggggaagcgcctcgagccctcctgggccagcgtgaagaaggacctgatctcctacggcggcgggtggcggctgcagggcagctggaacacgggggaggaggtgcaggtcatcgccgtggagcccggcaagaaccccaagaacgtgcagaccgcccccgggaccttcaagacctccgagggcgaggtcggcgccatcgcgctcgacttcaagcccgggacgagcggcagccccatcgtgaaccgcgaggggaagatcgtgggcctgtacggcaacggggtcgtgaccacctccggcacctacgtgagcgccatcgcccaggccaaggcgtcccaggaggggcccctgccggagatcgaggacgaggtcttccggaagcgcaacctcacgatcatggacctgcaccccggcagcgggaagacccggcgctacctgcccgccatcgtgcgggaggccatcaagcgcaagctccggaccctgatcctggccccgacccgcgtggtcgcctccgagatggcggaggccctcaagggcatgcccatccgctaccagacgaccgccgtcaagagcgagcacaccggcaaggagatcgtggacctgatgtgccacgccaccttcacgatgcggctgctctcccccgtccgcgtgcccaactacaacatgatcatcatggacgaggcccacttcaccgacccgagctccatcgcggcccgggggtacatcagcacccgcgtgggcatgggggaggccgccgccatcttcatgaccgcgacgccgcccggctccgtcgaggccttcccccagagcaacgccgtgatccaggacgaggagcgggacatcccggagcgctcctggaacagcgggtacgagtggatcaccgacttccccggcaagaccgtgtggttcgtcccctccatcaagagcggcaacgacatcgccaactgcctgcggaagaacgggaagcgcgtgatccagctgtcccggaagaccttcgacacggagtaccagaagaccaagaacaacgactgggactacgtggtcaccaccgacatcagcgagatgggcgcgaacttccgcgccgaccgggtgatcgacccccgccggtgcctcaagccggtgatcctgaaggacgggcccgagcgcgtcatcctggccggccccatgcccgtgacggtcgcctccgccgcgcagcggcgcgggcggatcggccgcaaccacaacaaggagggcgaccagtacatctacatggggcagccgctcaacaacgacgaggaccacgcccactggaccgaggccaagatgctgctggacaacatcaacacccccgagggcatcatccccgccctcttcgagcccgagcgggagaagtccgccgcgatcgacggggagtaccgcctgcgcggcgaggcccggaagaccttcgtggagctgatgcgccgcggggacctcccggtgtggctgagccacaaggtcgcctccgagggcttccagtacagcgaccgccggtggtgcttcgacggcgagcgcaacaaccaggtgctggaggagaacatggacgtggagatctggacgaaggagggggagcggaagaagctccgcccccggtggctggacgcccgcacctactccgaccccctggccctccgggagttcaaggagttcgcggccggccgccggagcgtctccggggacctgatcctggagatcggcaagctcccccagcacctgacccagcgcgcccagaacgccctggacaacctcgtgatgctgcacaacagcgagcagggcgggcgggcgtaccgccacgccatggaggagctgccggacaccatcgagacgctcatgctgctggccctcatcgccgtgctgaccggcggggtcaccctgttcttcctctccggccgggggctgggcaagaccagcatcggcctgctctgcgtgatggcctccagcgtgctgctgtggatggcgtccgtcgagccccactggatcgccgccagcatcatcctcgagttcttcctgatggtgctgctcatccccgagcccgaccgccagcggaccccgcaggacaaccagctggcctacgtggtcatcgggctcctcttcatgatcctgacggtggccgcgaacgagatgggcctgctcgagaccaccaagaaggacctggggatcggccacgtggccgtcgagaagcaccaccacgccgccatgctggacgtggacctccaccccgcctccgcgtggaccctgtacgccgtggccacgaccatcatcacccccatgatgcgccacaccatcgagaacacgaccgccaacatcagcctgaccgccatcgcgaaccaggccgccatcctcatggggctggacaagggctggccgatctccaagatggacatcggcgtccccctgctcgccctggggtgctacagccaggtgaaccccctgaccctcacggcggccgtgctgatgctggtcgcccactacgccatcatcggccccgggctccaggccaaggcgacccgggaggcccagaagcgcaccgccgccggcatcatgaagaacccgaccgtggacgggatcgtggccatcgacctggaccccgtcgtgtacgacgcgaagttcgagaagcagctgggccagatcatgctcctgatcctgtgcacgtcccagatcctcctgatgcgcaccacctgggccctgtgcgagagcatcaccctcgccacgggccccctgaccaccctgtgggaggggtcccccggcaagttctggaacaccacgatcgccgtgagcatggccaacatcttccgggggagctacctcgcgggcgccggcctggccttctccctgatgaagtccctcgggggcgggcgccggggcaccggggcccagggcgagaccctgggcgagaagtggaagcgccagctgaaccagctctccaagagcgagttcaacacctacaagcggtccgggatcatggaggtcgaccgcagcgaggcgaaggagggcctgaagcgcggggagacgaccaagcacgccgtgtcccgcggcaccgccaagctgcggtggttcgtggagcgcaacctcgtcaagccggaggggaaggtgatcgacctgggctgcggccgcggcgggtggagctactactgcgccgggctgaagaaggtgaccgaggtcaaggggtacacgaagggcgggcccggccacgaggagcccatccccatggccacctacgggtggaacctggtgaagctccactccggcaaggacgtgttcttcatcccgcccgagaagtgcgacaccctgctgtgcgacatcggggagagctcccccaaccccaccatcgaggagggccgcacgctccgggtcctgaagatggtggagccgtggctgcgcgggaaccagttctgcatcaagatcctcaacccctacatgcccagcgtggtcgagaccctggagcagatgcagcggaagcacggcggcatgctggtgcgcaaccccctctcccggaacagcacccacgagatgtactgggtgtcctgcgggaccggcaacatcgtcagcgcggtgaacatgacctcccgcatgctgctgaaccggttcacgatggcccaccgcaagccgacctacgagcgcgacgtggacctcggggccggcacccggcacgtcgccgtggagcccgaggtggccaacctggacatcatcggccagcgcatcgagaacatcaagcacgagcacaagagcacctggcactacgacgaggacaacccctacaagacgtgggcgtaccacgggtcctacgaggtcaagcccagcggcagcgcctccagcatggtgaacggggtcgtgaagctgctcaccaagccgtgggacgtgatccccatggtcacccagatcgccatgaccgacacgacccccttcggccagcagcgggtgttcaaggagaaggtggacacccgcacccccaaggccaagcgggggacggcccagatcatggaggtcaccgcgaagtggctgtggggcttcctgtcccgcaacaagaagccgcggatctgcacccgcgaggagttcacccggaaggtgcgcagcaacgccgccatcggcgccgtgttcgtcgacgagaaccagtggaactccgcgaaggaggccgtggaggacgagcggttctgggacctcgtgcaccgcgagcgggagctgcacaagcaggggaagtgcgccacgtgcgtctacaacatgatgggcaagcgcgagaagaagctgggggagttcggcaaggccaaggggagccgggccatctggtacatgtggctcggcgcgcgcttcctggagttcgaggccctgggcttcatgaacgaggaccactggttctcccgggagaacagcctctccggggtggagggcgaggggctgcacaagctgggctacatcctccgcgacatcagcaagatccccgggggcaacatgtacgccgacgacaccgccggctgggacacccggatcaccgaggacgacctgcagaacgaggccaagatcacggacatcatggagcccgagcacgcgctgctcgccaagtccatcttcaagctgacctaccagaacaaggtggtccgcgtgcagcggccggccaagaacgggaccgtgatggacgtcatcagccgccgcgaccagcggggctccggccaggtgggcacctacggcctgaacacgttcaccaacatggaggcccagctcatccgccagatggagagcgaggggatcttctcccccagcgagctggagacccccaacctggccggccgggtgctcgactggctggagaagcacggggtcgagcgcctgaagcggatggcgatctccggcgacgactgcgtggtgaagcccatcgacgaccgcttcgccaccgccctcacggccctgaacgacatggggaaggtccggaaggacatcccgcagtgggagcccagcaagggctggaacgactggcagcaggtccccttctgcagccaccacttccaccagctgatcatgaaggacggccgcgagatcgtggtcccctgccggaaccaggacgagctcgtggggcgcgcccgggtgtcccagggcgcggggtggagcctgcgcgagaccgcctgcctgggcaagtcctacgcccagatgtggcagctcatgtacttccaccggcgcgacctgcggctggccgcgaacgccatctgcagcgccgtcccggtggactgggtgcccacctcccgcaccacgtggagcatccacgcccaccaccagtggatgaccaccgaggacatgctctccgtctggaaccgggtgtggatcgaggagaacccctggatggaggacaagacccacatcagctcctggggcgacgtgccctacctgggcaagcgcgaggaccagtggtgcggcagcctgatcgggctcacggcccgggcgacctgggccaccaacatccaggtcgccatcaaccaggtgcgccgcctgatcggcaacgagaactacctggactacatgacctccatgaagcggttcaagaacgagagcgacccggagggggccctctggtga

SEQ ID NO: 8472 - RNA, 9879 nt, synthetic construct
  misc_feature 1..9879: note = derived and/or modified CDS sequence (opt1) from DENV-1__FJ898376__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgcgggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtgacctacgggacctgcagccagaccggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgtgatcggcacctccatcacccagaaggggatcatcttcatcctcctgatgctggtcacgcccagcatggccatgcggtgcgtgggcatcggctcccgcgacttcgtggaggggctcagcggcgccacctgggtcgacgtggtgctggagcacgggtcctgcgtcaccaccatggccaaggacaagcccacgctggacatcgagctcctgaagaccgaggtgaccaaccccgccgtgctgcggaagctctgcatcgaggcgaagatcagcaacaccacgaccgactcccgctgccccacccagggcgaggccaccctgatggaggagcaggacgccaacttcgtctgccggcgcacgttcgtggaccggggctgggggaacggctgcgggctgttcggcaaggggagcctcatcacgtgcgccaagttcaagtgcgtgaccaagctggagggcaagatcgtccagtacgagaacctgaagtactccgtgatcgtgaccgtccacacgggcgaccagcaccaggtggggaacgagagcaccgagcacggcaccaccgccaccatcacgccccaggcgcccacctccgagatccagctcaccgactacggggccctgaccctggactgcagcccccgcacgggcctcgacttcaacgagatggtcctgctgaccatgaaggagaagtcctggctcgtgcacaagcagtggttcctggacctgccgctcccctggaccagcggggccagcacctcccaggagacgtggaaccggcaggacctgctggtgaccttcaagaccgcccacgccaagaagcaggaggtcgtggtgctcggcagccaggagggcgcgatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggccgagacgcagcacggcaccgtgctggtccagatcaagtacgagggcaccgacgcgccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccaccgcccgcggggcccggcgcatggccatcctgggcgacacggcgtgggacttcgggtccatcggcggcgtgttcaccagcgtcgggaagctggtgcaccagatcttcggcaccgcctacggggtcctgttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggccgactccgggtgcgtcatcaactggaagggccgggagctcaagtgcgggagcggcatcttcgtgacgaacgaggtgcacacctggaccgagcagtacaagttccaggccgacagcccgaagcgcctgtccgcggccatcggcaaggcctgggaggagggggtctgcggcatccggagcgccacccgcctggagaacatcatgtggaagcagatctccaacgagctcaaccacatcctgctggagaacgacatgaagttcaccgtggtggtcggggacgtggtgggcatcctcgcccaggggaagaagatgatccggccccagcccatggagcacaagtacagctggaagtcctggggcaaggcgaagatcatcggcgccgacgtccagaacacgaccttcatcatcgacgggcccaacaccccggagtgccccgacgaccagcgcgcctggaacatctgggaggtggaggactacggcttcgggatcttcaccacgaacatctggctgaagctgcgggacagccacacccaggtgtgcgaccaccgcctcatgtccgccgcgatcaaggacagcaaggccgtccacgccgacatgggctactggatcgagtccgagaagaacgagacctggaagctggcccgggccagcttcatcgaggtgaagacctgcatctggcccaagtcccacacgctgtggagcaacggcgtgctcgagtccgagatgatcatccccaagatctacgggggcccgatcagccagcacaactaccgccccgggtacttcacccagaccgcgggcccctggcacctggggaagctggagctcgacttcgacctgtgcgagggcaccacggtcgtggtggacgagcactgcggcaaccgggggccgtccctgcgcaccaccaccgtcacgggcaagatcatccacgagtggtgctgccggagctgcaccctgccgcccctccgcttcaagggggaggacggctgctggtacgggatggagatccggcccgtgaaggagaaggaggagaacctggtgaagtccatggtcagcgccggcagcggcgaggtggactccttcagcctcgggctgctgtgcatctccatcatgatcgaggaggtgatgcgcagccggtggtcccgcaagatgctcatgaccggcaccctggccgtcttcctgctcctgatcatggggcagctgacgtggaacgacctcatccggctgtgcatcatggtgggcgccaacgccagcgaccgcatggggatgggcaccacctacctggcgctcatggccaccttcaagatgcgcccgatgttcgccgtggggctgctgttccggcgcctcacgtcccgggaggtcctgctgctcaccatcgggctgagcctggtggcctccgtcgagctccccaacagcctggaggagctgggcgacgggctcgccatgggcatcatgatcctgaagctgctcaccgacttccagtcccaccagctgtgggcgaccctgctcagcctgacgttcatcaagaccaccctgtccctccactacgcctggaagaccatggccatggtgctgagcatcgtgtccctgttccccctctgcctgagcacgacctcccagaagaccacctggctgcccgtcctcctgggcagcctggggtgcaagccgctcgccatgttcctgatcgcggagaacaagatctggggccgcaagtcctggcccctgaacgaggggatcatggccgtgggcgtggtcagcatcctcctgagctccctgctcaagaacgacgtgcccctggccgggcccctgatcgccggcggcatgctcatcgcctgctacgtgatcagcgggtccagcgcggacctgtccctggagaaggccgccgaggtcagctgggaggaggaggccgagcactccggcgccagccacaacatcctcgtggaggtgcaggacgacgggacgatgaagatcaaggacgaggagcgggacgacaccctgaccatcctgctcaaggcgaccctgctggccgtctccggcgtgtacccgctcagcatccccgccaccctgttcgtgtggtacttctggcagaagaagaagcagcgctccggggtcctgtgggacacgcccagcccgcccgaggtggagcgggccgtgctggacgacggcatctaccgcatcatgcagcggggcctcctggggcgctcccaggtcggcgtgggggtgttccaggagaacgtcttccacaccatgtggcacgtgacccggggcgccgtgctgatgtaccaggggaagcgcctcgagcccagctgggcgtccgtcaagaaggacctgatcagctacggcggcgggtggcggctgcagggctcctggaacaccggggaggaggtccaggtgatcgccgtcgagcccggcaagaaccccaagaacgtgcagacggcccccgggaccttcaagacccccgagggcgaggtgggcgccatcgccctcgacttcaagcccgggaccagcggctcccccatcgtcaaccgcgaggggaagatcgtgggcctgtacggcaacggggtggtcacgaccagcggcacctacgtgagcgcgatcgcccaggccaaggcctcccaggaggggccgctgcccgagatcgaggacgaggtgttccggaagcgcaacctcaccatcatggacctgcaccccggcagcgggaagacgcggcgctacctgccggcgatcgtccgggaggccatcaagcgcaagctccggaccctgatcctggcccccacccgcgtggtggcctccgagatggccgaggcgctcaagggcatgcccatccgctaccagaccacggccgtcaagagcgagcacaccggcaaggagatcgtggacctgatgtgccacgccaccttcaccatgcggctgctctcccccgtgcgcgtcccgaactacaacatgatcatcatggacgaggcccacttcacggaccccagctccatcgccgcgcgggggtacatcagcacccgcgtgggcatgggggaggccgccgccatcttcatgaccgccacgccgcccggctccgtggaggcgttcccgcagagcaacgccgtcatccaggacgaggagcgggacatccccgagcgctcctggaacagcgggtacgagtggatcacggacttccccggcaagaccgtgtggttcgtgccctccatcaagagcggcaacgacatcgccaactgcctgcggaagaacgggaagcgcgtcatccagctgtcccggaagaccttcgacaccgagtaccagaagacgaagaacaacgactgggactacgtggtgaccaccgacatcagcgagatgggcgccaacttccgcgcggaccgggtcatcgacccgcgccggtgcctcaagcccgtgatcctgaaggacgggcccgagcgcgtcatcctggccggccccatgccggtgaccgtggcctccgccgcccagcggcgcgggcggatcggccgcaaccacaacaaggagggcgaccagtacatctacatggggcagcccctcaacaacgacgaggaccacgcgcactggacggaggccaagatgctgctggacaacatcaacacccccgagggcatcatccccgccctcttcgagccggagcgggagaagtccgccgccatcgacggggagtaccgcctgcgcggcgaggcgcggaagaccttcgtcgagctgatgcgccgcggggacctccccgtgtggctgtcctacaaggtggccagcgagggcttccagtacagcgaccgccggtggtgcttcgacggcgagcgcaacaaccaggtcctggaggagaacatggacgtggagatctggaccaaggagggggagcggaagaagctccgcccccggtggctggacgcccgcacgtactccgaccccctggccctccgggagttcaaggagttcgccgcgggccgccggagcgtgtccggggacctgatcctggagatcggcaagctcccgcagcacctgacccagcgcgcccagaacgccctggacaacctcgtcatgctgcacaacagcgagcagggcgggcgggcctaccgccacgcgatggaggagctgcccgacaccatcgagaccctcatgctgctggccctcatcgccgtgctgacgggcggggtgaccctgttcttcctctccggccgggggctgggcaagaccagcatcggcctgctctgcgtcatggcctccagcgtgctgctgtggatggcctccgtggagccccactggatcgcggccagcatcatcctcgagttcttcctgatggtcctgctcatccccgagccggaccgccagcggacgccccaggacaaccagctggcctacgtggtgatcgggctcctcttcatgatcctgaccgtcgccgccaacgagatgggcctgctcgagacgaccaagaaggacctggggatcggccacgtggcggtggagaaccaccaccacgccaccatgctggacgtcgacctccaccccgcctccgcctggaccctgtacgccgtggcgacgaccatcatcaccccgatgatgcgccacaccatcgagaacacgaccgccaacatcagcctgaccgccatcgccaaccaggccgcgatcctcatggggctggacaagggctggcccatctccaagatggacatcggcgtgcccctgctcgccctggggtgctacagccaggtcaaccccctgaccctcacggccgccgtgctgatgctggtggcgcactacgccatcatcggcccggggctccaggccaaggccacccgggaggcccagaagcgcaccgcggccggcatcatgaagaaccccaccgtcgacgggatcgtggccatcgacctggaccccgtggtctacgacgccaagttcgagaagcagctgggccagatcatgctcctgatcctgtgcacgtcccagatcctcctgatgcgcaccacctgggccctgtgcgagagcatcaccctcgcgacgggccccctgaccaccctgtgggaggggtccccgggcaagttctggaacaccacgatcgccgtgagcatggccaacatcttccgggggtcctacctcgccggcgccggcctggcgttcagcctgatgaagtccctcgggggcgggcgccggggcaccggggcccagggcgagaccctgggcgagaagtggaagcgccagctgaaccagctctccaagagcgagttcaacatctacaagcggtccgggatcatggaggtggaccgcagcgaggccaaggagggcctgaagcgcggggagaccacgcgccacgccgtctcccggggcaccgcgaagctgcgctggttcgtggagcggaacctggtgaagcccgaggggaaggtcatcgacctcggctgcggccgcgggggctggagctactactgcgccgggctgaagaaggtgaccgaggtgaagggctacaccaagggcgggcccggccacgaggagcccatcccgatggccacgtacgggtggaacctggtcaagctccactccggcaaggacgtgttcttcacgccgcccgagaagtgcgacaccctgctgtgcgacatcggggagagctcccccaacccgaccatcgaggagggccggacgctccgcgtgctgaagatggtcgagccctggctgcgggggaaccagttctgcatcaagatcctcaacccctacatgcccagcgtggtggagaccctggagcagatgcagcgcaagcacggcggcatgctggtccggaacccgctctcccgcaacagcacccacgagatgtactgggtgtcctgcgggaccggcaacatcgtgagcgccgtcaacatgacctcccggatgctgctgaaccgcttcacgatggcccaccgcaagcccacctacgagcgggacgtggacctcggggcgggcacccgccacgtggccgtcgagcccgaggtggccaacctggacatcatcggccagcggatcgagaacatcaagcacgagcacaagagcacctggcactacgacgaggacaacccctacaagacgtgggcctaccacgggtcctacgaggtcaagccgagcggctccgccagcagcatggtgaacggggtggtcaagctgctcaccaagccctgggacgtgatccccatggtgacccagatcgcgatgaccgacacgacccccttcggccagcagcgcgtcttcaaggagaaggtggacacccggaccccgaaggccaagcgcgggacggcccagatcatggaggtgaccgcccggtggctgtggggcttcctgtcccgcaacaagaagccccggatctgcacccgcgaggagttcacccggaaggtccgcagcaacgccgcgatcggcgccgtgttcgtggacgagaaccagtggaactccgccaaggaggccgtcgaggacgagcggttctgggacctcgtgcagaaggagcgcgagctgcacaagcaggggaagtgcgcgacgtgcgtgtacaacatgatgggcaagcgggagaagaagctgggggagttcggcaaggccaaggggagccgcgccatctggtacatgtggctcggcgcccggttcctggagttcgaggccctgggcttcatgaacgaggaccactggttctcccgcgagaacagcctctccggggtcgagggcgaggggctgcacaagctgggctacatcctccgggacatcagcaagatccccgggggcaacatgtacgcggacgacaccgccggctgggacacccgcatcaccgaggacgacctgcagaacgaggccaagatcacggacatcatggagccggagcacgccctgctcgccacctccatcttcaagctgacctaccagaacaaggtggtgcgggtccagcgccccgcgaagaacgggaccgtgatggacgtgatcagccgccgggaccagcgcggctccgggcaggtcggcacgtacggcctgaacaccttcaccaacatggaggcccagctcatccggcagatggagagcgaggggatcttcctgccctccgagctggagacccagaacctcgccgagcgcgtgctggactggctggagaagtacggcgtggagcggctcaagcgcatggccatcagcggggacgactgcgtcgtgaagcccatcgacgaccggttcgccacggcgctgaccgccctgaacgacatgggcaaggtgcgcaaggacatcccgcagtgggagccctccaaggggtggaacgactggcagcaggtccccttctgcagccaccacttccaccagctcatcatgaaggacggccgggagatcgtggtgccctgccgcaaccaggacgagctggtcggccgggcccgcgtgtcccagggggccggctggagcctgcgggagaccgcctgcctcggcaagagctacgcgcagatgtggcagctgatgtacttccaccgccgggacctgcgcctcgccgccaacgccaactgctccgcggtgccggtcgactgggtgcccaccagccggacgacctggtccatccacgcccaccaccagtggatgaccaccgaggacatgctgagcgtgtggaaccgcgtctggatcgaggagaacccctggatggaggacaagacgcacgtgtccagctggggcgacgtgccctacctggggaagcgggaggaccagtggtgcggctccctcatcggcctgaccgcccgcgccacctgggccagcaacatccaggtcgcgatcaaccaggtgcgccggctgatcgggaacgagaactacctcgactacatgacctccatgaagcgcttcaagaacgagggcgacccggagggggccctgtggtga

SEQ ID NO: 8473 - RNA, 9879 nt, synthetic construct
  misc_feature 1..9879: note = derived and/or modified CDS sequence (opt1) from DENV-1__FJ898379__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgggacaagcggtccgtggccctcgcgccccacgtgggcctggggctggagacccgcaccgagacctggatgagctccgagggcgcgtggaagcagatccagcgggtcgagacgtgggccctccggcaccccgggttcaccgtgatcgccctgttcctggcccacgtgatcggcaccagcatcacccagaaggggatcatcttcatcctcctgatgctggtcacgccctccatggcgatgcggtgcgtgggcatcggcagccgcgacttcgtggaggggctctccggcgccacctgggtcgacgtggtgctggagcacgggagctgcgtcaccaccatggccaaggacaagcccacgctggacatcgagctcctgaagaccgaggtgaccaaccccgccgtgctgcggaagctctgcatcgaggccaagatctccaacaccacgaccgacagccgctgcccgacccagggcgaggcgaccctggtcgaggagcaggacgccaacttcgtgtgccggcgcacgttcgtggaccggggctgggggaacggctgcgggctgttcggcaaggggtccctcatcacgtgcgccaagttcaagtgcgtcaccaagctggagggcaagatcgtgcagtacgagaacctgaagtacagcgtgatcgtcaccgtgcacacgggcgaccagcaccaggtcgggaacgagtccaccgagcacggcaccaccgccaccatcacgccccaggcccccaccaccgagatccagctcaccgactacggggcgctgacgctggactgcagcccccgcaccggcctcgacttcaacgagatggtgctgctgaccatgaaggagaagtcctggctcgtgcacaagcagtggttcctggacctgcccctcccctggaccagcggggccagcacgtcccaggagacctggaaccggcaggacctgctggtcaccttcaagaccgcccacgccaagaagcaggaggtggtggtcctcggcagccaggagggcgccatgcacacggcgctgaccggggccaccgagatccagacctccggcacgaccaccatcttcgccgggcacctgaagtgccgcctcaagatggacaagctgaccctgaagggcatgagctacgtgatgtgcacggggtccttcaagctcgagaaggaggtggccgagacccagcacggcaccgtcctggtgcagatcaagtacgagggcaccgacgccccctgcaagatccccttcagcacgcaggacgagaagggggtgacccagaacggccggctgatcaccgcgaacccgatcgtcaccgacaaggagaagcccgtgaacatcgaggccgagccgcccttcggggagtcctacatcatcatcggcgccggcgagaaggccctgaagctcagctggttcaagaaggggtccagcatcggcaagatgttcgaggcgacggcccgcggggcccggcgcatggccatcctgggcgacaccgcctgggacttcgggtccatcggcggcgtgttcaccagcgtcgggaagctggtgcaccagatcttcggcaccgcgtacggggtgctgttctccggcgtcagctggacgatgaagatcgggatcggcgtgctgctgacctggctcggcctgaactcccgcagcacctccctgagcatgacctgcatcgccgtggggctcgtcacgctgtacctgggcgtgatggtgcaggccgactccgggtgcgtcatcaactggaagggccgggagctcaagtgcgggagcggcatcttcgtgaccaacgaggtgcacacctggaccgagcagtacaagttccaggccgacagcccgaagcgcctgtccgccgcgatcggcaaggcctgggaggagggggtctgcggcatccggagcgccacccgcctggagaacatcatgtggaagcagatctccaacgagctcaaccacatcctgctggagaacgacatgaagttcacggtggtggtcggggacgtggccggcatcctcgcccaggggaagaagatgatccggccccagcccatggagtacaagtacagctggaagtcctggggcaaggcgaagatcatcggcgccgacgtgcagaacaccaccttcatcatcgacgggcccaacaccccggagtgccccgacgaccagcgcgcctggaacatctgggaggtcgaggactacggcttcgggatcttcacgaccaacatctggctgaagctgcgggacagctacacccaggtgtgcgaccaccgcctcatgtccgccgcgatcaaggacagcaaggccgtgcacgccgacatgggctactggatcgagtccgagaagaacgagacctggaagctggcccgggccagcttcatcgaggtcaagacgtgcatctggcccaagtcccacaccctgtggagcaacggcgtgctcgagtccgagatgatcatccccaagatctacgggggcccgatcagccagcacaactaccgccccgggtacttcacccagaccgcgggcccctggcacctggggaagctggagctcgacttcgacctgtgcgagggcacgaccgtggtcgtggacgagcactgcggcaaccgggggccgtccctgcgcaccaccacggtgaccggcaagatcatccacgagtggtgctgccggagctgcaccctgccgcccctccgcttccgcggggaggacggctgctggtacgggatggagatccgccccgtcaaggagaaggaggagaacctggtgaagtccatggtgagcgccggcagcggcgaggtcgactccttcagcctcgggctgctgtgcatctccatcatgatcgaggaggtgatgcggagccgctggtcccggaagatgctcatgaccggcacgctggccgtgttcttcctgctcatcatggggcagctgacctggaacgacctgatccgcctctgcatcatggtcggcgccaacgccagcgaccgcatggggatgggcaccacctacctggcgctgatggccacgttcaagatgcggccgatgttcgccgtgggcctcctgttccgccggctgacctcccgcgaggtgctcctgctgaccatcgggctcagcctggtcgcctccgtggagctgcccaacagcctcgaggagctgggcgacgggctggccatgggcatcatgatcctcaagctgctgaccgacttccagtcccaccagctctgggcgacgctgctgagcctcaccttcatcaagaccaccttctccctgcactacgcctggaagacgatggccatggtcctgagcatcgtgtccctcttccccctgtgcctgagcaccacctcccagaagaccacgtggctccccgtgctgctgggcagcctcgggtgcaagccgctgaccatgttcctgatcgccgagaacaagatctggggccggcgctcctggcccctcaacgaggggatcatggcggtcggcatcgtgagcatcctgctgagctccctcctgaagaacgacgtgcccctggccgggcccctcatcgccggcggcatgctgatcgcctgctacgtcatcagcgggtccagcgccgacctgtccctcgagaaggcggccgaggtgagctgggaggaggaggccgagcactccggcgccagccacaacatcctggtggaggtccaggacgacgggaccatgaagatcaaggacgaggagcgggacgacaccctgaccatcctcctgaaggccacgctgctcgcggtgtccggcgtgtacccgctgagcatccccgccaccctgttcgtctggtacttctggcagaagaagaagcagcgctccggggtgctctgggacacccccagcccgcccgaggtggagcgggccgtcctggacgacggcatctaccgcatcatgcagcggggcctgctggggcgctcccaggtgggcgtgggggtcttccaggagaacgtgttccacaccatgtggcacgtgacgcggggcgccgtcctcatgtaccaggggaagcgcctggagcccagctgggcctccgtgaagaaggacctgatcagctacggcggcgggtggcggctccagggctcctggaacaccggggaggaggtgcaggtcatcgcggtggagcccggcaagaaccccaagaacgtgcagaccgcccccgggaccttcaagacgcccgagggcgaggtcggcgccatcgccctggacttcaagcccgggaccagcggctcccccatcgtgaaccgcgaggggaagatcgtgggcctgtacggcaacggggtcgtgaccaccagcggcacgtacgtgagcgccatcgcgcaggccaaggcctcccaggaggggccgctccccgagatcgaggacgaggtcttccggaagcgcaacctgaccatcatggacctgcaccccggcagcgggaagacccggcgctacctcccggccatcgtgcgggaggcgatcaagcgcaagctgcgcaccctgatcctcgcccccacgcgggtggtcgcctccgagatggccgaggccctgaagggcatgcccatccgctaccagaccaccgcggtcaagagcgagcacaccggcaaggagatcgtggacctgatgtgccacgccacgttcaccatgcggctcctgtcccccgtccgcgtgccgaactacaacatgatcatcatggacgaggcccacttcaccgaccccagctccatcgccgcccgggggtacatcagcacccgcgtgggcatgggggaggcggccgccatcttcatgacggccacgccgcccggctccgtcgaggccttcccgcagagcaacgcggtgatccaggacgaggagcgggacatccccgagcgctcctggaacagcgggtacgagtggatcaccgacttccccggcaagaccgtgtggttcgtcccctccatcaagagcggcaacgacatcgccaactgcctgcggaagaacgggaagcgcgtgatccagctctcccggaagacgttcgacaccgagtaccagaagaccaagaacaacgactgggactacgtggtcaccacggacatcagcgagatgggcgccaacttccgcgccgaccgggtgatcgacccgcgccggtgcctgaagcccgtgatcctgaaggacgggcccgagcgcgtcatcctcgcgggccccatgccggtgaccgtcgcctccgccgcccagcggcgcgggcggatcggccgcaaccacaacaaggagggcgaccagtacatctacatggggcagcccctgaacaacgacgaggaccacgcccactggaccgaggcgaagatgctgctcgacaacatcaacacccccgagggcatcatccccgccctgttcgagccggagcgcgagaagtccgccgccatcgacggggagtaccggctgcgcggcgaggcccggaagacgttcgtggagctcatgcgccgcggggacctgcccgtgtggctgtcctacaaggtcgcgagcgagggcttccagtacagcgaccgccggtggtgcttcgacggcgagcgcaacaaccaggtgctcgaggagaacatggacgtggagatctggaccaaggagggggagcggaagaagctgcgcccccggtggctggacgcccgcacctactccgaccccctcgccctgcgggagttcaaggagttcgccgccggccgccggagcgtctccggggacctgatcctcgagatcggcaagctgccgcagcacctgacccagcgcgcgcagaacgccctcgacaacctggtgatgctgcacaacagcgagcagggcgggcgggcctaccgccacgccatggaggagctccccgacacgatcgagaccctgatgctgctcgcgctgatcgccgtgctgaccggcggggtcaccctcttcttcctgtccggccgggggctgggcaagaccagcatcggcctcctgtgcgtgatggcctccagcgtgctgctctggatggcctccgtcgagccccactggatcgccgcgagcatcatcctggagttcttcctgatggtgctcctgatccccgagccggaccgccagcggacgccccaggacaaccagctggcctacgtggtcatcgggctcctgttcatgatcctgaccgtggccgccaacgagatgggcctcctggagaccaccaagaaggacctggggatcggccacgtggccgtcgagaaccaccaccacgcggccatgctcgacgtggacctgcaccccgcctccgcctggacgctgtacgccgtggcgaccaccatcatcaccccgatgatgcgccacacgatcgagaacaccaccgccaacatcagcctcaccgccatcgccaaccaggccgcgatcctgatggggctggacaagggctggcccatctccaagatggacatcggcgtccccctcctggccctggggtgctacagccaggtgaaccccctcacgctgaccgccgccgtgctgatgctcgtcgcgcactacgccatcatcggcccggggctgcaggccaaggccacccgcgaggcccagaagcggaccgcggccggcatcatgaagaaccccacggtggacgggatcgtggccatcgacctggaccccgtcgtgtacgacgccaagttcgagaagcagctcggccagatcatgctgctgatcctctgcacctcccagatcctgctgatgcgcaccacctgggccctctgcgagagcatcacgctggcgaccggccccctgaccaccctctgggaggggtccccgggcaagttctggaacacgaccatcgccgtgagcatggccaacatcttccgggggtcctacctggccggcgccggcctggcgttcagcctcatgaagtccctcgggggcgggcgccgggggaccggggcccagggcgagaccctgggcgagaagtggaagcgccagctcaaccagctgtccaagagcgagttcaacacgtacaagcggtccgggatcatggaggtcgaccgcagcgaggccaaggagggcctgaagcgcggggagaccaccaagcacgccgtgtcccgcggcaccgcgaagctccggtggttcgtggagcgcaacctggtcaagcccgaggggaaggtgatcgacctgggctgcggccgcgggggctggagctactactgcgccgggctgaagaaggtgacggaggtcaagggctacaccaagggcggccccggccacgaggagcccatcccgatggccacctacgggtggaacctcgtgaagctgcactccggcaaggacgtgttcttcatcccgcccgagaagtgcgacaccctgctctgcgacatcggggagagctcccccaacccgacgatcgaggagggccgcaccctgcgggtcctgaagatggtggagccctggctccgcgggaaccagttctgcatcaagatcctgaacccctacatgcccagcgtggtcgagaccctggagcagatgcagcggaagcacggcggcatgctcgtgcgcaacccgctgtcccggaacagcacccacgagatgtactgggtgtcctgcgggaccggcaacatcgtcagcgccgtgaacatgacgtcccgcatgctgctcaaccgcttcaccatggcccaccggaagcccacctacgagcgcgacgtggacctgggggcgggcacccggcacgtcgccgtggagcccgaggtggccaacctggacatcatcggccagcgcatcgagaacatcaagcacgagcacaagagcacgtggcactacgacgaggacaacccctacaagacctgggcctaccacgggtcctacgaggtcaagccgagcggctccgccagcagcatggtgaacggggtcgtgaagctcctgaccaagccctgggacgtgatccccatggtcacccagatcgcgatgacggacaccacccccttcggccagcagcgggtgttcaaggagaaggtggacacccgcacgccgaaggccaagcgggggaccgcccagatcatggaggtcaccgccaagtggctgtggggcttcctctcccgcaacaagaagccccggatctgcacccgcgaggagttcacgcggaaggtgcgcagcaacgccgcgatcggcgccgtgttcgtcgacgagaaccagtggaactccgccaaggaggccgtggaggacgagcggttctgggacctggtgcaccgcgagcgggagctgcacaagcaggggaagtgcgcgacctgcgtctacaacatgatgggcaagcgcgagaagaagctcggggagttcggcaaggccaaggggagccgggccatctggtacatgtggctgggcgcccgcttcctggagttcgaggccctcggcttcatgaacgaggaccactggttctcccgggagaacagcctgtccggggtggagggcgaggggctgcacaagctcggctacatcctgcgcgacatcagcaagatccccgggggcaacatgtacgcggacgacaccgccggctgggacacccggatcacggaggacgacctgcagaacgaggcccgcatcaccgacatcatggagccggagcacgccctcctggccaagtccatcttcaagctgacctaccagaacaaggtggtccgcgtgcagcggcccgcgaagaacgggaccgtgatggacgtcatcagccgccgggaccagcgcggctccggccaggtggggacgtacggcctcaacaccttcaccaacatggaggcccagctgatccggcagatggagagcgaggggatcttctcccccagcgagctggagacccccaacctcgccgagcgcgtgctggactggctggagaagtacggcgtcgagcggctcaagcgcatggccatctccggggacgactgcgtggtgaagccgatcgacgaccggttcgccacggcgctgaccgccctgaacgacatgggcaaggtccgcaaggacatcccccagtgggagcccagcaaggggtggaacgactggcagcaggtccccttctgctcccaccacttccaccagctcatcatgaaggacggccgggagatcgtggtcccgtgccgcaaccaggacgagctggtgggccgggcccgcgtgagccagggggccggctggagcctgcgggagaccgcctgcctcgggaagtcctacgcgcagatgtggcagctgatgtacttccaccgccgggacctgcgcctcgccgccaacgccatctgcagcgcggtccccgtggactggatccccacctcccggacgacctggagcatccacgcccaccaccagtggatgaccaccgaggacatgctgtccgtgtggaaccgcgtctggatcgaggagaacccctggatggaggacaagacgcacatcagctcctggggcgacgtgccgtacctggggaagcgcgaggaccagtggtgcggcagcctcatcggcctgaccgcccgggccacctgggccaccaacatccaggtggcgatcaaccaggtccgccggctgatcgggaacgagaactacctcgactacatgacctccatgaagcgcttcaagaacgagagcgaccccgagggcgccctgtggtga

SEQ ID NO: 8474 - RNA, 9879 nt, synthetic construct
  misc_feature 1..9879: note = derived and/or modified CDS sequence (opt1) from DENV-1__GQ199773__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagttctgcgaggacacgatgacctacaagtgcccccgcatcaccgaggccgagcccgacgacgtggactgctggtgcaacgccaccgacacctgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagaccgtccagtacgagaacctgaagtacagcgtgaccgtgacggtccacaccggcgaccagcaccaggtggggaacgagtccaccgagcacggcaccaccgcgacgatcacgccccaggcccccagcaccgagatccagctgaccgactacggggccctcacgctggactgcagcccccggaccggcctggacttcaacgagatggtcctcctgaccatgaaggagaagtcctggctggtgcacaagcagtggttcctcgacctgccgctgccctggaccagcggggcctccacgagccaggagacctggaaccggaaggacctcctggtgaccttcaagaccgcccacgcgaagaagcaggaggtcgtggtgctgggctcccaggagggcgccatgcacacggccctcaccggggccaccgagatccagaccagcggcacgaccaccatcttcgccgggcacctgaagtgccgcctgaagatggacaagctcaccctgaagggcatgtcctacgtcatgtgcacggggagcttcaagctggagaaggaggtggcggagacccagcacggcaccgtgctcgtccagatcaagtacgagggcaccgacgccccctgcaagatccccttctccacgcaggacgagaagggggtgacccagaacggccggctgatcaccgccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccacggcccgcggggcccggcgcatggcgatcctcggcgacaccgcctgggacttcgggagcatcggcggcgtgttcacctccgtcgggaagctggtgcaccagatcttcggcaccgcctacggggtgctgttcagcggcgtctcctggacgatgaagatcgggatcggcgtgctcctgacctggctgggcctcaacagccgctccaccagcctgtccatgacctgcatcgccgtggggctggtcacgctctacctgggcgtgatggtgcaggccgacagcgggtgcgtcatcaactggaagggccgggagctgaagtgcgggagcggcatcttcgtgaccaacgaggtgcacacctggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagttcacggtggtggtcggggacgtggcgggcatcctggcccaggggaagaagatgatccggccccagcccatggagtacaagtactcctggaagtcctggggcaaggccaagatcatcggcgccgacgtgcagaacaccaccttcatcatcgacgggcccaacaccccggagtgccccgacgaccagcgcgcgtggaacatctgggaggtcgaggactacggcttcgggatcttcacgaccaacatctggctcaagctgcgggactcctacacccaggtgtgcgaccaccgcctgatgagcgccgccatcaaggactccaaggccgtgcacgccgacatgggctactggatcgagagcgagaagaacgagacctggaagctcgcgcgggcctccttcatcgaggtcaagacgtgcatctggcccaagagccacaccctgtggtccaacggcgtgctggagagcgagatgatcatccccaagatctacgggggcccgatctcccagcacaactaccgccccgggtacttcacccagaccgccggcccctggcacctcgggaagctggagctggacttcgacctctgcgagggcacgaccgtggtcgtggacgagcactgcggcaaccgggggccgagcctgcgcaccaccacggtgaccggcaagatcatccacgagtggtgctgccggtcctgcaccctgccgcccctgcgcttcaagggggaggacggctgctggtacgggatggagatccggcccgtcaaggagaaggaggagaacctggtcaagagcatggtgagcgccggctccggcgaggtcgacagcttctccctggggctcctgtgcatcagcatcatgatcgaggaggtgatgcgctcccggtggagccgcaagatgctgatgaccggcacgctcgccgtgttcttcctgctgatcatggggcagctcacctggaacgacctgatccggctgtgcatcatggtcggcgcgaacgcctccgaccgcatggggatgggcaccacctacctcgccctgatggccacgttcaagatgcgcccgatgttcgccgtggggctcctgttccggcgcctgaccagccgggaggtgctgctcctgaccatcgggctgtccctcgtcgcgagcgtggagctgcccaactccctggaggagctcggcgacgggctggccatgggcatcatgatcctgaagctcctgaccgacttccagagccaccagctgtgggccacgctcctgtccctgaccttcatcaagaccaccttcagcctccactacgcctggaagacgatggcgatggtcctgtccatcgtgagcctgttccccctctgcctgtccaccaccagccagaagaccacgtggctgcccgtgctcctgggctccctggggtgcaagccgctcaccatgttcctgatcgccgagaacaagatctggggccgcaagagctggcccctgaacgaggggatcatggccgtcggcatcgtgagcatcctcctgtccagcctgctcaagaacgacgtgcccctggccgggcccctgatcgccggcggcatgctcatcgcgtgctacgtcatctccgggagctccgccgacctgagcctggagaaggccgccgaggtgtcctgggaggaggaggccgagcacagcggcgcgtcccacaacatcctcgtggaggtccaggacgacgggaccatgaagatcaaggacgaggagcgggacgacaccctgaccatcctgctcaaggccacgctgctggccgtgagcggcgtgtacccgctctccatccccgccaccctgttcgtctggtacttctggcagaagaagaagcagcgcagcggggtgctgtgggacacccccagcccgcccgaggtggagcgggccgtcctcgacgacggcatctaccgcatcatgcagcggggcctgctggggcgcagccaggtgggcgtgggggtcttccaggagaacgtgttccacaccatgtggcacgtgacgcggggcgcggtcctgatgtaccaggggaagcgcctcgagccctcctgggccagcgtgaagaaggacctgatctcctacggcggcgggtggcggctgcagggcagctggaacaccggggaggaggtgcaggtcatcgccgtggagcccggcaagaaccccaagaacgtgcagaccgcccccgggaccttcaagacgtccgagggcgaggtcggcgccatcgcgctcgacttcaagcccgggaccagcggcagccccatcgtgaaccgcgaggggaagatcgtgggcctgtacggcaacggggtcgtgaccacctccggcacgtacgtgagcgccatcgcccaggccaaggcgtcccaggaggggcccctgccggagatcgaggacgaggtcttccggaagcgcaacctcaccatcatggacctgcaccccggcagcgggaagacccggcgctacctgcccgccatcgtgcgggaggccatcaagcgcaagctccggaccctgatcctggccccgacgcgcgtggtcgcctccgagatggcggaggccctcaagggcatgcccatccgctaccagaccaccgccgtcaagagcgagcacaccggcaaggagatcgtggacctgatgtgccacgccacgttcaccatgcggctgctctcccccgtccgcgtgcccaactacaacatgatcatcatggacgaggcccacttcaccgacccgagctccatcgcggcccgggggtacatcagcacccgcgtgggcatgggggaggccgccgccatcttcatgacggcgacgccgcccggctccgtcgaggccttcccccagagcaacgccgtgatccaggacgaggagcgggacatcccggagcgctcctggaacagcgggtacgagtggatcaccgacttccccggcaagaccgtgtggttcgtcccctccatcaagagcggcaacgacatcgccaactgcctgcggaagaacgggaagcgcgtgatccagctgtcccggaagacgttcgacaccgagtaccagaagaccaagaacaacgactgggactacgtggtcaccacggacatcagcgagatgggcgcgaacttccgcgccgaccgggtgatcgacccccgccggtgcctcaagccggtgatcctgaaggacgggcccgagcgcgtcatcctggccggccccatgcccgtgaccgtcgcctccgccgcgcagcggcgcgggcggatcggccgcaaccacaacaaggagggcgaccagtacatctacatggggcagccgctcaacaacgacgaggaccacgcccactggaccgaggccaagatgctgctggacaacatcaacacccccgagggcatcatccccgccctcttcgagcccgagcgggagaagtccgccgcgatcgacggggagtaccgcctgcgcggcgaggcccggaagacgttcgtggagctgatgcgccgcggggacctcccggtgtggctgagctacaaggtcgcctccgagggcttccagtacagcgaccgccggtggtgcttcgacggcgagcgcaacaaccaggtgctggaggagaacatggacgtggagatctggaccaaggagggggagcggaagaagctccgcccccggtggctggacgcccgcacctactccgaccccctggccctccgggagttcaaggagttcgcggccggccgccggagcgtctccggggacctgatcctggagatcggcaagctcccccagcacctgacccagcgcgcccagaacgccctggacaacctcgtgatgctgcacaacagcgagcagggcgggcgggcgtaccgccacgccatggaggagctgccggacacgatcgagaccctcatgctgctggccctcatcgccgtgctgaccggcggggtcaccctgttcttcctctccggccgggggctgggcaagaccagcatcggcctgctctgcgtgatggcctccagcgtgctgctgtggatggcgtccgtcgagccccactggatcgccgccagcatcatcctcgagttcttcctgatggtgctgctcatccccgagcccgaccgccagcggacgccgcaggacaaccagctggcctacgtggtcatcgggctcctcttcatgatcctgaccgtggccgcgaacgagatgggcctgctcgagaccaccaagaaggacctggggatcggccacgtggccgtcgagaaccaccaccacgccgccatgctggacgtggacctccaccccgcctccgcgtggacgctgtacgccgtggccaccaccatcatcacccccatgatgcgccacacgatcgagaacaccaccgccaacatcagcctgaccgccatcgcgaaccaggccgccatcctcatggggctggacaagggctggccgatctccaagatggacatcggcgtccccctgctcgccctggggtgctacagccaggtgaaccccctgacgctcaccgcggccgtgctgatgctggtcgcccactacgccatcatcggccccgggctccaggccaaggcgacccgggaggcccagaagcgcaccgccgccggcatcatgaagaacccgacggtggacgggatcgtggccatcgacctggaccccgtcgtgtacgacgcgaagttcgagaagcagctgggccagatcatgctcctgatcctgtgcacctcccagatcctcctgatgcgcaccacctgggccctgtgcgagagcatcacgctcgccaccggccccctgaccaccctgtgggaggggtcccccggcaagttctggaacacgaccatcgccgtgagcatggccaacatcttccgggggagctacctcgcgggcgccggcctggccttctccctgatgaagtccctcgggggcgggcgccggggcaccggggcccagggcgagaccctgggcgagaagtggaagcgccagctgaaccagctctccaagagcgagttcaacacgtacaagcggtccgggatcatggaggtcgaccgcagcgaggcgaaggagggcctgaagcgcggggagaccaccaagcacgccgtgtcccgcggcaccgccaagctgcggtggttcgtggagcgcaacctcgtcaagccggaggggaaggtgatcgacctgggctgcggccgcggcgggtggagctactactgcgccgggctgaagaaggtgacggaggtcaaggggtacaccaagggcgggcccggccacgaggagcccatccccatggccacctacgggtggaacctggtgaagctccactccggcaaggacgtgttcttcatcccgcccgagaagtgcgacaccctgctgtgcgacatcggggagagctcccccaaccccacgatcgaggagggccgcaccctccgggtcctgaagatggtggagccgtggctgcgcgggaaccagttctgcatcaagatcctcaacccctacatgcccagcgtggtcgagaccctggagcagatgcagcggaagcacggcggcatgctggtgcgcaaccccctctcccggaacagcacccacgagatgtactgggtgtcctgcgggaccggcaacatcgtcagcgcggtgaacatgacgtcccgcatgctgctgaaccggttcaccatggcccaccgcaagccgacctacgagcgcgacgtggacctcggggccggcacccggcacgtcgccgtggagcccgaggtggccaacctggacatcatcggccagcgcatcgagaacatcaagcacgagcacaagagcacgtggcactacgacgaggacaacccctacaagacctgggcgtaccacgggtcctacgaggtcaagcccagcggcagcgcctccagcatggtgaacggggtcgtgaagctgctcaccaagccgtgggacgtgatccccatggtcacccagatcgccatgacggacaccacccccttcggccagcagcgggtgttcaaggagaaggtggacacccgcacgcccaaggccaagcgggggaccgcccagatcatggaggtcaccgcgaagtggctgtggggcttcctgtcccgcaacaagaagccgcggatctgcacccgcgaggagttcacgcggaaggtgcgcagcaacgccgccatcggcgccgtgttcgtcgacgagaaccagtggaactccgcgaaggaggccgtggaggacgagcggttctggaacctcgtgcaccgcgagcgggagctgcacaagcaggggaagtgcgcgacctgcgtctacaacatgatgggcaagcgcgagaagaagctgggggagttcggcaaggccaaggggagccgggccatctggtacatgtggctcggcgcgcgcttcctggagttcgaggccctgggcttcatgaacgaggaccactggttctcccgggagaacagcctctccggggtggagggcgaggggctgcacaagctgggctacatcctccgcgacatcagcaagatccccgggggcaacatgtacgccgacgacaccgccggctgggacacccggatcacggaggacgacctgcagaacgaggccaagatcaccgacatcatggagcccgagcacgcgctgctcgccaagtccatcttcaagctgacctaccagaacaaggtggtccgcgtgcagcggccggccaagaacgggaccgtgatggacgtcatcagccgccgcgaccagcggggctccggccaggtgggcacgtacggcctgaacaccttcaccaacatggaggcccagctcatccgccagatggagagcgaggggatcttctcccccagcgagctggagacccccaacctggccggccgggtgctcgactggctggagaagcacggggtcgagcgcctgaagcggatggcgatctccggcgacgactgcgtggtgaagcccatcgacgaccgcttcgccacggccctcaccgccctgaacgacatggggaaggtccggaaggacatcccgcagtgggagcccagcaagggctggaacgactggcagcaggtccccttctgcagccaccacttccaccagctgatcatgaaggacggccgcgagatcgtggtcccctgccggaaccaggacgagctcgtggggcgcgcccgggtgtcccagggcgcggggtggagcctgcgcgagaccgcctgcctgggcaagtcctacgcccagatgtggcagctcatgtacttccaccggcgcgacctgcggctggccgcgaacgccatctgcagcgccgtcccggtggactgggtgcccacctcccgcacgacctggagcatccacgcccaccaccagtggatgaccaccgaggacatgctctccgtctggaaccgggtgtggatcgaggagaacccctggatggaggacaagacgcacatcagctcctggggcgacgtgccctacctgggcaagcgcgaggaccagtggtgcggcagcctgatcgggctcaccgcccgggcgacctgggccaccaacatccaggtcgccatcaaccaggtgcgccgcctgatcggcaacgagaactacctggactacatgacctccatgaagcggttcaagaacgagagcgacccggagggggccctctggtga

SEQ ID NO: 8475 - RNA, 9879 nt, synthetic construct
  misc_feature 1..9879: note = derived and/or modified CDS sequence (opt1) from DENV-1__JF937596__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgcgggggtgaacatgtgcaccctcatcgccatggacctgggcgagctgtgcgaggacaccatgacctacaagtgcccccggatcaccgaggccgagcccgacgacgtggactgctggtgcaacgccacggacacctgggtgacctacgggacctgcagccagacgggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcatccagaacggccggctgatcacggccaacccgatcgtgaccgacaaggagaagcccgtgaacatcgaggccgagccgcccttcggggagtcctacatcgtcatcggcgtgggcgagaaggcgctgaagctcagctggttcaagaaggggtccagcatcggcaagatgttcgaggccaccgcccgcggggcccggcgcatggccatcctgggcgacaccgcgtgggacttcgggtccatcggcggcgtgttcacgagcgtcgggaagctggtgcaccagatcttcggcaccgcctacggggtcctgttctccggcgtcagctggaccatgaagatcgggatcggcgtgctgctgacctggctcggcctgaactcccgcagcacgtccctgagcatgacctgcatcgccgtggggctcgtcaccctgtacctgggcgtgatggtgcaggccgactccgggtgcgtcatcaactggaagggccgggagctcaagtgcgggagcggcatcttcgtgaccaacgaggtgcacacgtggaccgagcagtacaagttccaggccgacagcccgaagcgcctgtccgcggccatcggcaaggcctgggaggagggggtctgcggcatccggagcgccacccgcctggagaacatcatgtggaagcagatctccaacgagctcaaccacatcctgctggagaacgacatgaagttcaccgtggtggtcggggacgtggtgggcatcctcgcccaggggaagaagatgatccggccccagcccatggagcacaagtacagctggaagtcctggggcaaggcgaagatcatcggcgccgacgtccagaacaccacgttcatcatcgacgggcccaacaccccggagtgccccgacgaccagcgcgcctggaacatctgggaggtggaggactacggcttcgggatcttcaccaccaacatctggctgaagctgcgggacagctacacgcaggcctgcgaccaccgcctcatgtccgcggccatcaaggacagcaaggccgtgcacgccgacatgggctactggatcgagtccgagaagaacgagacctggaagctggcccgggcgagcttcatcgaggtcaagacctgcatctggcccaagtcccacaccctgtggagcaacggcgtgctcgagtccgagatggtgatccccaagatctacgggggcccgatcagccagcacaactaccgccccgggtacttcacgcagaccgccggcccctggcacctggggaagctggagctcgacttcgacctgtgcgagggcaccaccgtcgtggtggacgagcactgcggcaaccgggggccgtccctgcgcacgaccaccgtcaccggcaagatcatccacgagtggtgctgccggagctgcacgctgccgcccctccgcttcaagggggaggacggctgctggtacgggatggagatccggcccgtgaaggagaaggaggagaacctggtgaagtccatggtcagcgccggcagcggcgaggtggactccttcagcctcgggctgctgtgcatctccatcatgatcgaggaggtgatgcgcagccggtggtcccgcaagatgctcatgaccggcaccctggccgtcttcctgctcctgatcatggggcagctgacctggaacgacctcatccggctgtgcatcatggtgggcgccaacgcgagcgaccgcatggggatgggcacgacctacctggccctcatggccaccttcaagatgcgcccgatgttcgccgtggggctgctgttccggcgcctcacctcccgggaggtcctgctgctcacgatcgggctgagcctggtggcctccgtcgagctccccaacagcctggaggagctgggcgacgggctcgccatgggcatcatgatcctgaagctgctcaccgacttccagtcccaccagctgtgggccaccctgctcagcctgaccttcatcaagacgaccctgtccctccactacgcctggaagaccatggccatggtgctgagcatcgtgtccctgttccccctctgcctgagcaccacgtcccagaagaccacctggctgcccgtcctcctgggcagcctggggtgcaagccgctcaccatgttcctgatcgcggagaacaagatctggggccgcaagtcctggcccctgaacgaggggatcatggccgtgggcgtggtcagcatcctcctgagctccctgctcaagaacgacgtgcccctggccgggcccctgatcgccggcggcatgctcatcgcctgctacgtgatcagcgggtccagcgcggacctgtccctggagaaggccgccgaggtcagctgggaggaggaggccgagcactccggcgccagccacaacatcctcgtggaggtgcaggacgacgggacgatgaagatcaaggacgaggagcgggacgacaccctgaccatcctgctcaaggcgaccctgctggccgtctccggcgtgtacccgctcagcatccccgccaccctgttcgtgtggtacttctggcagaagaagaagcagcgctccggggtcctgtgggacacgcccagcccgcccgaggtggagcgggccgtgctggacgacggcatctaccgcatcatgcagcggggcctcctggggcgctcccaggtcggcgtgggggtgttccaggagaacgtcttccacaccatgtggcacgtgacccggggcgccgtgctgatgtaccaggggaagcgcctcgagcccagctgggcgtccgtcaagaaggacctgatcagctacggcggcgggtggcggctgcagggctcctggaacaccggggaggaggtccaggtgatcgccgtcgagcccggcaagaaccccaagaacgtgcagacggcccccgggaccttcaagacccccgagggcgaggtgggcgccatcgccctcgacttcaagcccgggaccagcggctcccccatcgtcaaccgcgaggggaagatcgtgggcctgtacggcaacggggtggtcacgaccagcggcacctacgtgagcgcgatcgcccagaccaaggcctcccaggaggggccgctgcccgagatcgaggacgaggtgttccggaagcgcaacctcacgatcatggacctgcaccccggcagcgggaagacccggcgctacctgccggccatcgtccgggaggcgatcaagcgcaagctccggaccctgatcctggcccccacccgcgtggtggcctccgagatggccgaggccctcaagggcatgcccatccgctaccagacgaccgcggtcaagagcgagcacaccggcaaggagatcgtggacctgatgtgccacgccaccttcacgatgcggctgctctcccccgtgcgcgtcccgaactacaacatgatcatcatggacgaggcccacttcaccgaccccagctccatcgccgcccgggggtacatcagcacccgcgtgggcatgggggaggcggccgccatcttcatgaccgccacgccgcccggctccgtggaggccttcccgcagagcaacgcggtcatccaggacgaggagcgggacatccccgagcgctcctggaacagcgggcacgagtggatcaccgacttccccggcaagaccgtgtggttcgtgccctccatcaagagcggcaacgacatcgccaactgcctgcggaagaacgggaagcgcgtcatccagctgtcccggaagaccttcgacacggagtaccagaagaccaagaacaacgactgggactacgtggtgaccaccgacatcagcgagatgggcgccaacttccgcgccgaccgggtcatcgacccgcgccggtgcctcaagcccgtgatcctgaaggacgggcccgagcgcgtcatcctggcgggccccatgccggtgacggtggcctccgccgcccagcggcgcgggcggatcggccgcaaccacaacaaggagggcgaccagtacatctacatggggcagcccctcaacaacgacgaggaccacgcccactggaccgaggcgaagatgctgctggacaacatcaacacccccgagggcatcatccccgccctcttcgagccggagcgggagaagtccgccgccatcgacggggagtaccgcctgcgcggcgaggcccggaagaccttcgtcgagctgatgcgccgcggggacctccccgtgtggctgtcctacaaggtggcgagcgagggcttccagtacagcgaccgccggtggtgcttcgacggcgagcgcaacaaccaggtcctggaggagaacatggacgtggagatctggacgaaggagggggagcggaagaagctccgcccccggtggctggacgcccgcacctactccgaccccctggccctccgggagttcaaggagttcgccgccggccgccggagcgtgtccggggacctgatcctggagatcggcaagctcccgcagcacctgacccagcgcgcgcagaacgccctggacaacctcgtcatgctgcacaacagcgagcagggcgggcgggcctaccgccacgccatggaggagctgcccgacaccatcgagacgctcatgctgctggcgctcatcgccgtgctgaccggcggggtgaccctgttcttcctctccggccgggggctgggcaagaccagcatcggcctgctctgcgtcatggcctccagcgtgctgctgtggatggcctccgtggagccccactggatcgccgcgagcatcatcctcgagttcttcctgatggtcctgctcatccccgagccggaccgccagcggacgccccaggacaaccagctggcctacgtggtgatcgggctcctcttcatgatcctgacggtcgccgccaacgagatgggcctgctcgagaccaccaagaaggacctggggatcggccacgtggccgtggagaaccaccaccacgcgaccatgctggacgtcgacctccaccccgcctccgcctggacgctgtacgccgtggccaccaccatcatcaccccgatgatgcgccacacgatcgagaacaccaccgcgaacatcagcctgaccgccatcgccaaccaggccgccatcctcatggggctggacaagggctggcccatctccaagatggacatcggcgtgcccctgctcgcgctggggtgctacagccaggtcaaccccctgacgctcaccgccgccgtgctgatgctggtggcccactacgcgatcatcggcccggggctccaggccaaggccacccgggaggcccagaagcgcaccgccgcgggcatcatgaagaaccccacggtcgacgggatcgtggccatcgacctggaccccgtggtctacgacgccaagttcgagaagcagctgggccagatcatgctcctgatcctgtgcacctcccagatcctcctgatgcgcaccacctgggccctgtgcgagagcatcacgctcgccaccggccccctgaccaccctgtgggaggggtccccgggcaagttctggaacacgaccatcgcggtgagcatggccaacatcttccgggggtcctacctcgccggcgccggcctggccttcagcctgatgaagtccctcgggggcgggcgccggggcaccggggcgcagggcgagaccctgggcgagaagtggaagcgccagctgaaccagctctccaagagcgagttcaacatctacaagcggtccgggatcatggaggtggaccgcagcgaggccaaggagggcctgaagcgcggggagacgacccgccacgccgtctcccggggcaccgccaagctgcgctggttcgtggagcggaacctggtgaagcccgaggggaaggtcatcgacctcggctgcggccgcgggggctggagctactactgcgcggggctgaagaaggtgaccgaggtgaagggctacacgaagggcgggcccggccacgaggagcccatcccgatggccacctacgggtggaacctggtcaagctccactccggcaaggacgtgttcttcgcgccgcccgagaagtgcgacaccctgctgtgcgacatcggggagagctcccccaacccgaccatcgaggagggccggacgctccgcgtgctgaagatggtcgagccctggctgcgggggaaccagttctgcatcaagatcctcaacccctacatgcccagcgtggtggagaccctggagcagatgcagcgcaagcacggcggcatgctggtccggaacccgctctcccgcaacagcacccacgagatgtactgggtgtcctgcgggaccggcaacatcgtgagcgccgtcaacatgacctcccggatgctgctgaaccgcttcacgatggcccaccgcaagcccacctacgagcgggacgtggacctcggggcgggcacccgccacgtggccgtcgagcccgaggtggccaacctggacatcatcggccagcggatcgagaacatcaagcacgagcacaagagcacctggcactacgacgaggacaacccctacaagacgtgggcctaccacgggtcctacgaggtcaagccgagcggctccgccagcagcatggtgaacggggtggtcaagctgctcaccaagccctgggacgtgatccccatggtgacccagatcgcgatgaccgacacgacccccttcggccagcagcgcgtcttcaaggagaaggtggacacccggaccccgaaggccaagcgcgggacggcccagatcatggaggtgaccgcccggtggctgtggggcttcctgtcccgcaacaagaagccccggatctgcacccgcgaggagttcacccggaaggtccgcagcaacgccgcgatcggcgccgtgttcgtggacgagaaccagtggaactccgccaaggaggccgtcgaggacgagcggttctgggacctcgtgcagaaggagcgcgagctgcacaagcaggggaagtgcgcgacgtgcgtgtacaacatgatgggcaagcgggagaagaagctgggggagttcggcaaggccaaggggagccgcgccatctggtacatgtggctcggcgcccggttcctggagttcgaggccctgggcttcatgaacgaggaccactggttctcccgcgagaacagcctctccggggtcgagggcgaggggctgcacaagctgggctacatcctccgggacatcagcaagatccccgggggcaacatgtacgcggacgacaccgccggctgggacacccgcatcaccgaggacgacctgcagaacgaggccaagatcacggacatcatggagccggagcacgccctgctcgccacctccatcttcaagctgacctaccagaacaaggtggtgcgggtccagcgccccgcgaagaacgggaccgtgatggacgtgatcagccgccgggaccagcgcggctccgggcaggtcggcacgtacggcctgaacaccttcaccaacatggaggcccagctcatccggcagatggagagcgaggggatcttcctgccctccgagctggagacccccaacctcgccgagcgcgtgctggactggctggagaagcacggcgtggagcggctcaagcgcatggccatcagcggggacgactgcgtcgtgaagccgatcgacgaccggttcgccacggcgctgaccgccctgaacgacatgggcaaggtgcgcaaggacatcccccagtgggagccctccaaggggtggaacgactggcagcaggtccccttctgcagccaccacttccaccagctcatcatgaaggacggccgggagatcgtggtgccgtgccgcaaccaggacgagctggtcggccgggcccgcgtgtcccagggggccggctggagcctgcgggagaccgcctgcctcggcaagagctacgcgcagatgtggcagctgatgtacttccaccgccgggacctgcgcctcgccgccaacgccatctgctccgcggtgcccgtcgactgggtgcccaccagccggacgacctggtccatccacgcccaccaccagtggatgaccaccgaggacatgctgagcgtgtggaaccgcgtctggatcgaggagaacccctggatggaggacaagacgcacgtgtccagctggggcgacgtgccgtacctggggaagcgggaggaccagtggtgcggctccctcatcggcctgaccgcccgcgccacctgggccagcaacatccaggtcgcgatcaaccaggtgcgccggctgatcgggaacgagaactacctcgactacatgacctccatgaagcgcttcaagaacgagggcgaccccgagggggccctgtggtga

SEQ ID NO: 8476 - RNA, 9879 nt, synthetic construct
  misc_feature 1..9879: note = derived and/or modified CDS sequence (opt1) from DENV-1__FJ898380__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgcgacaagcggtccgtggccctcgcgccccacgtgggcctggggctggagacccggaccgagacctggatgagctccgagggcgcgtggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtcgggaagctggtgcaccagatcttcggcaccgcctacggggtgctgttctccggcgtcagctggacgatgaagatcgggatcggcgtgctgctgacctggctcggcctgaactcccgcagcacctccctgagcatgacctgcatcgccgtggggctcgtcacgctgtacctgggcgtgatggtgcaggccgactccgggtgcgtcatcaactggaagggccgggagctcaagtgcgggagcggcatcttcgtgaccaacgaggtgcacacctggaccgagcagtacaagttccaggccgacagcccgaagcgcctgtccgcggccatcggcaaggcctgggaggagggggtctgcggcatccggagcgccacccgcctggagaacatcatgtggaagcagatctccaacgagctcaaccacatcctgctggagaacgacatgaagttcacggtggtggtcggggacgtggccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtcgaggactacggcttcgggatcttcacgaccaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacgtgcatctggcccaagtcccacaccctgtggagcaacggcgtgctcgagtccgagatgatcatccccaagatctacgggggcccgatcagccagcacaactaccgccccgggtacttcacccaggccgccggcccctggcacctggggaagctggagctcgacttcgacctgtgcgagggcaccacggtggtcgtggacgagcactgcggcaaccgggggccgtccctgcgcaccaccaccgtgacgggcaagatcatccacgagtggtgctgccggagctgcaccctgccgcccctccgcttcaagggggaggacggctgctggtacgggatggagatccggcccgtcaaggagaaggaggagaacctggtgaagtccatggtgagcgccggcagcggcgaggtcgactccttcagcctcgggctgctgtgcatctccatcatgatcgaggaggtgatgcgcagccggtggtcccgccggatgctcatgaccggcaccctggccgtgttcttcctgctcatcatggggcagctgacgtggaacgacctgatccgcctctgcatcatggtcggcgcgaacgccagcgaccgcatggggatgggcaccacctacctggccctgatggccaccttcaagatgcggccgatgttcgccgtgggcctcctgttccgccggctgacgtcccgcgaggtgctcctgctgaccatcgggctcagcctggtcgcgtccgtggagctgcccaacagcctcgaggagctgggcgacgggctggccatgggcatcatgatcctcaagctgctgaccgacttccagtcccaccagctctgggccaccctgctgagcctcacgttcatcaagaccaccttctccctgcactacgcctggaagaccatggcgatggtcctgagcatcgtgtccctcttccccctgtgcctgagcacgacctcccagaagaccacctggctccccgtgctgctgggcagcctcgggtgcaagccgctgacgatgttcctgatcgccgagaacaagatctggggccggcgctcctggcccctcaacgaggggatcatggccgtcggcatcgtgagcatcctgctgagctccctcctgaagaacgacgtgcccctggccgggcccctcatcgccggcggcatgctgatcgcgtgctacgtcatcagcgggtccagcgccgacctgtccctcgagaaggccgccgaggtgagctgggaggaggaggccgagcactccggcgcgagccacaacatcctggtggaggtccaggacgacgggaccatgaagatcaaggacgaggagcgggacgacaccctgaccatcctcctgaaggccaccctgctcgccgtgtccggcgtgtacccgctgagcatccccgccacgctgttcgtctggtacttctggcagaagaagaagcagcgctccggggtgctctgggacacccccagcccgcccgaggtggagcgggccgtcctggacgacggcatctaccgcatcatgcagcggggcctgctggggcgctcccaggtgggcgtgggggtcttccaggagaacgtgttccacaccatgtggcacgtgacccggggcgcggtcctcatgtaccaggggaagcgcctggagcccagctgggcctccgtgaagaaggacctgatcagctacggcggcgggtggcggctccagggctcctggaacacgggggaggaggtgcaggtcatcgccgtggagcccggcaagaaccccaagaacgtgcagaccgcccccgggaccttcaagacccccgagggcgaggtcggcgccatcgcgctggacttcaagcccgggacgagcggctcccccatcgtgaaccgcgaggggaagatcgtgggcctgtacggcaacggggtcgtgaccaccagcggcacctacgtgagcgccatcgcccaggccaaggcgtcccaggaggggccgctccccgagatcgaggacgaggtcttccggaagcgcaacctgacgatcatggacctgcaccccggcagcgggaagacccggcgctacctcccggccatcgtgcgggaggccatcaagcgcaagctgcgcaccctgatcctcgcccccacccgggtggtcgcctccgagatggcggaggccctgaagggcatgcccatccgctaccagacgaccgccgtcaagagcgagcacaccggcaaggagatcgtggacctgatgtgccacgccaccttcacgatgcggctcctgtcccccgtccgcgtgccgaactacaacatgatcatcatggacgaggcccacttcaccgaccccagctccatcgcggcccgggggtacatcagcacccgcgtgggcatgggggaggccgccgccatcttcatgaccgcgacgccgcccggctccgtcgaggccttcccgcagagcaacgccgtgatccaggacgaggagcgggacatccccgagcgctcctggaacagcgggtacgagtggatcaccgacttccccggcaagaccgtgtggttcgtcccctccatcaagagcggcaacgacatcgccaactgcctgcggaagaacgggaagcgcgtgatccagctctcccggaagaccttcgacacggagtaccagaagaccaagaacaacgactgggactacgtggtcaccaccgacatcagcgagatgggcgcgaacttccgcgccgaccgggtgatcgacccgcgccggtgcctgaagcccgtgatcctgaaggacgggcccgagcgcgtcatcctcgccggccccatgccggtgacggtcgcctccgccgcgcagcggcgcgggcggatcggccgcaaccacaacaaggagggcgaccagtacatctacatggggcagcccctgaacaacgacgaggaccacgcccactggaccgaggccaagatgctgctcgacaacatcaacacccccgagggcatcatccccgccctgttcgagccggagcgcgagaagtccgccgcgatcgacggggagtaccggctgcgcggcgaggcccggaagaccttcgtggagctcatgcgccgcggggacctgcccgtgtggctgtcctacaaggtcgccagcgagggcttccagtacagcgaccgccggtggtgcttcgacggcgagcgcaacaaccaggtgctcgaggagaacatggacgtggagatctggacgaaggagggggagcggaagaagctgcgcccccggtggctggacgcccgcacctactccgaccccctcgccctgcgggagttcaaggagttcgcggccggccgccggagcgtctccggggacctgatcctcgagatcggcaagctgccgcagcacctgacccagcgcgcccagaacgccctcgacaacctggtgatgctgcacaacagcgagcagggcgggcgggcgtaccgccacgccatggaggagctccccgacaccatcgagacgctgatgctgctcgccctgatcgccgtgctgaccggcggggtcaccctcttcttcctgtccggccgggggctgggcaagaccagcatcggcctcctgtgcgtgatggcctccagcgtgctgctctggatggcgtccgtcgagccccactggatcgccgccagcatcatcctggagttcttcctgatggtgctcctgatccccgagccggaccgccagcggacgccccaggacaaccagctggcctacgtggtcatcgggctcctgttcatgatcctgacggtggccgcgaacgagatgggcctcctggagaccaccaagaaggacctggggatcggccacgtggccgtcgagaaccaccaccacgccgccatgctcgacgtggacctgcaccccgcctccgcgtggaccctgtacgccgtggccacgaccatcatcaccccgatgatgcgccacaccatcgagaacacgaccgccaacatcagcctcaccgccatcgcgaaccaggccgccatcctgatggggctggacaagggctggcccatctccaagatggacatcggcgtccccctcctggccctggggtgctacagccaggtgaaccccctcaccctgacggcggccgtgctgatgctcgtcgcccactacgccatcatcggcccggggctgcaggccaaggcgacccgcgaggcccagaagcggaccgccgccggcatcatgaagaaccccaccgtggacgggatcgtggccatcgacctggaccccgtcgtgtacgacgcgaagttcgagaagcagctcggccagatcatgctgctgatcctctgcacgtcccagatcctgctgatgcgcaccacctgggccctctgcgagagcatcaccctggccacgggccccctgaccaccctctgggaggggtccccgggcaagttctggaacaccacgatcgccgtgagcatggccaacatcttccgggggtcctacctggcgggcgccggcctggccttcagcctcatgaagtccctcgggggcgggcgccgggggaccggggcccagggcgagaccctgggcgagaagtggaagcgccagctcaaccagctgtccaagagcgagttcaacacctacaagcggtccgggatcatggaggtcgaccgcagcgaggcgaaggagggcctgaagcgcggggagacgaccaagcacgccgtgtcccgcggcaccgccaagctccggtggttcgtggagcgcaacctggtcaagcccgaggggaaggtgatcgacctgggctgcggccgcggcgggtggagctactactgcgccgggctgaagaaggtgaccgaggtcaaggggtacacgaagggcggccccggccacgaggagcccatcccgatggccacctacgggtggaacctcgtgaagctgcactccggcaaggacgtgttcttcatcccgcccgagaagtgcgacaccctgctctgcgacatcggggagagctcccccaacccgaccatcgaggagggccgcacgctgcgggtcctgaagatggtggagccctggctccgcgggaaccagttctgcatcaagatcctgaacccctacatgcccagcgtggtcgagaccctggagcagatgcagcggaagcacggcggcatgctcgtgcgcaacccgctgtcccggaacagcacccacgagatgtactgggtgtcctgcgggaccggcaacatcgtcagcgcggtgaacatgacctcccgcatgctgctcaaccgcttcacgatggcccaccggaagcccacctacgagcgcgacgtggacctgggggccggcacccggcacgtcgccgtggagcccgaggtggccaacctggacatcatcggccagcgcatcgagaacatcaagcacgagcacaagagcacctggcactacgacgaggacaacccctacaagacgtgggcgtaccacgggtcctacgaggtcaagccgagcggctccgccagcagcatggtgaacggggtcgtgaagctcctgaccaagccctgggacgtgatccccatggtcacccagatcgccatgaccgacacgacccccttcggccagcagcgggtgttcaaggagaaggtggacacccgcaccccgaaggccaagcgggggacggcccagatcatggaggtcaccgcgaagtggctgtggggcttcctctcccgcaacaagaagccccggatctgcacccgcgaggagttcacccggaaggtgcgcagcaacgccgccatcggcgccgtgttcgtcgacgagaaccagtggaactccgcgaaggaggccgtggaggacgagcggttctgggacctggtgcaccgcgagcgggagctgcacaagcaggggaagtgcgccacgtgcgtctacaacatgatgggcaagcgcgagaagaagctcggggagttcggcaaggccaaggggagccgggccatctggtacatgtggctgggcgcgcgcttcctggagttcgaggccctcggcttcatgaacgaggaccactggttctcccgggagaacagcctgtccggggtggagggcgaggggctgcacaagctcggctacatcctgcgcgacatcagcaagatccccgggggcaacatgtacgccgacgacaccgccggctgggacacccggatcaccgaggacgacctgcagaacgaggcccgcatcacggacatcatggagccggagcacgcgctcctggccaagtccatcttcaagctgacctaccagaacaaggtggtccgcgtgcagcggcccgccaagaacgggaccgtgatggacgtcatcagccgccgggaccagcgcggctccggccaggtgggcacctacggcctcaacacgttcaccaacatggaggcccagctgatccggcagatggagagcgaggggatcttctcccccagcgagctggagacccccaacctcgccgagcgcgtgctggactggctggagaagtacggcgtcgagcggctcaagcgcatggcgatctccggggacgactgcgtggtgaagccgatcgacgaccggttcgccaccgccctgacggccctgaacgacatgggcaaggtccgcaaggacatcccccagtgggagcccagcaaggggtggaacgactggcagcaggtccccttctgctcccaccacttccaccagctcatcatgaaggacggccgggagatcgtggtcccgtgccgcaaccaggacgagctggtgggccgggcccgcgtgagccagggggcgggctggagcctgcgggagaccgcctgcctcgggaagtcctacgcccagatgtggcagctgatgtacttccaccgccgggacctgcgcctcgccgcgaacgccatctgcagcgccgtccccgtggactggatccccacctcccggaccacgtggagcatccacgcccaccaccagtggatgaccaccgaggacatgctgtccgtgtggaaccgcgtctggatcgaggagaacccctggatggaggacaagacccacatcagctcctggggcgacgtgccgtacctggggaagcgcgaggaccagtggtgcggcagcctcatcggcctgacggcccgggcgacctgggccaccaacatccaggtggccatcaaccaggtccgccggctgatcgggaacgagaactacctcgactacatgacctccatgaagcgcttcaagaacgagagcgaccccgagggcgccctgtggtga

SEQ ID NO: 8477 - RNA, 9879 nt, synthetic construct
  misc_feature 1..9879: note = derived and/or modified CDS sequence (opt1) from DENV-1__FJ898382__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagacctccgccggggtgaacatgtgcaccctcatcgccatggacctgggcgagctgtgcgaggacaccatgacctacaagtgcccccgcatcaccgagaccgagcccgacgacgtggactgctggtgcaacgccacggacacctgggtgacctacgggacctgcagccagacgggcgagcaccggcgcgacaagcggtccgtggccctcgcgccccacgtgggcctggggctggagacccgcaccgagacctggatgagctccgagggcgcgtggaagcagatccagcgggtggagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtcgggaagctggtgcaccagatcttcggcaccgcctacggggtcctcttctccggcgtcagctggacgatgaagatcgggatcggcgtgctgctgacctggctcggcctgaactcccgcagcacctccctgagcatgacctgcatcgccgtggggctcgtcacgctgtacctgggcgtgatggtgcaggccgactccgggtgcgtcatcaactggaagggccgggagctcaagtgcgggagcggcatcttcgtgaccaacgaggtgcacacctggaccgagcagtacaagttccaggccgacagcccgaagcgcctgtccgcggccatcggcaaggcctgggaggagggggtctgcggcatccggagcgccacccgcctggagaacatcatgtggaagcagatctccaacgagctcaaccacatcctgctggagaacgacatgaagttcacggtggtggtcggggacgtggccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtcgaggactacggcttcgggatcttcacgaccaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacgtgcatctggcccaagtcccacaccctgtggagcaacggcgtgctcgagtccgagatgatcatccccaagatctacgggggcccgatcagccagcacaactaccgccccgggtacttcacccaggccgccggcccctggcacctggggaagctggagctcgacttcgacctgtgcgagggcaccacggtggtcgtggacgagcactgcggcaaccgggggccgtccctgcgcaccaccaccgtgacgggcaagatcatccacgagtggtgctgccggagctgcaccctgccgcccctccgcttccgcggggaggacggctgctggtacgggatggagatccgccccgtcaaggagaaggaggagaacctggtgaagtccatggtgagcgccggcagcggcgaggtcgactccttcagcctcgggctgctgtgcatctccatcatgatcgaggaggtgatgcggagccgctggtcccggcgcatgctcatgaccggcaccctggccgtgttcttcctgctcatcatggggcagctgacgtggaacgacctgatccgcctctgcatcatggtcggcgcgaacgccagcgaccggatggggatgggcaccacctacctggccctgatggccaccttcaagatgcgcccgatgttcgccgtggggctcctgttccggcgcctgacgtcccgggaggtgctcctgctgaccatcgggctcagcctggtcgcgtccgtggagctgcccaacagcctcgaggagctgggcgacgggctggccatgggcatcatgatcctcaagctgctgaccgacttccagtcccaccagctctgggccaccctgctgagcctcacgttcatcaagaccaccttctccctgcactacgcctggaagaccatggcgatggtcctgagcatcgtgtccctcttccccctgtgcctgagcacgacctcccagaagaccacctggctccccgtgctgctgggcagcctcgggtgcaagccgctgacgatgttcctgatcgccgagaacaagatctggggccgccggtcctggcccctcaacgaggggatcatggccgtcggcatcgtgagcatcctgctgagctccctcctgaagaacgacgtgcccctggccgggcccctcatcgccggcggcatgctgatcgcgtgctacgtcatcagcgggtccagcgccgacctgtccctcgagaaggccgccgaggtgagctgggaggaggaggccgagcactccggcgcgagccacaacatcctggtggaggtccaggacgacgggaccatgaagatcaaggacgaggagcgcgacgacaccctgaccatcctcctgaaggccaccctgctcgccgtgtccggcgtgtacccgctgagcatccccgccacgctgttcgtctggtacttctggcagaagaagaagcagcggtccggggtgctctgggacacccccagcccgcccgaggtggagcgcgccgtcctggacgacggcatctaccggatcatgcagcgcggcctgctggggcggtcccaggtgggcgtgggggtcttccaggagaacgtgttccacaccatgtggcacgtgacccgcggcgcggtcctcatgtaccaggggaagcggctggagcccagctgggcctccgtgaagaaggacctgatcagctacggcggcgggtggcgcctccagggctcctggaacacgggggaggaggtgcaggtcatcgccgtggagcccggcaagaaccccaagaacgtgcagaccgcccccgggaccttcaagacccccgagggcgaggtcggcgccatcgcgctggacttcaagcccgggacgagcggctcccccatcgtgaaccgggaggggaagatcgtgggcctgtacggcaacggggtcgtgaccaccagcggcacctacgtgagcgccatcgcccaggccaaggcgtcccaggaggggccgctccccgagatcgaggacgaggtcttccgcaagcggaacctgacgatcatggacctgcaccccggcagcgggaagacccgccggtacctcccggccatcgtgcgcgaggccatcaagcgcaagctgcggaccctgatcctcgcccccacccgcgtggtcgcctccgagatggcggaggccctgaagggcatgcccatccggtaccagacgaccgccgtcaagagcgagcacaccggcaaggagatcgtggacctgatgtgccacgccaccttcacgatgcgcctcctgtcccccgtccgggtgccgaactacaacatgatcatcatggacgaggcccacttcaccgaccccttcagcatcgcggcccgcgggtacatctccacccgggtgggcatgggggaggccgccgccatcttcatgaccgcgacgccgcccggcagcgtcgaggccttcccgcagtccaacgccgtgatccaggacgaggagcgcgacatccccgagcggagctggaactccgggtacgagtggatcaccgacttccccggcaagaccgtgtggttcgtccccagcatcaagtccggcaacgacatcgccaactgcctgcgcaagaacgggaagcgggtgatccagctcagccgcaagaccttcgacacggagtaccagaagaccaagaacaacgactgggactacgtggtcaccaccgacatctccgagatgggcgcgaacttccgggccgaccgcgtgatcgacccgcggcgctgcctgaagcccgtgatcctgaaggacgggcccgagcgggtcatcctcgccggccccatgccggtgacggtcgccagcgccgcgcagcgccgggggcgcatcggccgcaaccacaacaaggagggcgaccagtacatctacatggggcagcccctgaacaacgacgaggaccacgcccactggaccgaggccaagatgctgctcgacaacatcaacacccccgagggcatcatccccgccctgttcgagccggagcgggagaagtccgccgcgatcgacggggagtaccgcctgcggggcgaggcccgcaagaccttcgtggagctcatgcggcgcggggacctgcccgtgtggctgagctacaaggtcgcctccgagggcttccagtacagcgaccggcgctggtgcttcgacggcgagcggaacaaccaggtgctcgaggagaacatggacgtggagatctggacgaaggagggggagcgcaagaagctgcggccccgctggctggacgcccggacctacagcgaccccctcgccctgcgcgagttcaaggagttcgcggccggccggcgctccgtcagctccgacctgatcctcgagatcgggaagctgccgcagcacctgacccagcgggcccagaacgccctcgacaacctggtgatgctgcacaacagcgagcagggcggccgcgcgtaccggcacgccatggaggagctccccgacaccatcgagacgctgatgctgctcgccctgatcgccgtgctgaccgggggcgtcaccctcttcttcctgtccgggcgcggcctggggaagaccagcatcggcctcctgtgcgtgatggcctccagcgtgctgctctggatggcgtccgtcgagccccactggatcgccgccagcatcatcctggagttcttcctgatggtgctcctgatccccgagccggaccggcagcgcacgccccaggacaaccagctggcctacgtggtcatcggcctcctgttcatgatcctgacggtggccgcgaacgagatggggctcctggagaccaccaagaaggacctgggcatcgggcacgtggccgtcgagaaccaccaccacgccgccatgctcgacgtggacctgcaccccgcctccgcgtggaccctgtacgccgtggccacgaccatcatcaccccgatgatgcgccacaccatcgagaacacgaccgccaacatcagcctcaccgccatcgcgaaccaggccgccatcctgatgggcctggacaaggggtggcccatctccaagatggacatcggcgtccccctcctggccctgggctgctacagccaggtgaaccccctcaccctgacggcggccgtgctgatgctcgtcgcccactacgccatcatcgggccgggcctgcaggccaaggcgacccgggaggcccagaagcgcaccgccgccgggatcatgaagaaccccaccgtggacggcatcgtggccatcgacctggaccccgtcgtgtacgacgcgaagttcgagaagcagctcgggcagatcatgctgctgatcctctgcacgtcccagatcctgctgatgcggaccacctgggccctctgcgagagcatcaccctggccacgggccccctgaccaccctctgggagggctccccggggaagttctggaacaccacgatcgccgtgagcatggccaacatcttccgcggctcctacctggcgggggccggcctggccttcagcctcatgaagtccctgggcgggggccggcgcgggaccggcgcccagggggagaccctgggcgagaagtggaagcggcagctcaaccagctgtccaagagcgagttcaacacctacaagcgctccggcatcatggaggtcgaccggagcgaggcgaaggaggggctgaagcgcggcgagacgaccaagcacgccgtgtcccgggggaccgccaagctccgctggttcgtggagcggaacctggtcaagcccgagggcaaggtgatcgacctggggtgcggccgcggcgggtggagctactactgcgccggcctgaagaaggtgaccgaggtcaaggggtacacgaagggcgggcccggccacgaggagcccatcccgatggccacctacggctggaacctcgtgaagctgcactccgggaaggacgtgttcttcatcccgcccgagaagtgcgacaccctgctctgcgacatcggcgagagctcccccaacccgaccatcgaggaggggcggacgctgcgcgtcctgaagatggtggagccctggctccggggcaaccagttctgcatcaagatcctgaacccctacatgcccagcgtggtcgagaccctggagcagatgcagcgcaagcacgggggcatgctcgtgcggaacccgctgtcccgcaacagcacccacgagatgtactgggtgtcctgcggcaccgggaacatcgtcagcgcggtgaacatgacctcccgcatgctgctcaaccggttcacgatggcccaccgcaagcccacctacgagcgggacgtggacctgggcgccgggacccgccacgtcgccgtggagcccgaggtggccaacctggacatcatcggccagcggatcgagaacatcaagcacgagcacaagagcacctggcactacgacgaggacaacccctacaagacgtgggcgtaccacggctcctacgaggtcaagccgagcgggtccgccagcagcatggtgaacggcgtcgtgaagctcctgaccaagccctgggacgtgatccccatggtcacccagatcgccatgaccgacacgacccccttcgggcagcagcgcgtgttcaaggagaaggtggacacccggaccccgaaggccaagcgcggcacggcccagatcatggaggtcaccgcgaagtggctgtgggggttcctctcccggaacaagaagccccgcatctgcacccgggaggagttcacccgcaaggtgcggagcaacgccgccatcggcgccgtgttcgtcgacgagaaccagtggaactccgcgaaggaggccgtggaggacgagcgcttctgggacctggtgcaccgggagcgcgagctgcacaagcagggcaagtgcgccacgtgcgtctacaacatgatggggaagcgggagaagaagctcggcgagttcgggaaggccaagggcagccgcgccatctggtacatgtggctgggggcgcggttcctggagttcgaggccctcggcttcatgaacgaggaccactggttctcccgcgagaacagcctgtccggcgtggagggggagggcctgcacaagctcgggtacatcctgcgggacatcagcaagatccccggcgggaacatgtacgccgacgacaccgccggctgggacacccgcatcaccgaggacgacctgcagaacgaggcccgcatcacggacatcatggagccggagcacgcgctcctggccaagtccatcttcaagctgacctaccagaacaaggtggtccgggtgcagcgccccgccaagaacggcaccgtgatggacgtcatcagccggcgcgaccagcgggggtccggccaggtggggacctacggcctcaacacgttcaccaacatggaggcccagctgatccgccagatggagagcgagggcatcttctcccccagcgagctggagacccccaacctcgccgagcgggtgctggactggctggagaagtacggggtcgagcgcctcaagcggatggcgatctccggcgacgactgcgtggtgaagccgatcgacgaccgcttcgccaccgccctgacggccctgaacgacatggggaaggtccggaaggacatcccccagtgggagcccagcaagggctggaacgactggcagcaggtccccttctgctcccaccacttccaccagctcatcatgaaggacgggcgcgagatcgtggtcccgtgccggaaccaggacgagctggtgggccgcgcccgggtgagccagggcgcggggtggagcctgcgcgagaccgcctgcctcggcaagtcctacgcccagatgtggcagctgatgtacttccaccggcgcgacctgcggctcgccgcgaacgccatctgcagcgccgtccccgtggactggatccccacctcccgcaccacgtggagcatccacgcccaccaccagtggatgaccaccgaggacatgctgtccgtgtggaaccgcgtctggatcgaggagaacccctggatggaggacaagacccacatcagctcctggggcgacgtgccgtacctgggcaagcgggaggaccagtggtgcgggagcctcatcggcctgacggcccgcgcgacctgggccaccaacatccaggtggccatcaaccaggtccggcgcctgatcggcaacgagaactacctcgactacatgacctccatgaagcggttcaagaacgagagcgaccccgagggggccctgtggtga

SEQ ID NO: 8478 - RNA, 9879 nt, synthetic construct
  misc_feature 1..9879: note = derived and/or modified CDS sequence (opt1) from DENV-1__FJ898383__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgagaccgagcccgacgacgtggactgctggtgcaacgccacggacacctgggtcacctacgggacctgcagccagacgggcgagcaccggcgcgacaagcggtccgtggccctcgcgccccacgtgggcctggggctggagacccgcaccgagacctggatgagctccgagggcgcgtggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccatcaacatcgaggccgagccgcccttcggggagtcctacatcgtcatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtggggaagctggtccaccagatcttcggcaccgcctacggggtgctgttctccggcgtgagctggacgatgaagatcgggatcggcgtcctgctgacctggctcggcctgaactcccgcagcacctccctgagcatgacctgcatcgccgtggggctcgtgacgctgtacctgggcgtcatggtgcaggccgactccgggtgcgtgatcaactggaagggccgggagctcaagtgcgggagcggcatcttcgtcaccaacgaggtgcacacctggaccgagcagtacaagttccaggccgacagcccgaagcgcctgtccgcggccatcggcaaggcctgggaggagggggtgtgcggcatccggagcgccacccgcctggagaacatcatgtggaagcagatctccaacgagctcaaccacatcctgctggagaacgacatgaagttcacggtcgtggtgggggacgtcgccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctgaagctgcgggacagctacacccaggtctgcgaccaccgcctcatgtccgcggccatcaaggacagcaaggccgtgcacgccgacatgggctactggatcgagtccgagaagaacgagacctggaagctggcccgggcgagcttcatcgaggtgaagacgtgcatctggcccaagtcccacaccctgtggagcaacggcgtcctcgagtccgagatgatcatccccaagatctacgggggcccgatcagccagcacaactaccgccccgggtacttcacccaggccgccggcccctggcacctggggaagctggagctcgacttcgacctgtgcgagggcaccacggtggtggtcgacgagcactgcggcaaccgggggccgtccctgcgcaccaccaccgtgacgggcaagatcatccacgagtggtgctgccggagctgcaccctgccgcccctccgcttccgcggggaggacggctgctggtacgggatggagatccgccccgtgaaggagaaggaggagaacctggtcaagtccatggtgagcgccggcagcggcgaggtggactccttcagcctcgggctgctgtgcatctccatcatgatcgaggaggtcatgcggagccgctggtcccggcgcatgctcatgaccggcaccctggccgtgttcttcctgctcatcatggggcagctgacgtggaacgacctgatccgcctctgcatcatggtgggcgcgaacgccagcgaccggatggggatgggcaccacctacctggccctgatggccaccttcaagatgcgcccgatgttcgccgtcggcctcctgttccggcgcctgacgtcccgggaggtgctcctgctgaccatcgggctcagcctggtggcgtccgtcgagctgcccaacagcctcgaggagctgggcgacgggctggccatgggcatcatgatcctcaagctgctgaccgacttccagtcccaccagctctgggccaccctgctgagcctcacgttcatcaagaccaccttctccctgcactacgcctggaagaccatggcgatggtgctgagcatcgtctccctcttccccctgtgcctgagcacgacctcccagaagaccacctggctccccgtgctgctgggcagcctcgggtgcaagccgctgacgatgttcctgatcgccgagaacaagatctggggccgccggtcctggcccctcaacgaggggatcatggccgtgggcatcgtcagcatcctgctgagctccctcctgaagaacgacgtgcccctggccgggcccctcatcgccggcggcatgctgatcgcgtgctacgtgatcagcgggtccagcgccgacctgtccctcgagaaggccgccgaggtcagctgggaggaggaggccgagcactccggcgcgagccacaacatcctggtggaggtgcaggacgacgggaccatgaagatcaaggacgaggagcgcgacgacaccctgaccatcctcctgaaggccaccctgctcgccgtctccggcgtgtacccgctgagcatccccgccacgctgttcgtgtggtacttctggcagaagaagaagcagcggtccggggtcctctgggacacccccagcccgcccgaggtggagcgcgccgtgctggacgacggcatctaccggatcatgcagcgcggcctgctggggcggtcccaggtcggcgtgggggtgttccaggagaacgtcttccacaccatgtggcacgtgacccgcggcgcggtgctcatgtaccaggggaagcggctggagcccagctgggcctccgtcaagaaggacctgatcagctacggcggcgggtggcgcctccagggctcctggaacacgggggaggaggtccaggtgatcgccgtcgagcccggcaagaaccccaagaacgtgcagaccgcccccgggaccttcaagacccccgagggcgaggtgggcgccatcgcgctggacttcaagcccgggacgagcggctcccccatcgtcaaccgggaggggaagatcgtgggcctgtacggcaacggggtggtcaccaccagcggcacctacgtgagcgccatcgcccaggccaaggcgtcccaggaggggccgctccccgagatcgaggacgaggtgttccgcaagcggaacctgacgatcatggacctgcaccccggcagcgggaagacccgccggtacctcccggccatcgtccgcgaggccatcaagcgcaagctgcggaccctgatcctcgcccccacccgcgtggtggcctccgagatggcggaggccctgaagggcatgcccatccggtaccagacgaccgccgtcaagagcgagcacaccggcaaggagatcgtggacctgatgtgccacgccaccttcacgatgcgcctcctgtcccccgtgcgggtcccgaactacaacatgatcatcatggacgaggcccacttcaccgaccccagctccatcgcggcccgcgggtacatcagcacccgggtgggcatgggggaggccgccgccatcttcatgaccgcgacgccgcccggctccgtggaggccttcccgcagagcaacgccgtcatccaggacgaggagcgcgacatccccgagcggtcctggaacagcgggtacgagtggatcaccgacttccccggcaagaccgtgtggttcgtgccctccatcaagagcggcaacgacatcgccaactgcctgcgcaagaacgggaagcgggtcatccagctctcccgcaagaccttcgacacggagtaccagaagaccaagaacaacgactgggactacgtggtgaccaccgacatcagcgagatgggcgcgaacttccgggccgaccgcgtcatcgacccgcggcgctgcctgaagcccgtgatcctgaaggacgggcccgagcgggtgatcctcgccggccccatgccggtcacggtggcctccgccgcgcagcgccgggggcgcatcggccgcaaccacaacaaggagggcgaccagtacatctacatggggcagcccctgaacaacgacgaggaccacgcccactggaccgaggccaagatgctgctcgacaacatcaacacccccgagggcatcatccccgccctgttcgagccggagcgggagaagtccgccgcgatcgacggggagtaccgcctgcggggcgaggcccgcaagaccttcgtcgagctcatgcggcgcggggacctgcccgtgtggctgtcctacaaggtggccagcgagggcttccagtacagcgaccggcgctggtgcttcgacggcgagcggaacaaccaggtcctcgaggagaacatggacgtggagatctggacgaaggagggggagcgcaagaagctgcggccccgctggctggacgcccggacctactccgaccccctcgccctgcgcgagttcaaggagttcgcggccggccggcgcagcgtgtccggggacctgatcctcgagatcggcaagctgccgcagcacctgacccagcgggcccagaacgccctcgacaacctggtcatgctgcacaacagcgagcagggcgggcgcgcgtaccggcacgccatggaggagctccccgacaccatcgagacgctgatgctgctcgccctgatcgccgtgctgaccggcggggtgaccctcttcttcctgtccggccgcgggctgggcaagaccagcatcggcctcctgtgcgtcatggcctccagcgtgctgctctggatggcgtccgtggagccccactggatcgccgccagcatcatcctggagttcttcctgatggtcctcctgatccccgagccggaccggcagcgcacgccccaggacaaccagctggcctacgtggtgatcgggctcctgttcatgatcctgacggtcgccgcgaacgagatgggcctcctggagaccaccaagaaggacctggggatcggccacgtggccgtggagaaccaccaccacgccgccatgctcgacgtcgacctgcaccccgcctccgcgtggaccctgtacgccgtggccacgaccatcatcaccccgatgatgcgccacaccatcgagaacacgaccgccaacatcagcctcaccgccatcgcgaaccaggccgccatcctgatggggctggacaagggctggcccatctccaagatggacatcggcgtgcccctcctggccctggggtgctacagccaggtcaaccccctcaccctgacggcggccgtgctgatgctcgtggcccactacgccatcatcggcccggggctgcaggccaaggcgacccgggaggcccagaagcgcaccgccgccggcatcatgaagaaccccaccgtcgacgggatcgtggccatcgacctggaccccgtggtctacgacgcgaagttcgagaagcagctcggccagatcatgctgctgatcctctgcacgtcccagatcctgctgatgcggaccacctgggccctctgcgagagcatcaccctggccacgggccccctgaccaccctctgggaggggtccccgggcaagttctggaacaccacgatcgccgtgagcatggccaacatcttccgcgggtcctacctggcgggcgccggcctggccttcagcctcatgaagtccctcgggggcgggcggcgcgggaccggggcccagggcgagaccctgggcgagaagtggaagcggcagctcaaccagctgtccaagagcgagttcaacacctacaagcgctccgggatcatggaggtggaccggagcgaggcgaaggagggcctgaagcgcggggagacgaccaagcacgccgtctcccggggcaccgccaagctccgctggttcgtggagcggaacctggtgaagcccgaggggaaggtcatcgacctgggctgcggccgcgggggctggagctactactgcgccgggctgaagaaggtgaccgaggtgaagggctacacgaagggcggccccggccacgaggagcccatcccgatggccacctacgggtggaacctcgtcaagctgcactccggcaaggacgtgttcttcatcccgcccgagaagtgcgacaccctgctctgcgacatcggggagagctcccccaacccgaccatcgaggagggccggacgctgcgcgtgctgaagatggtcgagccctggctccgggggaaccagttctgcatcaagatcctgaacccctacatgcccagcgtggtggagaccctggagcagatgcagcgcaagcacggcggcatgctcgtccggaacccgctgtcccgcaacagcacccacgagatgtactgggtgtcctgcgggaccggcaacatcgtgagcgcggtcaacatgacctcccgcatgctgctcaaccggttcacgatggcccaccgcaagcccacctacgagcgggacgtggacctgggggccggcacccgccacgtggccgtcgagcccgaggtggccaacctggacatcatcggccagcggatcgagaacatcaagcacgagcacaagagcacctggcactacgacgaggacaacccctacaagacgtgggcgtaccacgggtcctacgaggtgaagccgagcggctccgccagcagcatggtcaacggggtggtcaagctcctgaccaagccctgggacgtgatccccatggtgacccagatcgccatgaccgacacgacccccttcggccagcagcgcgtcttcaaggagaaggtggacacccggaccccgaaggccaagcgcgggacggcccagatcatggaggtgaccgcgaagtggctgtggggcttcctctcccggaacaagaagccccgcatctgcacccgggaggagttcacccgcaaggtccggagcaacgccgccatcggcgccgtgttcgtggacgagaaccagtggaactccgcgaaggaggccgtcgaggacgagcgcttctgggacctggtgcaccgggagcgcgagctgcacaagcaggggaagtgcgccacgtgcgtgtacaacatgatgggcaagcgggagaagaagctcggggagttcggcaaggccaaggggagccgcgccatctggtacatgtggctgggcgcgcggttcctggagttcgaggccctcggcttcatgaacgaggaccactggttctcccgcgagaacagcctgtccggggtcgagggcgaggggctgcacaagctcggctacatcctgcgggacatcagcaagatccccgggggcaacatgtacgccgacgacaccgccggctgggacacccgcatcaccgaggacgacctgcagaacgaggcccgcatcacggacatcatggagccggagcacgcgctcctggccaagtccatcttcaagctgacctaccagaacaaggtggtgcgggtccagcgccccgccaagaacgggaccgtgatggacgtgatcagccggcgcgaccagcggggctccgggcaggtcggcacctacggcctcaacacgttcaccaacatggaggcccagctgatccgccagatggagagcgaggggatcttctcccccagcgagctggagacccccaacctcgccgagcgggtgctggactggctggagaagtacggcgtggagcgcctcaagcggatggcgatctccggggacgactgcgtcgtgaagccgatcgacgaccgcttcgccaccgccctgacggccctgaacgacatgggcaaggtgcggaaggacatcccccagtgggagcccagcaaggggtggaacgactggcagcaggtccccttctgctcccaccacttccaccagctcatcatgaaggacggccgcgagatcgtggtgccgtgccggaaccaggacgagctggtcggccgcgcccgggtgagccagggggcgggctggagcctgcgcgagaccgcctgcctcgggaagtcctacgcccagatgtggcagctgatgtacttccaccggcgcgacctgcggctcgccgcgaacgccatctgcagcgccgtgcccgtcgactggatccccacctcccgcaccacgtggagcatccacgcccaccaccagtggatgaccaccgaggacatgctgtccgtgtggaaccgcgtgtggatcgaggagaacccctggatggaggacaagacccacatcagctcctggggcgacgtcccgtacctggggaagcgggaggaccagtggtgcggcagcctcatcggcctgacggcccgcgcgacctgggccaccaacatccaggtggccatcaaccaggtgcggcgcctgatcgggaacgagaactacctcgactacatgacctccatgaagcggttcaagaacgagagcgaccccgagggcgccctgtggtga

SEQ ID NO: 8479 - RNA, 9879 nt, synthetic construct
  misc_feature 1..9879: note = derived and/or modified CDS sequence (opt1) from DENV-1__FJ898384__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggggagttctgcgaggacacgatgacctacaagtgcccccggatcaccgaggccgagcccgacgacgtggactgctggtgcaacgccaccgacacctgggtgacctacgggacctgcagccagaccggggagcaccggcgggacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccatcttcctcgcgcacgccatcggcaccagcatcacccagaaggggatcatcttcatcctgctgatgctcgtgaccccctccatggccatgcggtgcgtcggcatcggcagccgcgacttcgtggaggggctgtccggcgccacgtgggtggacgtcgtgctggagcacgggagctgcgtgaccaccatggccaaggacaagcccaccctcgacatcgagctgctgaagacggaggtcaccaaccccgcggtgctccggaagctgtgcatcgaggccaagatctccaacaccaccacggacagccgctgcccgacccagggcgaggccaccctggtggaggagcaggacgccaacttcgtctgccggcgcaccttcgtggaccggggctgggggaacggctgcggcctgttcggcaaggggtccctgatcacgtgcgccaagttcaagtgcgtgaccaagctggagggcaagatcgtccagtacgagaacctcaagtacagcgtgatcgtgaccgtccacaccggcgaccagcaccaggtggggaacgagtccacggagcacggcaccaccgcgaccatcacgccccaggcccccagcacggagatccagctgaccgactacggggccctgaccctcgactgcagcccccggaccggcctggacttcaacgagatggtcctgctcacgatgaaggagaagtcctggctggtgcacaagcagtggttcctggacctcccgctgccctggaccagcggggcctccaccagccaggagacctggaaccggcaggacctgctcgtgacgttcaagaccgcccacgcgaagaagcaggaggtcgtggtgctgggctcccaggagggcgccatgcacaccgccctgaccggggccacggagatccagaccagcggcaccaccacgatcttcgccgggcacctcaagtgccgcctgaagatggacaagctgaccctcaagggcatgtcctacgtcatgtgcaccgggagcttcaagctggagaaggaggtggcggagacccagcacggcacggtgctggtccagatcaagtacgagggcaccgacgccccctgcaagatccccttctccacccaggacgagaagggggtgacccagaacggccggctcatcacggccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctgggcgacaccgcctgggacttcgggagcatcggcggcgtgttcacgtccgtcgggaagctcgtgcaccagatcttcggcaccgcctacggggtgctgttcagcggcgtctcctggaccatgaagatcgggatcggcgtgctgctcacctggctgggcctgaacagccgctccacgagcctctccatgacctgcatcgccgtggggctggtcaccctgtacctcggcgtgatggtgcaggccgacagcgggtgcgtcatcaactggaagggccgggagctgaagtgcgggagcggcatcttcgtgaccaacgaggtgcacacgtggaccgagcagtacaagttccaggcggactccccgaagcgcctgagcgccgccatcggcaaggcctgggaggagggggtctgcggcatccggtccgccacccgcctcgagaacatcatgtggaagcagatcagcaacgagctgaaccacatcctgctcgagaacgacatgaagctgaccgtggtggtcggggacgtggcgggcatcctggcccaggggaagaagatgatccggccccagcccatggagtacaagtactcctggaagtcctggggcaaggccaagatcatcggcgccgacgtgcagaacaccacgttcatcatcgacgggcccaacaccccggagtgccccgacgaccagcgcgcgtggaacatctgggaggtcgaggactacggcttcgggatcttcaccaccaacatctggctcaagctgcgggactcctacacccaggtgtgcgaccaccgcctgatgagcgccgccatcaaggactccaaggccgtgcacgccgacatgggctactggatcgagagcgagaagaacgagacgtggaagctcgcgcgggcctccttcatcgaggtcaagacctgcatctggcccaagagccacaccctgtggtccaacggcgtgctggagagcgagatgatcatccccaagatctacgggggcccgatctcccagcacaactaccgccccgggtacttcacgcagaccgccggcccctggcacctcgggaagctggagctggacttcgacctctgcgagggcaccaccgtggtcgtggacgagcactgcggcaaccgggggccgagcctgcgcacgaccaccgtgaccggcaagatcatccacgagtggtgctgccggtcctgcacgctgccgcccctgcgcttcaagggggaggacggctgctggtacgggatggagatccggcccgtcaaggagaaggaggagaacctggtcaagagcatggtgagcgccggctccggcgaggtcgacagcttctccctggggctcctgtgcatcagcatcatgatcgaggaggtgatgcgctcccggtggagccgcaagatgctgatgaccggcaccctcgccgtgttcttcctgctgatcatggggcagctcacctggaacgacctgatccggctgtgcatcatggtcggcgcgaacgcctccgaccgcatggggatgggcacgacctacctcgccctgatggccaccttcaagatgcgcccgatgttcgccgtgggcctcctcttccggcgcctgaccagccgggaggtgctgctcctgacgatcgggctgtccctcgtcgcgagcgtggagctgcccaactccctggaggagctcggcgacgggctggccatgggcatcatgatcctgaagctcctgaccgacttccagagccaccagctgtgggccaccctcctgtccctgaccttcatccgcacgaccttcagcctccactacgcctggaagaccatggcgatggtcctgtccatcgtgagcctgttccccctctgcctgtccaccacgagccagaagaccacctggctgcccgtgctcctgggctccctggggtgcaagccgctcaccatgttcctgatcgccgagaacaagatctggggccgcaagagctggcccctgaacgaggggatcatggccgtcggcatcgtgagcatcctcctgtccagcctgctcaagaacgacgtgcccctggccgggcccctgatcgccggcggcatgctcatcgcgtgctacgtcatctccgggagctccgccgacctgagcctggagaaggccgccgaggtgtcctgggaggaggaggccgagcacagcggcgcgtcccacaacatcctcgtggaggtccaggacgacgggacgatgaagatcaaggacgaggagcgcgacgacaccctgaccatcctgctcaaggccaccctgctggccgtgagcggcgtgtacccgctctccatccccgccaccctgttcgtctggtacttctggcagaagaagaagcagcggagcggggtgctgtgggacacgcccagcccgcccgaggtggagcgcgccgtcctcgacgacggcatctaccggatcatgcagcgcggcctgctggggcggagccaggtgggcgtgggggtcttccaggagaacgtgttccacaccatgtggcacgtgacccgcggcgcggtcctgatgtaccaggggaagcggctcgagccctcctgggccagcgtgaagaaggacctgatctcctacggcggcgggtggcgcctgcagggcagctggaacaccggggaggaggtgcaggtcatcgccgtggagcccggcaagaaccccaagaacgtgcagacggcccccgggaccttcaagacctccgagggcgaggtcggcgccatcgcgctcgacttcaagcccgggaccagcggcagccccatcgtgaaccgggaggggaagatcgtgggcctgtacggcaacggggtcgtgacgacctccggcacctacgtgagcgccatcgcccaggccaaggcgtcccaggaggggcccctgccggagatcgaggacgaggtcttccgcaagcggaacctcaccatcatggacctgcaccccggcagcgggaagacgcgccggtacctgcccgccatcgtgcgcgaggccatcaagcggcgcctccgcaccctgatcctggccccgacccgggtggtcgcctccgagatggcggaggccctcaagggcatgcccatccgctaccagaccacggccgtcaagagcgagcacaccggcaaggagatcgtggacctgatgtgccacgccaccttcaccatgcggctgctctcccccgtccgcgtgcccaactacaacatgatcatcatggacgaggcccacttcacggacccgagctccatcgcggcccgggggtacatcagcacccgcgtgggcatgggggaggccgccgccatcttcatgaccgcgacgccgcccggctccgtcgaggccttcccccagagcaacgccgtgatccaggacgaggagcgggacatcccggagcgctcctggaacagcgggtacgagtggatcacggacttccccggcaagaccgtgtggttcgtcccctccatcaagagcggcaacgacatcgccaactgcctgcggaagaacgggaagcgcgtgatccagctgtcccggaagaccttcgacaccgagtaccagaagacgaagaacaacgactgggactacgtggtcaccaccgacatcagcgagatgggcgcgaacttccgcgccgaccgggtgatcgacccccgccggtgcctcaagccggtgatcctgaaggacgggcccgagcgcgtcatcctggccggccccatgcccgtgaccgtcgcctccgccgcgcagcggcgcgggcggatcggccgcaaccacaacaaggagggcgaccagtacatctacatggggcagccgctcaacaacgacgaggaccacgcccactggacggaggccaagatgctgctggacaacatcaacacccccgagggcatcatccccgccctcttcgagcccgagcgcgagaagtccgccgcgatcgacggggagtaccggctgcgcggcgaggcccggaagaccttcgtggagctgatgcgccgcggggacctcccggtgtggctgagctacaaggtcgcctccgagggcttccagtacagcgaccgccggtggtgcttcgacggcgagcgcaacaaccaggtgctggaggagaacatggacgtggagatctggaccaaggagggggagcggaagaagctccgcccccggtggctggacgcccgcacgtactccgaccccctggccctccgggagttcaaggagttcgcggccggccgccggagcgtctccggggacctgatcctggagatcggcaagctcccccagcacctgacccagcgcgcccagaacgccctggacaacctcgtgatgctgcacaacagcgagcagggcgggcgggcgtaccgccacgccatggaggagctgccggacaccatcgagaccctcatgctgctggccctcatcgccgtgctgacgggcggggtcaccctgttcttcctctccggccgggggctgggcaagaccagcatcggcctgctctgcgtgatggcctccagcgtgctgctgtggatggcgtccgtcgagccccactggatcgccgccagcatcatcctcgagttcttcctgatggtgctgctcatccccgagcccgaccgccagcggaccccgcaggacaaccagctggcctacgtggtcatcgggctcctcttcatgatcctgaccgtggccgcgaacgagatgggcctgctcgagacgaccaagaaggacctggggatcggccacgtggccgtcgagaaccaccaccacgccgccatgctggacgtggacctccaccccgcctccgcgtggaccctgtacgccgtggccaccacgatcatcacccccatgatgcgccacaccatcgagaacaccacggccaacatcagcctgaccgccatcgcgaaccaggccgccatcctcatggggctggacaagggctggccgatctccaagatggacatcggcgtccccctgctcgccctggggtgctacagccaggtgaaccccctgaccctcaccgcggccgtgctgatgctggtcgcccactacgccatcatcggccccgggctccaggccaaggcgacgcgcgaggcccagaagcggaccgccgccggcatcatgaagaacccgaccgtggacgggatcgtggccatcgacctggaccccgtcgtgtacgacgcgaagttcgagaagcagctgggccagatcatgctcctgatcctgtgcacctcccagatcctcctgatgcgcacgacctgggccctgtgcgagagcatcaccctcgccaccggccccctgacgaccctgtgggaggggtcccccggcaagttctggaacaccaccatcgccgtgagcatggccaacatcttccgggggagctacctcgcgggcgccggcctggccttctccctgatgaagtccctcgggggcgggcgccggggcacgggggcccagggcgagaccctgggcgagaagtggaagcgccagctgaaccagctctccaagagcgagttcaacacctacaagcggtccgggatcatggaggtcgaccgcagcgaggcgaaggagggcctgaagcgcggggagaccacgaagcacgccgtgtcccgcggcaccgccaagctgcggtggttcgtggagcgcaacctcgtcaagccggaggggaaggtgatcgacctgggctgcggccgcggcgggtggagctactactgcgccgggctgaagaaggtgaccgaggtcaaggggtacaccaagggcgggcccggccacgaggagcccatccccatggccacgtacgggtggaacctggtgaagctccactccggcaaggacgtgttcttcatcccgcccgagaagtgcgacaccctgctgtgcgacatcggggagagctcccccaaccccaccatcgaggagggccgcaccctccgggtcctgaagatggtggagccgtggctgcgcgggaaccagttctgcatcaagatcctcaacccctacatgcccagcgtggtcgagacgctggagcagatgcagcggaagcacggcggcatgctggtgcgcaaccccctctcccggaacagcacccacgagatgtactgggtgtcctgcgggaccggcaacatcgtcagcgcggtgaacatgacctcccgcatgctgctgaaccgcttcaccatggcccaccggaagccgacgtacgagcgcgacgtggacctcggggccggcacccggcacgtcgccgtggagcccgaggtggccaacctggacatcatcggccagcgcatcgagaacatcaagcacgagcacaagagcacctggcactacgacgaggacaacccctacaagacctgggcgtaccacgggtcctacgaggtcaagcccagcggcagcgcctccagcatggtgaacggggtcgtgaagctgctcacgaagccgtgggacgtgatccccatggtcacccagatcgccatgaccgacaccacgcccttcggccagcagcgggtgttcaaggagaaggtggacacccgcacccccaaggccaagcgggggaccgcccagatcatggaggtcacggcgaagtggctgtggggcttcctgtcccgcaacaagaagccgcggatctgcacccgcgaggagttcacccggaaggtgcgcagcaacgccgccatcggcgccgtgttcgtcgacgagaaccagtggaactccgcgaaggaggccgtggaggacgagcggttctgggacctcgtgcaccgcgagcgggagctgcacaagcaggggaagtgcgcgacctgcgtctacaacatgatgggcaagcgcgagaagaagctgggggagttcggcaaggccaaggggagccgggccatctggtacatgtggctcggcgcgcgcttcctggagttcgaggccctgggcttcatgaacgaggaccactggttctcccgggagaacagcctctccggggtggagggcgaggggctgcacaagctgggctacatcctccgcgacatcagcaagatccccgggggcaacatgtacgccgacgacacggccggctgggacacccggatcaccgaggacgacctgcagaacgaggccaagatcaccgacatcatggagcccgagcacgcgctgctcgccaagtccatcttcaagctgacgtaccagaacaaggtggtccgcgtgcagcgcccggccaagaacgggaccgtgatggacgtcatcagccggcgcgaccagcggggctccggccaggtgggcacctacggcctgaacaccttcacgaacatggaggcccagctcatccgccagatggagagcgaggggatcttctcccccagcgagctggagacccccaacctggccggccgggtgctcgactggctggagaagcacggggtcgagcgcctgaagcggatggcgatctccggcgacgactgcgtggtgaagcccatcgacgaccgcttcgccaccgccctcaccgccctgaacgacatggggaaggtccggaaggacatcccgcagtgggagcccagcaagggctggaacgactggcagcaggtccccttctgcagccaccacttccaccagctgatcatgaaggacggccgcgagatcgtggtcccctgccggaaccaggacgagctcgtggggcgcgcccgggtgtcccagggcgcggggtggagcctgcgcgagacggcctgcctgggcaagtcctacgcccagatgtggcagctcatgtacttccaccggcgcgacctgcggctggccgcgaacgccatctgcagcgccgtcccggtggactgggtgcccacctcccgcaccacctggagcatccacgcccaccaccagtggatgacgaccgaggacatgctctccgtctggaaccgggtgtggatcgaggagaacccctggatggaggacaagacccacgtgagctcctggggcgacgtcccctacctgggcaagcgcgaggaccagtggtgcggcagcctgatcgggctcaccgcccgcgcgacgtgggccaccaacatccaggtggccatcaaccaggtgcggcgcctgctgggcaacgagaactacctcgactacatgacctccatgaagcggttcaagaacgagagcgacccggagggggccctgtggtga

SEQ ID NO: 8480 - RNA, 9879 nt, synthetic construct
  misc_feature 1..9879: note = derived and/or modified CDS sequence (opt1) from DENV-1__FJ898385__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgcgggggtgaacatgtgcaccctcatcgccatggacctgggcgagctgtgcgaggacaccatgacctacaagtgcccccgcatcaccgaggccgagcccgacgacgtggactgctggtgcaacgccaccgacacctgggtgacctacgggacctgcagccagacgggcgagcaccggcgcgacaagcggagcgtggccctcgcgccccacgtgggcctggggctggagacccgcaccgagacctggatgtccagcgagggcgcctggaagcagatccagcgggtggagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtgggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtggggaagctggtccaccagatcttcggcaccgcctacggggtcctgttctccggcgtgagctggaccatgaagatcgggatcggcgtcctgctgacgtggctcggcctgaactcccgcagcacctccctgagcatgacctgcatcgccgtggggctcgtgaccctgtacctgggcgtcatggtgcaggccgactccgggtgcgtgatcaactggaagggccgggagctcaagtgcgggagcggcatcttcgtcacgaacgaggtgcacacctggaccgagcagtacaagttccaggcggacagcccgaagcgcctgtccgccgccatcggcaaggcctgggaggagggggtgtgcggcatccggagcgccacccgcctggagaacatcatgtggaagcagatctccaacgagctcaaccacatcctgctggagaacgacatgaagttcaccgtcgtggtcggcggggtcgtggggatcctcgcgcaggggaagaagatgatccggccccagcccatggagcacaagtacagctggaagtcctggggcaaggccaagatcatcggggccgacgtgcagaacacgaccttcatcatcgacggccccaacaccccggagtgccccgacgaccagcgcgcctggaacatctgggaggtcgaggactacgggttcggcatcttcaccacgaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacctgcatctggcccaagtcccacacgctgtggagcaacggggtgctcgagtccgagatgatcatccccaagatctacggcgggccgatcagccagcacaactaccgccccggctacttcacccagaccgccgggccctggcacctgggcaagctggagctcgacttcgacctgtgcgagggcaccacggtggtcgtggacgagcactgcgggaaccggggcccgtccctgcgcaccaccaccgtgacggggaagatcatccacgagtggtgctgccggagctgcaccctgccgcccctccgcttcaagggcgaggacgggtgctggtacggcatggagatccggcccgtcaaggagaaggaggagaacctggtgaagtccatggtgagcgccggcagcggggaggtcgactccttcagcctcggcctgctgtgcatctccatcatgatcgaggaggtgatgcgcagccggtggtcccgcaagatgctcatgaccgggaccctggccgtgttcctgctcctgatcatgggccagctgacgtggaacgacctcatccggctgtgcatcatggtcggggccaacgcgagcgaccgcatgggcatgggcaccacctacctggccctcatggccaccttcaagatgcgcccgatgttcgccgtggggctgctgttccggcgcctcacgtcccgggaggtgctgctgctcaccatcggcctgagcctggtcgcctccgtggagctccccaacagcctggaggagctgggggacggcctcgcgatgggcatcatgatcctgaagctgctcaccgacttccagtcccaccagctgtgggccaccctgctcagcctgacgttcatcaagaccaccctgtccctccactacgcctggaagaccatggccatgatcctgagcatcgtctccctgttccccctctgcctgagcacgacctcccagaagaccacctggctgcccgtgctcctggggagcctgggctgcaagccgctcacgatgttcctgatcgcggagaacaagatctgggggcgcaagtcctggcccctgaacgagggcatcatggccgtgggggtcgtgagcatcctcctgagctccctgctcaagaacgacgtgcccctggccggccccctgatcgccggcgggatgctcatcgcctgctacgtcatcagcggctccagcgcggacctgtccctggagaaggccgccgaggtgagctgggaggaggaggccgagcactccggggccagccacaacatcctcgtggaggtccaggacgacggcaccatgaagatcaaggacgaggagcgggacgacaccctgaccatcctgctcaaggcgaccctgctggccgtgtccggggtgtacccgctcagcatccccgccacgctgttcgtctggtacttctggcagaagaagaagcagcgctccggcgtgctgtgggacacccccagcccgcccgaggtggagcgggccgtcctggacgacggcatctaccgcatcatgcagcgggggctcctgggccgctcccaggtgggggtgggcgtcttccaggagaacgtgttccacaccatgtggcacgtgacccgcggggccgtcctgatgtaccagggcaagcgcctcgagcccagctgggcgtccgtgaagaaggacctgatcagctacggcgggggctggcggctgcaggggtcctggaacatgggcgaggaggtgcaggtcatcgccgtggagcccgggaagaaccccaagaacgtgcagacggcccccggcaccttcaagacccccgagggcgaggtcggggccatcgccctcgacttcaagcccggcaccagcgggtcccccatcgtgaaccgcgagggcaagatcgtgggcctgtacgggaacggcgtcgtgacgaccagcgggacctacgtgagcgcgatcgcccaggccaaggcctcccaggagggcccgctgcccgagatcgaggacgaggtcttccggaagcgcaacctcaccatcatggacctgcaccccgggagcggcaagacgcggcgctacctgccggcgatcgtgcgggaggccatcaagcgcaagctccggaccctgatcctggcccccacccgcgtggtcgcctccgagatggccgaggcgctcaagggcatgcccatccgctaccagaccacggccgtcaagagcgagcacaccgggaaggagatcgtggacctgatgtgccacgccaccttcaccatgcggctgctctcccccgtccgcgtgccgaactacaacatgatcatcatggacgaggcccacttcacggaccccagctccatcgccgcgcggggctacatcagcacccgcgtggggatgggcgaggccgccgccatcttcatgaccgccacgccgcccgggtccgtcgaggcgttcccgcagagcaacgccgtgatccaggacgaggagcgggacatccccgagcgctcctggaacagcggctacgagtggatcacggacttccccggcaagaccgtgtggttcgtcccctccatcaagagcgggaacgacatcgccaactgcctgcggaagaacggcaagcgcgtgatccagctgtcccggaagaccttcgacaccgagtaccagaagacgaagaacaacgactgggactacgtggtcaccaccgacatcagcgagatgggggccaacttccgcgcggaccgggtgatcgacccgcgccggtgcctcaagcccgtgatcctgaaggacggccccgagcgcgtcatcctggccgggcccatgccggtgaccgtcgcctccgccgcccagcggcgcggccggatcggccgcaaccacaacaaggagggggaccagtacatctacatgggccagcccctcaacaacgacgaggaccacgcgcactggacggaggccaagatgctgctggacaacatcaacacccccgaggggatcatccccgccctcttcgagccggagcgggagaagtccgccgccatcgacggcgagtaccgcctgcgcggggaggcgcggaagaccttcgtggagctgatgcgccggggcgacctccccgtgtggctgtcctacaaggtcgccagcgagggcttccagtacagcgaccgccggtggtgcttcgacggggagcgcaacaaccaggtgctggaggagaacatggacgtggagatctggaccaaggagggcgagcggaagaagctccgcccccggtggctggacgcccgcacgtactccgaccccctggccctccgggagttcaaggagttcgccgcggggcgccggagcgtctccggcgacctgatcctggagatcggcaagctcccgcagcacctgacccagcgcgcccagaacgccctggacaacctcgtgatgctgcacaacagcgagcagggcgggcgggcctaccgccacgcgatggaggagctgcccgacaccatcgagaccctcatgctgctggccctcatcgccgtgctgaccgggggcgtcaccctgttcttcctctccgggcggggcctgggcaagaccagcatcgggctgctctgcgtgatggcctccagcgtgctgctgtggatggcctccgtcgagccccactggatcgcggccagcatcatcctcgagttcttcctgatggtgctgctcatccccgagccggaccgccagcggacgccccaggacaaccagctggcctacgtggtcatcggcctcctcttcatgatcctgaccgtggccgccaacgagatggggctgctcgagacgaccaagaaggacctgggcatcgggcacgtggcggtcgagaaccaccaccacgccaccatgctggacgtggacctccaccccgcctccgcctggaccctgtacgccgtggcgacgaccatcatcaccccgatgatgcgccacaccatcgagaacacgaccgccaacatcagcctgaccgccatcgccaaccaggccgcgatcctcatgggcctggacaagggctggcccatctccaagatggacatcggggtccccctgctcgccctgggctgctacagccaggtgaaccccctgaccctcacggccgccgtgctgatgctggtcgcgcactacgccatcatcgggccgggcctccaggccaaggccacccgggaggcccagaagcgcaccgcggccgggatcatgaagaaccccaccgtggacggcatcgtggccatcgacctggaccccgtcgtgtacgacgccaagttcgagaagcagctgggccagatcatgctcctgatcctgtgcacgtcccagatcctcctgatgcgcaccacctgggccctgtgcgagagcatcaccctcgcgacggggcccctgaccaccctgtgggagggctccccggggaagttctggaacaccacgatcgccgtgagcatggccaacatcttccggggctcctacctcgccggcgccgggctggcgttcagcctgatgaagtccctcggcgggggccgccgggggaccggcgcccagggcgagaccctgggggagaagtggaagcgccagctgaaccagctctccaagagcgagttcaacatctacaagcggtccggcatcatggaggtcgaccgcagcgaggccaaggaggggctgaagcggggcgagaccacgcgccacgccgtgtcccgggggaccgcgaagctgcgctggttcgtggagcggaacctggtcaagcccgagggcaaggtgatcgacctcggctgcgggcgcggcgggtggagctactactgcgccggcctgaagaaggtgaccgaggtcaaggggtacaccaagggcggccccgggcacgaggagcccatcccgatggccacgtacggctggaacctggtgaagctccactccgggaaggacgtgttcttcacgccgcccgagaagtgcgacaccctgctgtgcgacatcggcgagagctcccccaacccgaccatcgaggaggggcggacgctccgcgtcctgaagatggtggagccctggctgcggggcaaccagttctgcatcaagatcctcaacccctacatgcccagcgtggtcgagaccctggagcagatgcagcgcaagcacggcgggatgctggtgcggaacccgctctcccgcaacagcacccacgagatgtactgggtgtcctgcggcaccgggaacatcgtcagcgccgtgaacatgacctcccggatgctgctgaaccgcttcacgatggcccaccgcaagcccacctacgagcgggacgtggacctcggcgcgggcacccgccacgtcgccgtggagcccgaggtggccaacctggacatcatcgggcagcggatcgagaacatcaagcacgagcacaagagcacctggcactacgacgaggacaacccctacaagacgtgggcctaccacggctcctacgaggtcaagccgagcgggtccgccagcagcatggtgaacggcgtcgtgaagctgctcaccaagccctgggacgtgatccccatggtcacccagatcgcgatgaccgacacgacccccttcgggcagcagcgcgtgttcaaggagaaggtggacacccggaccccgaaggccaagcgcggcacggcccagatcatggaggtcaccgcccggtggctgtggggcttcctgtcccgcaacaagaagccccggatctgcacccgcgaggagttcacccggaaggtgcgcagcaacgccgcgatcggggccgtgttcgtcgacgagaaccagtggaactccgccaaggaggccgtggaggacgagcggttctgggacctcgtgcagaaggagcgcgagctgcacaagcagggcaagtgcgcgacgtgcgtctacaacatgatggggaagcgggagaagaagctgggcgagttcgggaaggccaagggcagccgcgccatctggtacatgtggctcggcgcccggttcctggagttcgaggccctggggttcatgaacgaggaccactggttctcccgcgagaacagcctctccggcgtggagggggagggcctgcacaagctggggtacatcctccgggacatcagcaagatccccggcggcaacatgtacgcggacgacaccgccgggtgggacacccgcatcaccgaggacgacctgcagaacgaggccaagatcacggacatcatggagccggagcacgccctgctcgccacctccatcttcaagctgacctaccagaacaaggtggtccgggtgcagcgccccgcgaagaacggcaccgtgatggacgtcatcagccgccgggaccagcgcgggtccggccaggtgggcacgtacgggctgaacaccttcaccaacatggaggcccagctcatccggcagatggagagcgagggcatcttctcccccagcgagctggagatccccaacctggccgagcgcgtgctcgactggctggagaagtacggggtcgagcggctgaagcgcatggccatctccggcgacgactgcgtggtgaagccgatcgacgaccggttcgccaccgcgctcacggccctgaacgacatggggaaggtccgcaaggacgtgccccagtgggagcccagcaagggctggaacgactggcagcaggtccccttctgctcccaccacttccaccagctgatcatgaaggacggccgggagatcgtcgtgccgtgccgcaaccaggacgagctcgtggggcgggcccgcgtcagccagggcgccgggtggagcctgcgggagaccgcctgcctgggcaagtcctacgcgcagatgtggcagctcatgtacttccaccgccgggacctgcgcctggccgccaacgccatctgcagcgcggtgcccgtggactgggtccccacctcccggaccacgtggagcatccacgcccaccaccagtggatgaccaccgaggacatgctctccgtgtggaaccgcgtgtggatcgaggagaacccctggatggaggacaagacccacgtcagctcctggggcgacgtgccgtacctgggcaagcgggaggaccagtggtgcggcagcctgatcgggctcacggcccgcgccacctgggcctccaacatccaggtggcgatcaaccaggtccgccggctgatcggcaacgagaactacctggactacatgaccagcatgaagcgcttcaagaacgagggggaccccgagggcgccctctggtga

SEQ ID NO: 8481 - RNA, 9879 nt, synthetic construct
  misc_feature 1..9879: note = derived and/or modified CDS sequence (opt1) from DENV-1__GQ868608__SS-prME
  source 1..9879: mol_type = other RNA
agcgtgaccatgctgctcatgctgatgcccaccgccctggccttccacctcaccacccggggcggggagccccacatgatcgtgtccaagcaggagcggggcaagagcctgctgttcaagacctccgcgggggtgaacatgtgcaccctcatcgccatggacctgggcgagttctgcgaggacacgatgacctacaagtgcccccgcatcaccgaggccgagcccgacgacgtggactgctggtgcaacgccaccgacacgtgggtcacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtcgagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagaccgtccagtacgagaacctgaagtacagcgtgatcgtgaccgtccacacgggcgaccagcaccaggtggggaacgagtccaccgagcacggcaccaccgcgaccatcacgccccaggcccccagcaccgagatccagctgaccgactacggggccctcaccctggactgcagcccccggacgggcctggacttcaacgagatggtcctcctgaccatgaaggagaaggcctggctggtgcacaagcagtggttcctcgacctgccgctgccctggaccagcggggccagcacctcccaggagacgtggaaccggaaggacctcctggtgaccttcaagaccgcgcacgccaagaagcaggaggtcgtggtgctgggcagccaggagggcgccatgcacaccgccctcacgggggccaccgagatccagacctccggcaccacgaccatcttcgcggggcacctgaagtgccgcctgaagatggacaagctcaccctgaagggcatgagctacgtcatgtgcaccgggtccttcaagctggagaaggaggtggccgagacgcagcacggcaccgtgctcgtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggcggagccgcccttcggggagtcctacatcgtgatcggcgccggcgagaaggccctgaagctgagctggttcaagaaggggtccagcatcggcaagatgttcgaggccaccgcccgcggggcgcggcgcatggccatcctcggcgacacggcctgggacttcgggtccatcggcggcgtgttcaccagcgtcgggaagctggtgcaccagatcttcggcaccgcctacggggtgctgttctccggcgtcagctggaccatgaagatcgggatcggcgtgctcctgacgtggctgggcctcaactcccgcagcacctccctgagcatgacctgcatcgccgtggggctggtcaccctctacctgggcgtgatggtgcaggcggactccgggtgcgtcatcaactggaagggccgggagctgaagtgcgggagcggcatcttcgtgacgaacgaggtgcacacctggaccgagcagtacaagttccaggccgacagcccgaagcgcctctccgccgccatcggcaaggcctggaaggagggggtctgcggcatccggagcgcgacccgcctggagaacatcatgtggaagcagatctccaacgagctgaaccacatcctcctggagaacgacatgaagttcaccgtggtggtcggggacgtggccggcatcctggcccaggggaagaagatgatccggccccagcccatggagtacaagtacagctggaagtcctggggcaaggccaagatcatcggcgcggacgtgcagaacgccacgttcatcatcgacgggcccaacaccccggagtgccccgacgaccagcgcgcctggaacatctgggaggtcgaggactacggcttcgggatcttcaccaccaacatctggctcaagctgcgggacagctacacccaggtgtgcgaccaccgcctgatgtccgccgccatcaaggacagcaaggcggtgcacgccgacatgggctactggatcgagtccgagaagaacgagacctggaagctcgcccgggccagcttcatcgaggtcaagacctgcatctggcccaagtcccacaccctgtggagcaacggcgtgctggagtccgagatgatcatccccaagatctacgggggcccgatcagccagcacaactaccgccccgggtacttcacgcagaccgccggcccctggcacctcgggaagctggagctggacttcgacctctgcgagggcaccaccgtggtcgtggacgagcactgcggcaaccgggggccgtccctgcgcacgaccaccgtgaccggcaagatcatccacgagtggtgctgccggagctgcacgctgccgcccctgcgcttcaagggggaggacggctgctggtacgggatggagatccggcccgtcaaggagaaggaggagaacctggtgaagtccatggtgagcgcgggcagcggcgaggtcgactccttcagcctggggctcctgtgcatctccatcatgatcgaggaggtgatgcgcagccggtggtcccgcaagatgctgatgaccggcaccctcgccgtgttcttcctgctgatcatggggcagctcacctggaacgacctgatccggctgtgcatcatggtcggcgccaacgccagcgaccgcatggggatgggcacgacgtacctcgccctgatggcgaccttcaagatgcgcccgatgttcgccgtggggctcctgttccggcgcctgacctcccgggaggtgctgctcctgacgatcgggctgagcctcgtcgcctccgtggagctgcccaacagcctggaggagctcggcgacgggctggccatgggcatcatgatcctgaagctcctgaccgacttccagtcccaccagctgtgggcgaccctcctgagcctgaccttcatcaagacgaccttctccctccactacgcctggaagaccatggccatggtcctgagcatcgtgtccctgttccccctctgcctgagcaccacgtcccagaagaccacctggctgcccgtgctcctgggcagcctggggtgcaagccgctcaccatgttcctgatcgccgagaacaagatctggggccgcaagtcctggcccctgaacgaggggatcatggccgtcggcatcgtgagcatcctcctgagctccctgctcaagaacgacgtgcccctggcggggcccctgatcgccggcggcatgctcatcgcctgctacgtcatcagcgggtccagcgccgacctgtccctggagaaggccgcggaggtgagctgggaggaggaggccgagcactccggcgccagccacaacatcctcgtggaggtccaggacgacgggacgatgaagatcaaggacgaggagcgggacgacatgctgaccatcctgctcaaggccaccctgctggccgtgtccggcgtgtacccgctcagcatccccgcgaccctgttcgtctggtacttctggcagaagaagaagcagcgctccggggtgctgtgggacaccccctccccgcccgaggtggagcgggccgtcctcgacgacggcatctaccgcatcatgcagcggggcctgctggggcgctcccaggtgggcgtgggggtcttccaggagaacgtgttccacacgatgtggcacgtgacccggggcgccgtcctgatgtaccaggggaagcgcctcgagcccagctgggcctccgtgaagaaggacctgatcagctacggcggcgggtggcggctgcagggctcctggaacaccggggaggaggtgcaggtcatcgccgtggagcccggcaagaaccccaagaacgtgcagaccgcgcccgggacgttcaagaccagcgagggcgaggtcggcgccatcgccctcgacttcaagcccgggacctccggcagccccatcgtgaaccgcgaggggaagatcgtgggcctgtacggcaacggggtcgtgaccacgagcggcacctacgtgtccgccatcgcgcaggccaaggccagccaggaggggcccctgccggagatcgaggacgaggtcttccggaagcgcaacctcaccatcatggacctgcaccccggctccgggaagacccggcgctacctgcccgccatcgtgcgggaggccatcaagcgcaagctccggacgctgatcctggcgccgacccgcgtggtcgccagcgagatggccgaggccctcaagggcatgcccatccgctaccagaccaccgccgtgaagtccgagcacacgggcaaggagatcgtggacctgatgtgccacgcgaccttcaccatgcggctgctcagccccgtccgcgtgcccaactacaacatgatcatcatggacgaggcccacttcaccgacccgtccagcatcgccgcccgggggtacatctccacgcgcgtgggcatgggggaggccgcggccatcttcatgaccgccacgccgcccggcagcgtcgaggccttcccccagtccaacgcggtgatccaggacgaggagcgggacatcccggagcgcagctggaactccgggtacgagtggatcaccgacttccccggcaagacggtgtggttcgtccccagcatcaagtccggcaacgacatcgccaactgcctgcggaagaacgggaagcgcgtgatccagctgagccggaagaccttcgacaccgagtaccagaagaccaagaacaacgactgggactacgtggtcacgaccgacatctccgagatgggcgccaacttccgcgccgaccgggtgatcgacccccgccggtgcctcaagccggtgatcctgaaggacgggcccgagcgcgtcatcctggccggccccatgcccgtgaccgtcgcgagcgccgcccagcggcgcgggcggatcggccgcaaccacaacaaggagggcgaccagtacatctacatggggcagccgctcaacaacgacgaggaccacgcccactggaccgaggccaagatgctgctggacaacatcaacacgcccgagggcatcatccccgccctcttcgagcccgagcgggagaagtccgccgccatcgacggggagtaccgcctgcgcggcgaggcccggaagaccttcgtggagctgatgcgccgcggggacctcccggtgtggctgagctacaaggtcgccagcgagggcttccagtactccgaccgccggtggtgcttcgacggcgagcgcaacaaccaggtgctggaggagaacatggacgtggagatctggaccaaggagggggagcggaagaagctccgcccccggtggctggacgcgcgcacctacagcgaccccctggccctccgggagttcaaggagttcgccgccggccgccggtccgtcagcggggacctgatcctggagatcggcaagctcccccagcacctgacgcagcgcgcgcagaacgccctggacaacctcgtgatgctgcacaactccgagcagggcgggcgggcctaccgccacgccatggaggagctgccggacaccatcgagaccctcatgctgctggccctcatcgcggtgctgaccggcggggtcacgctgttcttcctcagcggccgggggctgggcaagacctccatcggcctgctctgcgtgatggccagctccgtgctgctgtggatggccagcgtcgagccccactggatcgccgcctccatcatcctcgagttcttcctgatggtgctgctcatccccgagcccgaccgccagcggaccccgcaggacaaccagctggcgtacgtggtcatcgggctcctcttcatgatcctgaccgtggccgccaacgagatgggcctgctcgagaccacgaagaaggacctggggatcggccacgtggccgtcgagaaccaccaccacgccgcgatgctggacgtggacctccaccccgccagcgcctggaccctgtacgccgtggccaccaccatcatcacgcccatgatgcgccacaccatcgagaacaccaccgcgaacatctccctgacggccatcgccaaccaggccgcgatcctcatggggctggacaagggctggccgatcagcaagatggacatcggcgtccccctgctcgccctggggtgctactcccaggtgaaccccctgaccctcaccgccgccgtgctgatgctggtcgcccactacgcgatcatcggccccgggctccaggccaaggccacccgggaggcccagaagcgcacggccgcgggcatcatgaagaacccgaccgtggacgggatcgtggccatcgacctggaccccgtcgtgtacgacaccaagttcgagaagcagctgggccagatcatgctcctgatcctgtgcaccagccagatcctcctgatgcgcacgacctgggccctgtgcgagtccatcaccctcgccaccggccccctgacgaccctgtgggaggggagccccggcaagttctggaacaccaccatcgccgtgtccatggcgaacatcttccgggggagctacctcgccggcgccggcctggccttcagcctgatgaagtccctcgggggcgggcgccggggcacgggggcgcagggcgagaccctgggcgagaagtggaagcgccagctgaaccagctcagcaagtccgagttcaacacctacaagcggagcgggatcatggaggtcgaccgctccgaggccaaggagggcctgaagcgcggggagaccacgaagcacgccgtgagccgcggcaccgccaagctgcggtggttcgtggagcgcaacctcgtcaagccggaggggaaggtgatcgacctgggctgcggccgcggcgggtggtcctactactgcgccgggctgaagaaggtgaccgaggtcaaggggtacaccaagggcgggcccggccacgaggagcccatccccatggcgacgtacgggtggaacctggtgaagctccacagcggcaaggacgtgttcttcatcccgcccgagaagtgcgacaccctgctgtgcgacatcggggagtccagccccaaccccaccatcgaggagggccgcaccctccgggtcctgaagatggtggagccgtggctgcgcgggaaccagttctgcatcaagatcctcaacccctacatgccctccgtggtcgagacgctggagcagatgcagcggaagcacggcggcatgctggtgcgcaaccccctcagccggaactccacccacgagatgtactgggtgagctgcgggaccggcaacatcgtctccgccgtgaacatgaccagccgcatgctgctgaaccggttcaccatggcccaccgcaagccgacgtacgagcgcgacgtggacctcggggccggcacccggcacgtcgccgtggagcccgaggtggcgaacctggacatcatcggccagcgcatcgagaacatcaagcacgagcacaagtccacctggcactacgacgaggacaacccctacaagacctgggcctaccacgggagctacgaggtcaagccctccggcagcgccagctccatggtgaacggggtcgtgaagctgctcacgaagccgtgggacgtgatccccatggtcacccagatcgccatgaccgacaccacgcccttcggccagcagcgggtgttcaaggagaaggtggacacccgcacccccaaggccaagcgggggaccgcgcagatcatggaggtcacggccaagtggctgtggggcttcctgagccgcaacaagaagccgcggatctgcacccgcgaggagttcacccggaaggtgcgctccaacgccgccatcggcgcggtgttcgtcgacgagaaccagtggaacagcgccaaggaggccgtggaggacgagcggttctgggacctcgtgcaccgcgagcgggagctgcacaagcaggggaagtgcgcgacctgcgtctacaacatgatgggcaagcgcgagaagaagctgggggagttcggcaaggccaaggggtcccgggcgatctggtacatgtggctcggcgcccgcttcctggagttcgaggccctgggcttcatgaacgaggaccactggttcagccgggagaactccctcagcggggtggagggcgaggggctgcacaagctgggctacatcctccgcgacatctccaagatccccgggggcaacatgtacgccgacgacacggccggctgggacacccggatcaccgaggacgacctgcagaacgaggcgaagatcaccgacatcatggagcccgagcacgccctgctcgccaagagcatcttcaagctgacgtaccagaacaaggtggtccgcgtgcagcggccggccaagaacgggaccgtgatggacgtcatctcccgccgcgaccagcggggcagcggccaggtgggcacctacggcctgaacaccttcacgaacatggaggcccagctcatccgccagatggagtccgaggggatcttcagcccctccgagctggagacccccaacctggcgggccgggtgctcgactggctggagaagcacggggtcgagcgcctgaagcggatggccatcagcggcgacgactgcgtggtgaagcccatcgacgaccgcttcgccaccgccctcaccgccctgaacgacatggggaaggtccggaaggacatcccgcagtgggagccctccaagggctggaacgactggcagcaggtccccttctgcagccaccacttccaccagctgatcatgaaggacggccgcgagatcgtggtcccctgccggaaccaggacgagctcgtggggcgcgcgcgggtgagccagggcgccgggtggtccctgcgcgagacggcctgcctgggcaagagctacgcccagatgtggcagctcatgtacttccaccggcgcgacctgcggctggcggccaacgccatctgctccgccgtcccggtggactgggtgcccaccagccgcaccacctggtccatccacgcccaccaccagtggatgacgaccgaggacatgctcagcgtctggaaccgggtgtggatcgaggagaacccctggatggaggacaagacccacatctccagctggggcgacgtgccctacctgggcaagcgcgaggaccagtggtgcggctccctgatcgggctcaccgcgcgggccacgtgggccaccaacatccaggtcgccatcaaccaggtgcgccgcctgatcggcaacgagaactacctggactacatgaccagcatgaagcggttcaagaacgagatcgacccggagggggccctctggtga

SEQ ID NO: 8482 - RNA, 9879 nt, synthetic construct
  misc_feature 1..9879: note = derived and/or modified CDS sequence (opt1) from DENV-1__GQ199774__SS-prME
  source 1..9879: mol_type = other RNA
agcgtgaccatgctgctcatgctgatgcccaccgccctggccttccacctcaccacccggggcggggagccccacatgatcgtgtccaagcaggagcggggcaagagcctgctgttcaagacctccgccggggtgaacatgtgcaccctcatcgccatggacctgggcgagctgtgcgaggacaccatgacctacaagtgcccccggatcaccgaggtggagcccgacgacgtggactgctggtgcaacaccaccgacacctgggtgacctacgggacctgcagccagacgggcgagcaccggcgcgacaagcggtccgtggccctcgcgccccacgtcggcctggggctggagacccgcgccgagacctggatgagctccgagggcgcgtggaagcagatccagaaggtggagacctgggccctccggcaccccgggttcacggtgatcgccctgttcctggcccacgcgatcggcaccagcatcacccagaaggggatcatcttcatcctcctgatgctggtcaccccctccatggccatgcgctgcgtgggcatcggcagccgggacttcgtggaggggctctccggcgccacgtgggtcgacgtggtgctggagcacgggagctgcgtcaccaccatggccaaggacaagcccaccctggacatcgagctcctgaagacggaggtgaccaaccccgccgtgctgcgcaagctctgcatcgaggcgaagatctccaacaccaccacggacagccggtgcccgacccagggcgaggccaccctggtcgaggagcaggacgccaacttcgtgtgccgccggaccttcgtggaccgcggctgggggaacggctgcgggctgttcggcaaggggtccctcatcacgtgcgccaagttcaagtgcgtcaccaagctggagggcaagatcgtgcagtacgagaacctgaagtacagcgtgatcgtcaccgtgcacaccggcgaccagcaccaggtcgggaacgagtccacggagcacggcaccatcgccaccatcacgccccaggcgcccaccagcgagatccagctcacggactacggggccctgaccctggactgcagcccccggaccggcctcgacttcaacgagatggtgctgctgaccatgaaggagaagtcctggctcgtgcacaagcagtggttcctggacctgcccctcccctggacgagcggggcctccaccagccaggagacctggaaccgccaggacctgctggtcaccttcaagacggcccacgccaagaagcaggaggtggtggtcctcggctcccaggagggcgcgatgcacaccgccctgaccggggccaccgagatccagacgaccggcaccaccacgatcttcgccgggcacctgaagtgccggctcaagatggacaagctgaccctgaagggcatgagctacgtgatgtgcaccgggtccttcaagctcgagaaggaggtggccgagacccagcacggcacggtcctggtgcagatcaagtacgagggcaccgacgcgccctgcaagatccccttcagcacccaggacgagaagggggtgacccagaacggccgcctgatcacggccaacccgatcgtcaccgacaaggagaagcccgtgaacatcgaggccgagccgcccttcggggagtcctacatcgtgatcggcgccggcgagaaggcgctgaagctcagctggttcaagaaggggtccagcatcggcaagatgttcgaggccaccgcccgcggggcccgccggatggccatcctgggcgacaccgcgtgggacttcgggtccatcggcggcgtcttcacgagcgtggggaagctggtgcaccagatcttcggcaccgcctacggggtcctcttctccggcgtgagctggaccatgaagatcgggatcggcgtgctgctgacctggctcggcctgaactcccgcagcacgtccctgagcatgacctgcatcgccgtcgggctcatcaccctgtacctgggcgtgatggtgcaggccgactccgggtgcgtcatcaactggaagggccgcgagctcaagtgcgggagcggcatcttcgtgaccaacgaggtgcacacgtggaccgagcagtacaagttccaggccgacagcccgaagcggctgtccgcggccatcggcaaggcctgggaggagggggtctgcggcatccgcagcgccacccggctggagaacatcatgtggcgccagatctccaacgagctcaaccacatcctgctggagaacgacatgaagttcaccgtggtggtcggggacgtggtgggcatcctcgcccaggggaagaagatggtccggccccagcccatggagcacaagtacagctggaagtcctggggcaaggcgaagatcatcggcgccgacgtgcagaacaccacgttcatcatcgacgggcccaacaccccggagtgccccgacgaccagcgcgcctggaacatctgggaggtggaggactacggcttcgggatcttcaccaccaacatctggctgaagctgcgggacagctacacgcaggtctgcgaccaccgcctcatgtccgccgcgatcaaggacagcaaggccgtgcacgccgacatgggctactggatcgagtccgagaagaacgagacctggaagctggcccgggccagcttcatcgaggtgaagacctgcatctggcccaagtcccacaccctgtggagcaacggcgtcctcgagtccgagatgatcatccccaagatctacgggggcccgatcagccagcacaactaccgccccgggtacttcacgcagaccgcgggcccctggcacctggggaagctggagctcgacttcgacctgtgcgagggcaccaccgtggtggtcgacgagcactgcggcaaccgggggccgtccctgcgcacgaccaccgtgaccggcaagatcatccacgagtggtgctgccggagctgcacgctgccgcccctccgcttcaagggggaggacggctgctggtacgggatggagatccggcccgtgcgcgagaaggaggagaacctggtcaagtccatggtgagcgccggcagcggcgaggtggactccttcagcctcgggctgctgtgcatctccatcatgatcgaggaggtcatgcggagccgctggtcccggaagatgctcatgaccggcaccctggccgtgttcttcctgctcatcatggggcagctgacctggaacgacctgatccgcagctgcatcatggtgggcgccaacgcctccgaccgcatggggatgggcacgacctacctcgcgctgatggccaccttcaagatgcggccgatgttcgccgtcgggctgctgttccgccggctgaccagccgcgaggtgctgctcctgacgatcgggctgtccctcgtcgccagcgtggagctgcccaactccctggaggagctcggcgacgggctggccatgggcatcatgatcctgaagctcctgaccgacttccagagctaccagctgtgggcgaccctcctgtccctgaccttcatcaagacgaccttcagcctccactacgcctggaagaccatggccatggtgctgtccatcgtcagcctgctccccctgtgcctgtccaccacgagccagaagaccacctggctccccgtgctgctgggctccctcgggtgcaagccgctgaccatgttcctgatcgccgagaacaagatctggggccggaagtcctggcccctcaacgaggggatcatggcggtgggcatcgtcagcatcctgctgtccagcctcctgaagaacgacgtgcccctggccgggcccctcatcgccggcggcatgctgatcgcctgctacgtgatctccgggagctccgccgacctgagcctcgagaaggcggccgaggtctcctgggaggaggaggccgagcacagcggcgcctcccacaacatcctggtggaggtgcaggacgacgggacgatgaagatcaaggacgaggagcgcgacgacaccctgaccatcctcctgaaggccaccctgctcgcggtcagcggcgtgtacccgctgtccatccccgccaccctgttcgtgtggtacttctggcagaagaagaagcagcggagcggggtcctctgggacacgcccagcccgcccgaggtggagcgcgccgtgctggacgacggcatctaccggatcatgcagcgcggcctgctggggcggagccaggtcggcgtgggggtgttccaggagaacgtcttccacaccatgtggcacgtgacccgcggcgccgtgctcatgtaccaggggaagcggctggagccctcctgggccagcgtcaagaaggacctgatctcctacggcggcgggtggcgcctccagggcagctggaacaccggggaggaggtccaggtgatcgcggtcgagcccggcaagaaccccaagaacgtgcagacggcccccgggaccttcaagacccccgagggcgaggtgggcgccatcgccctggacttcaagcccgggacctccggcagccccatcgtcaaccgggaggggaagatcgtgggcctgtacggcaacggggtggtcacgaccagcggcacctacgtgtccgccatcgcgcaggccaaggccagccaggaggggccgctccccgagatcgaggacgaggtgttccgcaagcggaacctgaccatcatggacctgcaccccggctccgggaagacgcgccggtacctcccggccatcgtccgcgaggcgatcaagcggaagctgcgcaccctgatcctcgcccccacccgcgtggtggccagcgagatggccgaggccctgaagggcatgcccatccggtaccagaccacggcggtcaagtccgagcacaccggccgcgagatcgtggacctgatgtgccacgccaccttcaccatgcggctcctgagccccgtgcgcgtcccgaactacaacatgatcatcatggacgaggcccacttcacggacccctccagcatcgccgcccgggggtacatctccacccgcgtgggcatgggggaggcggccgccatcttcatgaccgccacgccgcccggcagcgtggaggccttcccgcagtccaacgcggtcatccaggacgaggagcgggacatccccgagcgcagctggaactccgggtacgagtggatcacggacttccccggcaagaccgtgtggttcgtgcccagcatcaagtccggcaacgacatcgccaactgcctgcggaagaacgggaagcgcgtcatccagctcagccggaagaccttcgacaccgagtaccagaagacgaagaacaacgactgggactacgtggtgaccaccgacatctccgagatgggcgccaacttccgcgccgaccgggtcatcgacccgcgccggtgcctgaagcccgtgatcctgaaggacgggcccgagcgcgtcatcctcgcgggccccatgccggtgaccgtggccagcgccgcccagcggcgcgggcggatcggccgcaaccacaacaaggagggcgaccagtacatctacatggggcagcccctgaacaacgacgaggaccacgcccactggacggaggcgaagatgctgctcgacaacatcaacacccccgagggcatcatccccgccctgttcgagccggagcgcgagaagtccgccgccatcgacggggagtaccggctgcgcggcgaggcccggaagaccttcgtcgagctcatgcgccgcggggacctgcccgtgtggctgagctacaaggtggcgagcgagggcttccagtactccgaccgccggtggtgcttcgacggcgagcgcaacaaccaggtcctcgaggagaacatggacgtggagatctggaccaaggagggggagcggaagaagctgcgcccccggtggctggacgcccgcacgtacagcgaccccctcgccctgcgggagttcaaggagttcgccgccggccgccggtccgtgagcggggacctgatcctcgagatcggcaagctgccgcagcacctgacccagcgcgcgcagaacgccctcgacaacctggtcatgctgcacaactccgagcagggcgggcgggcctaccgccacgccatggaggagctccccgacaccatcgagaccctgatgctgctcgcgctgatcgccgtgctgacgggcggggtgaccctcttcttcctgagcggccgggggctgggcaagacctccatcggcctcctgtgcgtcatggccagctccgccctgctctggatggccagcgtggagccccactggatcgcggcctccatcatcctggagttcttcctgatggtgctcctgatccccgagccggaccgccagcggacgccccaggacaaccagctggcctacgtcgtgatcgggctcctgttcatgatcctgaccgtggccgccaacgagatgggcctcctggagacgaccaagaaggacctggggatcggccacgtcgcggtggagaaccaccaccacgccaccatgctcgacgtggacctgcaccccgccagcgcctggaccctgtacgccgtcgcgacgaccatcatcaccccgatgatgcgccacaccatcgagaacacgaccgccaacatctccctcaccgccatcgccaaccaggccgcgatcctgatggggctggacaagggctggcccatcagcaagatggacatcggcgtgcccctcctggccctggggtgctactcccaggtgaaccccctcaccctgacggccgccgtcctgatgctcgtggcgcactacgccatcatcggcccggggctgcaggccaaggccacccgcgaggcccagaagcggaccgcggccggcatcatgaagaaccccaccgtggacgggatcgtcgccatcgacctggaccccgtggtgtacgacgccaagttcgagaagcagctcggccagatcatgctgctgatcctctgcacgagccagatcctgctgatgcgcaccacctgggccctctgcgagtccatcaccctggcgacgggccccctgaccaccctctgggaggggagcccgggcaagttctggaacaccacgatcgccgtctccatggccaacatcttccgggggagctacctggccggcgccggcctggcgttcagcctcatgaagtccctcgggggcgggcgccgggggaccggggcccagggcgagaccctgggcgagaagtggaagcgccagctcaaccagctgagcaagtccgagttcaacacctacaagcggagcgggatcatggaggtggaccgctccgaggccaaggagggcctgcggcgcggggagacgaccaagcacgccgtgagccggggcaccgcgaagctccgctggttcgtcgagcggaacctggtgaagcccgaggggaaggtgatcgacctgggctgcggccgcgggggctggtcctactactgcgccgggctgaagaaggtcaccgaggtgaagggctacacgaagggcgggcccggccacgaggagcccatcccgatggccacctacgggtggaacctcgtgaagctgcacagcggcaaggacgtcttcttcatcccgcccgagaagtgcgacaccctgctctgcgacatcggggagtccagccccaacccgaccatcgaggagggccggacgctgcgcgtgctgaagatggtggagccctggctccgggggaaccagttctgcatcaagatcctgaacccctacatgccctccgtcgtggagaccctggagcacatgcagcgcaagcacggcggcatgctcgtgcggaacccgctgagccgcaactccacccacgagatgtactgggtcagctgcgggaccggcaacatcgtgtccgccgtgaacatgaccagccgcatgctgctcaaccggttcacgatggcccaccgcaagcccacctacgagcgggacgtcgacctgggggcgggcacccgccacgtggccgtggagcccgaggtcgccaacctggacatcatcggccagcggatcgagaacatcaagcacgagcacaagtccacctggcactacgacgaggacaacccctacaagacgtgggcctaccacgggagctacgaggtgaagccgtccggcagcgccagctccatggtcaacggggtggtgaagctcctgaccaagccctgggacgtcatccccatggtgacccagatcgcgatgaccgacacgacccccttcggccagcagcgcgtgttcaaggagaaggtcgacacccggaccccgaaggccaagcgcgggacggcccagatcatggaggtgaccgcccggtggctgtggggcttcctcagccgcaacaagaagccccggatctgcacccgcgaggagttcacccggaaggtgcgctccaacgccgcgatcggcgccgtcttcgtggacgagaaccagtggaacagcgccaaggaggccgtggaggacgagcggttctgggacctggtccaccgcgagcgggagctgcacaagcaggggaagtgcgcgacgtgcgtgtacaacatgatgggcaagcgcgagaagaagctcggggagttcggcaaggccaaggggtcccgggccatctggtacatgtggctgggcgcccgcttcctggagttcgaggccctcggcttcatgaacgaggaccactggttcagccgggagaactccctgagcggggtggagggcgaggggctgcacaagctcggctacatcctgcgcgacatctccaagatccccgggggcaacatgtacgcggacgacaccgccggctgggacacccgcatcaccgaggacgacctgcagaacgaggccaagatcacggacatcatggagccggagcacgccctcctggccaccagcatcttcaagctgacctaccagaacaaggtcgtgcgggtgcagcgccccgcgaagaacgggaccgtcatggacgtgatctcccggcgcgaccagcggggcagcggccaggtgggcacgtacggcctcaacaccttcaccaacatggaggcccagctgatccgccagatggagtccgaggggatcttcagcccctccgagctggagacccccaacctcgccgagcgggtcctggactggctggagaagtacggcgtggagcgcctcaagcggatggccatcagcggggacgactgcgtggtcaagccgatcgacgaccgcttcgccacggcgctgaccgccctgaacgacatgggcaaggtgcggaaggacatcccccagtgggagccctccaaggggtggaacgactggcagcaggtccccttctgcagccaccacttccaccagctcatcatgaaggacggccgcgagatcgtcgtgccgtgccggaaccaggacgagctggtgggccgcgcccgggtcagccagggggccggctggtccctgcgcgagaccgcctgcctcggcaagagctacgcgcagatgtggcagctgatgtacttccaccggcgcgacctgcggctcgccgccaacgccatctgctccgcggtgcccgtggactgggtccccaccagccgcacgacctggtccatccacgcccaccaccagtggatgaccaccgaggacatgctgagcgtgtggaaccgcgtgtggatcgaggagaacccctggatggaggacaagacgcacatctccagctggggcgacgtcccgtacctggggaagcgggaggaccagtggtgcggctccctcatcggcctgaccgcccgcgccacctgggccaccaacatccaggtggcgatcaaccaggtgcggcgcctgatcgggaacgagaactacctcgactacatgaccagcatgaagcggttcaagaacgagtccgaccccgagggcgccctgtggtga

SEQ ID NO: 8483 - RNA, 9879 nt, synthetic construct
  misc_feature 1..9879: note = derived and/or modified CDS sequence (opt1) from DENV-1__GQ199775__SS-prME
  source 1..9879: mol_type = other RNA
agcgtgaccatgctgctcatgctgatgcccaccgccctggccttccacctcaccacccggggcggggagccccacatgatcgtgtccaagcaggagcggggcaagagcctgctgttcaagacctccgccggggtgaacatgtgcaccctcatcgccatggacctgggcgagctgtgcgaggacaccatgacctacaagtgcccccggatcaccgaggtggagcccgacgacgtggactgctggtgcaacaccaccgacacctgggtgacctacgggacctgcagccagacgggcgagcaccggcgcgacaagcggtccgtggccctcgcgccccacgtcggcctggggctggagacccgcgccgagacctggatgagctccgagggcgcgtggaagcagatccagaaggtggagacctgggccctccggcaccccgggttcacggtgatcgccctgttcctggcccacgcgatcggcaccagcatcacccagaaggggatcatcttcatcctcctgatgctggtcaccccctccatggccatgcgctgcgtgggcatcggcagccgggacttcgtggaggggctctccggcgccacgtgggtcgacgtggtgctggagcacgggagctgcgtcaccaccatggccaaggacaagcccaccctggacatcgagctcctgaagacggaggtgaccaaccccgccgtgctgcgcaagctctgcatcgaggcgaagatctccaacaccaccacggacagccggtgcccgacccagggcgaggccaccctggtcgaggagcaggacgccaacttcgtgtgccgccggaccttcgtggaccgcggctgggggaacggctgcgggctgttcggcaaggggtccctcatcacgtgcgccaagttcaagtgcgtcaccaagctggagggcaagatcgtgcagtacgagaacctgaagtacagcgtgatcgtcaccgtgcacaccggcgaccagcaccaggtcgggaacgagtccacggagcacggcaccatcgccaccatcacgccccaggcgcccaccagcgagatccagctcacggactacggggccctgaccctggactgcagcccccggaccggcctcgacttcaacgagatggtgctgctgaccatgaaggagaagtcctggctcgtgcacaagcagtggttcctggacctgcccctcccctggacgagcggggcctccaccagccaggagacctggaaccgccaggacctgctggtcaccttcaagacggcccacgccaagaagcaggaggtggtggtcctcggctcccaggagggcgcgatgcacaccgccctgaccggggccaccgagatccagacgaccggcaccaccacgatcttcgccgggcacctgaagtgccggctcaagatggacaagctgaccctgaagggcatgagctacgtgatgtgcaccgggtccttcaagctcgagaaggaggtggccgagacccagcacggcacggtcctggtgcagatcaagtacgagggcaccgacgcgccctgcaagatccccttcagcacccaggacgagaagggggtgacccagaacggccgcctgatcacggccaacccgatcgtcaccgacaaggagaagcccgtgaacatcgaggccgagccgcccttcggggagtcctacatcgtgatcggcgccggcgagaaggcgctgaagctcagctggttcaagaaggggtccagcatcggcaagatgttcgaggccaccgcccgcggggcccgccggatggccatcctgggcgacaccgcgtgggacttcgggtccatcggcggcgtcttcacgagcgtggggaagctggtgcaccagatcttcggcaccgcctacggggtcctcttctccggcgtgagctggaccatgaagatcgggatcggcgtgctgctgacctggctcggcctgaactcccgcagcacgtccctgagcatgacctgcatcgccgtcgggctcatcaccctgtacctgggcgtgatggtgcaggccgactccgggtgcgtcatcaactggaagggccgcgagctcaagtgcgggagcggcatcttcgtgaccaacgaggtgcacacgtggaccgagcagtacaagttccaggccgacagcccgaagcggctgtccgcggccatcggcaaggcctgggaggagggggtctgcggcatccgcagcgccacccggctggagaacatcatgtggcgccagatctccaacgagctcaaccacatcctgctggagaacgacatgaagttcaccgtggtggtcggggacgtggtgggcatcctcgcccaggggaagaagatggtccggccccagcccatggagcacaagtacagctggaagtcctggggcaaggcgaagatcatcggcgccgacgtgcagaacaccacgttcatcatcgacgggcccaacaccccggagtgccccgacgaccagcgcgcctggaacatctgggaggtggaggactacggcttcgggatcttcaccaccaacatctggctgaagctgcgggacagctacacgcaggtctgcgaccaccgcctcatgtccgccgcgatcaaggacagcaaggccgtgcacgccgacatgggctactggatcgagtccgagaagaacgagacctggaagctggcccgggccagcttcatcgaggtgaagacctgcatctggcccaagtcccacaccctgtggagcaacggcgtcctcgagtccgagatgatcatccccaagatctacgggggcccgatcagccagcacaactaccgccccgggtacttcacgcagaccgcgggcccctggcacctggggaagctggagctcgacttcgacctgtgcgagggcaccaccgtggtggtcgacgagcactgcggcaaccgggggccgtccctgcgcacgaccaccgtgaccggcaagatcatccacgagtggtgctgccggagctgcacgctgccgcccctccgcttcaagggggaggacggctgctggtacgggatggagatccggcccgtgcgcgagaaggaggagaacctggtcaagtccatggtgagcgccggcagcggcgaggtggactccttcagcctcgggctgctgtgcatctccatcatgatcgaggaggtcatgcggagccgctggtcccggaagatgctcatgaccggcaccctggccgtgttcttcctgctcatcatggggcagctgacctggaacgacctgatccgcagctgcatcatggtgggcgccaacgcctccgaccgcatggggatgggcacgacctacctcgcgctgatggccaccttcaagatgcggccgatgttcgccgtcggcctgctgttccgccggctgaccagccgcgaggtgctgctcctgacgatcgggctgtccctcgtcgccagcgtggagctgcccaactccctggaggagctcggcgacgggctggccatgggcatcatgatcctgaagctcctgaccgacttccagagctaccagctgtgggcgaccctcctgtccctgaccttcatcaagacgaccttcagcctccactacgcctggaagaccatggccatggtgctgtccatcgtcagcctgctccccctgtgcctgtccaccacgagccagaagaccacctggctccccgtgctgctgggctccctcgggtgcaagccgctgaccatgttcctgatcgccgagaacaagatctggggccggaagtcctggcccctcaacgaggggatcatggcggtgggcatcgtcagcatcctgctgtccagcctcctgaagaacgacgtgcccctggccgggcccctcatcgccggcggcatgctgatcgcctgctacgtgatctccgggagctccgccgacctgagcctcgagaaggcggccgaggtctcctgggaggaggaggccgagcacagcggcgcctcccacaacatcctggtggaggtgcaggacgacgggacgatgaagatcaaggacgaggagcgcgacgacaccctgaccatcctcctgaaggccaccctgctcgcggtcagcggcgtgtacccgctgtccatccccgccaccctgttcgtgtggtacttctggcagaagaagaagcagcggagcggggtcctctgggacacgcccagcccgcccgaggtggagcgcgccgtgctggacgacggcatctaccggatcatgcagcgcggcctgctggggcggagccaggtcggcgtgggggtgttccaggagaacgtcttccacaccatgtggcacgtgacccgcggcgccgtgctcatgtaccaggggaagcggctggagccctcctgggccagcgtcaagaaggacctgatctcctacggcggcgggtggcgcctccagggcagctggaacaccggggaggaggtccaggtgatcgcggtcgagcccggcaagaaccccaagaacgtgcagacggcccccgggaccttcaagacccccgagggcgaggtgggcgccatcgccctggacttcaagcccgggacctccggcagccccatcgtcaaccgggaggggaagatcgtgggcctgtacggcaacggggtggtcacgaccagcggcacctacgtgtccgccatcgcgcaggccaaggccagccaggaggggccgctccccgagatcgaggacgaggtgttccgcaagcggaacctgaccatcatggacctgcaccccggctccgggaagacgcgccggtacctcccggccatcgtccgcgaggcgatcaagcggaagctgcgcaccctgatcctcgcccccacccgcgtggtggccagcgagatggccgaggccctgaagggcatgcccatccggtaccagaccacggcggtcaagtccgagcacaccggccgcgagatcgtggacctgatgtgccacgccaccttcaccatgcggctcctgagccccgtgcgcgtcccgaactacaacatgatcatcatggacgaggcccacttcacggacccctccagcatcgccgcccgggggtacatctccacccgcgtgggcatgggggaggcggccgccatcttcatgaccgccacgccgcccggcagcgtggaggccttcccgcagtccaacgcggtcatccaggacgaggagcgggacatccccgagcgcagctggaactccgggtacgagtggatcacggacttccccggcaagaccgtgtggttcgtgcccagcatcaagtccggcaacgacatcgccaactgcctgcggaagaacgggaagcgcgtcatccagctcagccggaagaccttcgacaccgagtaccagaagacgaagaacaacgactgggactacgtggtgaccaccgacatctccgagatgggcgccaacttccgcgccgaccgggtcatcgacccgcgccggtgcctgaagcccgtgatcctgaaggacgggcccgagcgcgtcatcctcgcgggccccatgccggtgaccgtggccagcgccgcccagcggcgcgggcggatcggccgcaaccacaacaaggagggcgaccagtacatctacatggggcagcccctgaacaacgacgaggaccacgcccactggacggaggcgaagatgctgctcgacaacatcaacacccccgagggcatcatccccgccctgttcgagccggagcgcgagaagtccgccgccatcgacggggagtaccggctgcgcggcgaggcccggaagaccttcgtcgagctcatgcgccgcggggacctgcccgtgtggctgagctacaaggtggcgagcgagggcttccagtactccgaccgccggtggtgcttcgacggcgagcgcaacaaccaggtcctcgaggagaacatggacgtggagatctggaccaaggagggggagcggaagaagctgcgcccccggtggctggacgcccgcacgtacagcgaccccctcgccctgcgggagttcaaggagttcgccgccggccgccggtccgtgagcggggacctgatcctcgagatcggcaagctgccgcagcacctgacccagcgcgcgcagaacgccctcgacaacctggtcatgctgcacaactccgagcagggcgggcgggcctaccgccacgccatggaggagctccccgacaccatcgagaccctgatgctgctcgcgctgatcgccgtgctgacgggcggggtgaccctcttcttcctgagcggccgggggctgggcaagacctccatcggcctcctgtgcgtcatggccagctccgccctgctctggatggccagcgtggagccccactggatcgcggcctccatcatcctggagttcttcctgatggtgctcctgatccccgagccggaccgccagcggacgccccaggacaaccagctggcctacgtcgtgatcgggctcctgttcatgatcctgaccgtggccgccaacgagatgggcctcctggagacgaccaagaaggacctggggatcggccacgtcgcggtggagaaccaccaccacgccaccatgctcgacgtggacctgcaccccgccagcgcctggaccctgtacgccgtcgcgacgaccatcatcaccccgatgatgcgccacaccatcgagaacacgaccgccaacatctccctcaccgccatcgccaaccaggccgcgatcctgatggggctggacaagggctggcccatcagcaagatggacatcggcgtgcccctcctggccctggggtgctactcccaggtgaaccccctcaccctgacggccgccgtcctgatgctcgtggcgcactacgccatcatcggcccggggctgcaggccaaggccacccgcgaggcccagaagcggaccgcggccggcatcatgaagaaccccaccgtggacgggatcgtcgccatcgacctggaccccgtggtgtacgacgccaagttcgagaagcagctcggccagatcatgctgctgatcctctgcacgagccagatcctgctgatgcgcaccacctgggccctctgcgagtccatcaccctggcgacgggccccctgaccaccctctgggaggggagcccgggcaagttctggaacaccacgatcgccgtctccatggccaacatcttccgggggagctacctggccggcgccggcctggcgttcagcctcatgaagtccctcgggggcgggcgccgggggaccggggcccagggcgagaccctgggcgagaagtggaagcgccagctcaaccagctgagcaagtccgagttcaacacctacaagcggagcgggatcatggaggtggaccgctccgaggccaaggagggcctgcggcgcggggagacgaccaagcacgccgtgagccggggcaccgcgaagctccgctggttcgtcgagcggaacctggtgaagcccgaggggaaggtgatcgacctgggctgcggccgcgggggctggtcctactactgcgccgggctgaagaaggtcaccgaggtgaagggctacacgaagggcgggcccggccacgaggagcccatcccgatggccacctacgggtggaacctcgtgaagctgcacagcggcaaggacgtcttcttcatcccgcccgagaagtgcgacaccctgctctgcgacatcggggagtccagccccaacccgaccatcgaggagggccggacgctgcgcgtgctgaagatggtggagccctggctccgggggaaccagttctgcatcaagatcctgaacccctacatgccctccgtcgtggagaccctggagcacatgcagcgcaagcacggcggcatgctcgtgcggaacccgctgagccgcaactccacccacgagatgtactgggtcagctgcgggaccggcaacatcgtgtccgccgtgaacatgaccagccgcatgctgctcaaccggttcacgatggcccaccgcaagcccacctacgagcgggacgtcgacctgggggcgggcacccgccacgtggccgtggagcccgaggtcgccaacctggacatcatcggccagcggatcgagaacatcaagcacgagcacaagtccacctggcactacgacgaggacaacccctacaagacgtgggcctaccacgggagctacgaggtgaagccgtccggcagcgccagctccatggtcaacggggtggtgaagctcctgaccaagccctgggacgtcatccccatggtgacccagatcgcgatgaccgacacgacccccttcggccagcagcgcgtgttcaaggagaaggtcgacacccggaccccgaaggccaagcgcgggacggcccagatcatggaggtgaccgcccggtggctgtggggcttcctcagccgcaacaagaagccccggatctggacccgcgaggaggtgacccggaaggtccgctccaacgccggcatcggggcgggcgtgggggacgagaaccagtggaacagcgccaagaagggcgtggaggacgagcggttctgggacctggtccaccgcgagcgggagctgcacaagcaggggaagtgcgccacgtgcgtgtacaacatgatgggcaagcgcgagaagaagctcggcgagttcgggaaggccaagggctcccgggcgatctggtacatgtggctgggggcccgcttcctggagttcgaggccctcggcttcatgaacgaggaccactggttcagccgggagaactccctgagcggggtggagggcgagggcctgcacaagctcgggtacatcctgcgcgacatctccaagatccccggcgggaacatgtacgccgacgacaccgccggctgggacacccgcatcaccgaggacgacctgcagaacgaggcgaagatcacggacatcatggagccggagcacgccctcctggccaccagcatcttcaagctgacctaccagaacaaggtcgtgcgggtgcagcgccccgccaagaacggcaccgtcatggacgtgatctcccggcgcgaccagcgggggagcggccaggtggggacgtacggcctcaacaccttcaccaacatggaggcccagctgatccgccagatggagtccgaggggatcttcagcccctccgagctggagacccccaacctcgcggagcgggtcctggactggctggagaagtacggcgtggagcgcctcaagcggatggccatcagcggcgacgactgcgtggtcaagccgatcgacgaccgcttcgccacggccctgaccgccctgaacgacatggggaaggtgcggaaggacatcccccagtgggagccctccaagggctggaacgactggcagcaggtccccttctgcagccaccacttccaccagctcatcatgaaggacgggcgcgagatcgtcgtgccgtgccggaaccaggacgagctggtgggccgcgcgcgggtcagccagggggccggctggtccctgcgcgagaccgcctgcctcggcaagagctacgcccagatgtggcagctgatgtacttccaccggcgcgacctgcggctcgccgcgaacgccatctgctccgccgtgcccgtggactgggtccccaccagccgcacgacctggtccatccacgcccaccaccagtggatgaccaccgaggacatgctgagcgtgtggaaccgcgtgtggatcgaggagaacccctggatggaggacaagacgcacatctccagctggggcgacgtcccgtacctgggcaagcgggaggaccagtggtgcgggtccctcatcggcctgaccgcgcgcgccacctgggccaccaacatccaggtggccatcaaccaggtgcggcgcctgatcgggaacgagaactacctcgactacatgaccagcatgaagcggttcaagaacgagtccgaccccgagggcgccctgtggtga

SEQ ID NO: 8484 - RNA, 9876 nt, synthetic construct
  misc_feature 1..9876: note = derived and/or modified CDS sequence (opt1) from DENV-1__FJ882546__SS-prME
  source 1..9876: mol_type = other RNA
agcgtgaccatgctgctcatgctgatgcccaccgccctggccttccacctcaccacccgcggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtggagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtcctcttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggccgactccgggtgcgtcatcaactggaagggccgggagctcaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctggagaacatcatgtggaagcagatctccaacgagctcaaccacatcctgctggagaacgacatgaagctcaccgtggtggtcggggacgtggcgggcatcctggggcagggcaagaagatgatccggccccagcccatggagtacaagtacagctggaagtcctggggcaaggccaagatcatcggggccgacgcccagaacacgaccttcatcatcgacggccccaacaccccggagtgccccgacgaccagcgcgcgtggaacatctgggaggtggaggactacgggttcggcatcttcaccacgaacatctggctgaagctccgggacagctacacccaggtctgcgaccaccgcctgatgtccgccgccatcaaggacagcaaggccgtgcacgccgacatgggctactggatcgagtccgagaagaacgagacctggaagctggcgcgggccagcttcatcgaggtgaagacctgcatctggcccaagtcccacacgctctggagcaacggggtcctggagtccgagatgatcatccccaagatctacggcgggccgatcagccagcacaactaccgccccggctacttcacccagaccgccgggccctggcacctgggcaagctcgagctggacttcgacctgtgcgagggcaccacggtggtggtcgacgagcactgcgggaaccggggcccgtccctccgcaccaccaccgtgacggggaagatcatccacgagtggtgctgccggagctgcaccctgccgcccctgcgcttccggggcgaggacgggtgctggtacggcatggagatccgccccgtgaaggagaaggaggagaacctcgtcaagtccatggtgagcgccggcagcggggaggtggactccttcagcctgggcctgctctgcatctccatcatgatcgaggaggtcatgcggagccgctggtcccggaagatgctgatgaccgggaccctggccgtgttcttcctcctgatcatgggccagctgacgtggaacgacctcatccgcctgtgcatcatggtgggggcgaacgccagcgaccgcatgggcatgggcaccacctacctggccctcatggccaccttcaagatgcggccgatgttcgccgtcgggctgctgttccgccggctcacgtcccgcgaggtgctgctgctcaccatcgggctgagcctggtggcgtccgtcgagctccccaacagcctggaggagctgggggacggcctcgccatgggcatcatgatcctgaagctgctcaccgacttccagtcccaccagctgtgggccaccctgctcagcctgacgttcatcaagaccaccttctccctgcactacgcctggaagaccatggcgatggtgctcagcatcgtctccctgttccccctgtgcctcagcacgacctcccagaagaccacctggctgcccgtgctgctcgggagcctgggctgcaagccgctgacgatgttcctcatcgccgagaacaagatctgggggcggaagtcctggcccctgaacgagggcatcatggccgtggggatcgtcagcatcctgctcagctccctgctgaagaacgacgtgcccctcgccggccccctgatcgccggcgggatgctgatcgcgtgctacgtgatcagcggctccagcgccgacctctccctggagaaggccgccgaggtcagctgggaggaggaggccgagcactccggggcgagccacaacatcctggtggaggtgcaggacgacggcaccatgaagatcaaggacgaggagcgcgacgacaccctcaccatcctgctgaaggccaccctcctggccgtctccggggtgtacccgctgagcatccccgccaccctcttcgtgtggtacttctggcagaagaagaagcagcggtccggcgtcctgtgggacacccccagcccgcccgaggtggagcgcgccgtgctggacgacggcatctaccggatcatgcagcgcgggctgctcggccggtcccaggtcggggtgggcgtgttccaggagaacgtcttccacaccatgtggcacgtgacccgcggggcggtgctgatgtaccagggcaagcggctggagcccagctgggcctccgtcaagaaggacctcatcagctacggcgggggctggcgcctgcgggggtcctggaacacgggcgaggaggtccaggtgatcgccgtcgagcccgggaagaaccccaagaacgtgcagaccgcccccggcaccttcaagacccccgagggcgaggtgggggccatcgcgctggacttcaagcccggcacgagcgggtcccccatcgtcaaccgcgagggcaagatcgtgggcctctacgggaacggcgtggtcaccaccagcgggacctacgtgagcgccatcgcccaggccaaggcgtcccaggagggcccgctgcccgagatcgaggacgaggtgttccggaagcgcaacctgacgatcatggacctccaccccgggagcggcaagacccggcgctacctgccggccatcgtccgggaggccatcaagcgcaagctgcgcaccctcatcctggcccccacccgggtggtggcctccgagatggcggaggccctgaagggcatgcccatccgctaccagacgaccgccgtcaagagcgagcacaccgggaaggagatcgtggacctcatgtgccacgccaccttcacgatgcggctgctgtcccccgtgcgcgtcccgaactacaacatgatcatcatggacgaggcccacttcaccgaccccagctccatcgcggcccggggctacatcagcacccgcgtggggatgggcgaggccgccgccatcttcatgaccgcgacgccgcccgggtccgtggaggccttcccgcagagcaacgccgtcatccaggacgaggagcgggacatccccgagcgctcctggaacagcggctacgagtggatcaccgacttccccggcaagaccgtgtggttcgtgccctccatcaagagcgggaacgacatcgccaactgcctccggaagaacggcaagcgcgtcatccagctgtcccggaagaccttcgacacggagtaccagaagaccaagaacaacgactgggactacgtggtgaccaccgacatcagcgagatgggggcgaacttccgcgccgaccgggtcatcgacccgcgccggtgcctgaagcccgtgatcctcaaggacggccccgagcgcgtgatcctggccgggcccatgccggtcacggtggcctccgccgcgcagcggcgcggccggatcggccgcaaccacaacaaggagggggaccagtacatctacatgggccagcccctgaacaacgacgaggaccacgcccactggaccgaggccaagatgctcctggacaacatcaacacccccgaggggatcatccccgccctgttcgagccggagcgcgagaagtccgccgcggtcgacggcgagtaccggctccgcggggaggcccggaagaccttcgtggagctgatgcgccggggcgacctgcccgtgtggctctcctacaaggtcgccagcgagggcttccagtacagcgaccgccggtggtgcttcgacggggagcgcaacaaccaggtgctggaggagaacatggacgtggagatctggacgaaggagggcgagcggaagaagctgcgcccccggtggctcgacgcccgcacctactccgaccccctggccctgcgggagttcaaggagttcgcggccgggcgcaagagcgtctccggcgacctcatcctggagatcggcaagctgccgcagcacctcacccagcgggcccagaacgccctggacaacctggtgatgctccacaacagcgagcagggcgggcgcgcgtaccggcacgccatggaggagctgcccgacaccatcgagacgctgatgctcctggccctgatcgccgtgctcaccgggggcgtcaccctgttcttcctgtccgggcgcggcctcggcaagaccagcatcgggctgctgtgcgtgatggcctccagcgtgctcctgtggatggcgtccgtcgagccccactggatcgccgccagcatcatcctggagttcttcctcatggtgctgctgatccccgagccggaccggcagcgcacgccccaggacaaccagctcgcctacgtggtcatcggcctgctgttcatgatcctcacggtggccgcgaacgagatggggctgctggagaccaccaagaaggacctcggcatcgggcacgtggccgtcgagaaccaccaccacgccgccatgctggacgtggacctgcaccccgcctccgcgtggaccctctacgccgtggccacgaccatcatcaccccgatgatgcggcacaccatcgagaacacgaccgccaacatcagcctgaccgccatcgcgaaccaggccgccatcctgatgggcctcgacaagggctggcccatctccaagatggacatcggggtccccctgctggccctcggctgctacagccaggtgaaccccctgaccctgacggcggccgtgctcatgctggtcgcccactacgccatcatcgggccgggcctgcaggccaaggcgacccgcgaggcccagaagcgcaccgccgccgggatcatgaagaaccccaccgtggacggcatcgtggccatcgacctcgaccccgtcgtgtacgacgcgaagttcgagaagcagctgggccagatcatgctgctcatcctgtgcacgtcccagatcctgctcatgcggaccacctgggccctgtgcgagagcatcaccctggccacggggcccctcaccaccctgtgggagggctccccggggaagttctggaacaccacgatcgccgtgagcatggccaacatcttccgcggctcctacctggcgggcgccgggctcgccttcagcctgatgaagtccctgggcgggggccggcgcgggaccggcgcccagggcgagaccctcggggagaagtggaagcggcagctgaaccagctgtccaagagcgagttcaacacctacaagcgctccggcatcatggaggtcgaccggagcgaggcgaaggaggggctcaagcgcggcgagacgaccaagcacgccgtgtcccgggggaccgccaagctgcgctggttcgtggagcggaacctggtcaagcccgagggcaaggtgatcgacctgggctgcgggcgcggcgggtggagctactactgcgccggcctcaagaaggtgaccgaggtcaaggggtacacgaagggcggccccgggcacgaggagcccatcccgatggccacctacggctggaacctggtgaagctgcactccgggaaggacgtgttcttcatcccgcccgagaagtgcgacaccctcctgtgcgacatcggcgagagctcccccaacccgaccatcgaggaggggcggacgctgcgcgtcctcaagatggtggagccctggctgcggggcaaccagttctgcatcaagatcctgaacccctacatgcccagcgtggtcgagaccctcgagcagatgcagcgcaagcacggcgggatgctggtgcggaacccgctgtcccgcaacagcacccacgagatgtactgggtgtcctgcggcaccgggaacatcgtcagcgcggtgaacatgacctcccggatgctcctgaaccgcttcacgatggcccaccgcaagcccacctacgagcgggacgtggacctgggcaccggcacccgccacgtcgccgtggagcccgaggtggccaacctcgacatcatcgggcagcggatcgagaacatcaagcacgagcacaagagcacgtggcactacgacgaggacaacccctacaagacctgggcctaccacggctcctacgaggtcaagccgagcgggtccgcgagcagcatggtgaacggcgtcgtgaagctgctgaccaagccctgggacgtgatccccatggtcacccagatcgccatgacggagctccacctggggcagcagcgcgtgttcaaggagaaggtggacacccggacgccccgcgccaagcggggcaccgcccagatcatggagatgacggcccgctggctgtggggcttcctctcccggaacaagatcccgcgcatctgcacccgggaggagttcacccgcaaggtccggagcaacgcggccatcggggccgtgttcgtggacgagaaccagtggaactccgccaaggaggcggtcgaggacgagcgcttctgggacctggtgcaccgggagcgcgagctgcacaagcagggcaagtgcgcgacctgcgtgtacaacatgatggggaagcgggagaagaagctcggcgagttcgggaaggccaagggcagccgcgccatctggtacatgtggctgggcgcccggttcctggagttcgaggcgctcgggttcatgaacgaggaccactggttctcccgcgagaacagcctgtccggcgtcgagggggagggcctgcacaagctcgggtacatcctgcgggacatcagcaagatccccggcggcaacatgtacgccgacgacacggccgggtgggacacccgcatcaccgaggacgacctgcagaacgaggccaagatcaccgacatcatggagcccgagcacgccctcctggcgaaggccatcttcaagctgacgtaccagaacaaggtggtgcgcgtccagcggccggccaagaacggcaccgtgatggacgtgatctcccgccgggaccagcgcgggagcggccaggtcggcacctacgggctcaacaccttcacgaacatggaggcccagctgatccggcagatggagtccgaggagatcttcagcccctccgagctggagacccccaacctcgccgagcgcgcgctggactggctggagaagtacggcgtggagcggctcaagcgcatggccatcagcggggacgactgcgtggtcaagcccatcgacgaccggttcgccaccgccctgaccgccctgaacgacatgggcaaggtgcgcaaggacatcccgcagtgggagccctccaaggggtggaacgactggcagcaggtccccttctgcagccaccacttccaccagctcatcatgaaggacggccgggagatcgtcgtgccctgccgcaaccaggacgagctggtgggccgggcgcgcgtctcccagggggccggctggagcctgcgggagacggcctgcctcggcaagagctacgcccagatgtggcagctgatgtacttccaccgccgggacctgcgcctcgcggccaacgccatctgctccgccgtgccggtggactgggtccccaccagccggaccacctggtccatccacgcccaccaccagtggatgacgaccgaggacatgctgagcgtgtggaaccgcgtgtggatcgaggagaacccctggatggaggacaagacccacatctccagctgggaggacgtcccctacctgggcaagcgcgaggaccagtggtgcgggtccctcatcggcctgaccgcgcgggccacgtgggccaccaacatccaggtggccatcaaccaggtgcgccggctgatcggcaacgagaactacctcgactacatgaccagcatgaagcgcttcaagaacgagtccgacccggagggggccctgtggtga

SEQ ID NO: 8485 - RNA, 9879 nt, synthetic construct
  misc_feature 1..9879: note = derived and/or modified CDS sequence (opt1) from DENV-1__KF921935__SS-prME
  source 1..9879: mol_type = other RNA
agcgtgaccatgctgctgatgctgatgcccaccgccctggccttccacctcaccacccggggcggggagccccacatgatcgtgagcaagcaggagcggggcaagagcctgctgttcaagacctccgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgggacaagcggtccgtggccctcgcgccccacgtgggcctggggctggagacccgcaccgagacctggatgagctccgagggcgcgtggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcctgacgcaggacgagaagggggtgacccagaacggccggctgatcaccgccaacccgatcgtgaccgacaaggagaagcccgtcaacatcgaggccgagccgcccttcggggagagctacatcatcatcggcgccggcgagaaggcgctcaagctgtcctggttcaagaaggggagctccatcggcaagatgttcgaggccacggcccgcggggcccggcgcatggccatcctgggcgacaccgcgtgggacttcgggagcatcggcggcgtgttcacctccgtggggaagctcgtccaccagatcttcggcaccgcctacggggtgctgttcagcggcgtgtcctggacgatgaagatcgggatcggcgtcctgctcacctggctgggcctgaacagccgctccaccagcctctccatgacctgcatcgccgtggggctggtgacgctgtacctcggcgtcatggtgcaggccgacagcgggtgcgtgatcaactggaagggccgggagctgaagtgcgggtccggcatcttcgtcaccaacgaggtgcacacctggaccgagcagtacaagttccaggccgacagcccgaagcgcctgagcgcggccatcggcaaggcctgggaggagggggtgtgcggcatccggtccgccacccgcctcgagaacatcatgtggaagcagatcagcaacgagctgaaccacatcctgctcgagaacgacatgaagttcacggtcgtggtgggggacgtcgccggcatcctggcgcaggggaaggagatgatccggccccagcccatggagtacaagtactcctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctgaagctccgggactcccacacccaggtctgcgaccaccgcctgatgagcgcggccatcaaggactccaaggccgtgcacgccgacatgggctactggatcgagagcgagaagaacgagacctggaagctggcccgggcgtccttcatcgaggtgaagacgtgcatctggcccaagagccacaccctctggtccaacggcgtcctggagagcgagatgatcatccccaagatctacgggggcccgatctcccagcacaactaccgccccgggtacttcacccagaccgccggcccctggcacctggggaagctcgagctggacttcgacctgtgcgagggcacgaccgtggtggtcgacgagcactgcggcaaccgggggccgagcctccgcaccaccacggtgaccggcaagatcatccacgagtggtgctgccggtcctgcaccctgccgcccctgcgcttccgcggggaggacggctgctggtacgggatggagatccgccccgtgaaggagaaggaggagaacctcgtcaagagcatggtgtccgccggcagcggcgaggtggacagcttctccctggggctgctctgcatcagcatcatgatcgaggaggtcatgcggtcccgctggagccggaagatgctgatgaccggcacgctggccgtgttcttcctcctgatcatggggcagctgacctggaacgacctcatccgcctgtgcatcatggtgggcgccaacgcgtccgaccgcatggggatgggcaccacctacctggccctcatggccacgttcaagatgcggccgatgttcgccgtcggcctgctgttccgccggctcaccagccgcgaggtgctgctgctcaccatcgggctgtccctggtggccagcgtcgagctccccaactccctggaggagctgggcgacgggctcgcgatgggcatcatgatcctgaagctgctcaccgacttccagagccaccagctgtgggccacgctgctctccctgaccttcatcaagaccaccttcagcctgcactacgcctggaagacgatggccatggtgctctccatcgtcagcctgttccccctgtgcctctccaccaccagccagaagaccacgtggctgcccgtgctgctcggctccctggggtgcaagccgctgaccatgttcctcatcgcggagaacaagatctggggccggcgcagctggcccctgaacgaggggatcatggccgtgggcatcgtctccatcctgctcagcagcctgctgaagaacgacgtgcccctcgccgggcccctgatcgccggcggcatgctgatcgcctgctacgtgatctccgggagctccgcggacctcagcctggagaaggccgccgaggtctcctgggaggaggaggccgagcacagcggcgcctcccacaacatcctggtggaggtgcaggacgacgggaccatgaagatcaaggacgaggagcgggacgacaccctcaccatcctgctgaaggcgacgctcctggccgtcagcggcgtgtacccgctgtccatccccgccaccctcttcgtgtggtacttctggcagaagaagaagcagcgcagcggggtcctgtgggacacccccagcccgcccgaggtggagcgggccgtgctggacgacggcatctaccgcatcatgcagcggggcctgctcgggcgcagccaggtcggcgtgggggtgttccaggagaacgtcttccacaccatgtggcacgtgacgcggggcgccgtgctgatgtaccaggggaagcgcctggagccctcctgggcgagcgtcaagaaggacctcatctcctacggcggcgggtggcggctgcagggcagctggaacaccggggaggaggtccaggtgatcgccgtcgagcccggcaagaaccccaagaacgtgcagaccgcccccgggaccttcaagacgcccgagggcgaggtgggcgccatcgccctggacttcaagcccgggacctccggcagccccatcgtcaaccgcgaggggaagatcgtgggcctctacggcaacggggtggtcaccacctccggcacgtacgtgagcgcgatcgcccaggccaaggccagccaggaggggccgctgcccgagatcgaggacgaggtgttccggaagcgcaacctgaccatcatggacctccaccccggctccgggaagacccggcgctacctgccggcgatcgtccgggaggccatcaagcgcaagctgcgcaccctcatcctggcccccacgcgggtggtggccagcgagatggccgaggcgctgaagggcatgcccatccgctaccagaccaccgccgtcaagtccgagcacaccggcaaggagatcgtggacctcatgtgccacgccacgttcaccatgcggctgctgagccccgtgcgcgtcccgaactacaacatgatcatcatggacgaggcccacttcaccgacccctccagcatcgccgcgcgggggtacatctccacccgcgtgggcatgggggaggccgccgccatcttcatgacggccacgccgcccggcagcgtggaggcgttcccgcagtccaacgccgtcatccaggacgaggagcgggacatccccgagcgcagctggaactccgggtacgagtggatcaccgacttccccggcaagaccgtgtggttcgtgcccagcatcaagtccggcaacgacatcgccaactgcctccggaagaacgggaagcgcgtcatccagctgagccggaagacgttcgacaccgagtaccagaagaccaagaacaacgactgggactacgtggtgaccacggacatctccgagatgggcgccaacttccgcgcggaccgggtcatcgacccgcgccggtgcctgaagcccgtgatcctcaaggacgggcccgagcgcgtgatcctggccggccccatgccggtcaccgtggccagcgccgcccagcggcgcgggcggatcggccgcaaccacaacaaggagggcgaccagtacatctacatggggcagcccctgaacaacgacgaggaccacgcgcactggaccgaggccaagatgctcctggacaacatcaacacccccgagggcatcatccccgccctgttcgagccggagcgcgagaagtccgccgccatcgacggggagtaccggctccgcggcgaggcgcggaagacgttcgtcgagctgatgcgccgcggggacctgcccgtgtggctcagctacaaggtggcctccgagggcttccagtacagcgaccgccggtggtgcttcgacggcgagcgcaacaaccaggtcctggaggagaacatggacgtggagatctggaccaaggagggggagcggaagaagctgcgcccccggtggctcgacgcccgcacctacagcgaccccctggccctgcgggagttcaaggagttcgccgcgggccgccggtccgtgagcggggacctcatcctggagatcggcaagctgccgcagcacctcacccagcgcgcccagaacgccctggacaacctggtcatgctccacaactccgagcagggcgggcgggcctaccgccacgcgatggaggagctgcccgacacgatcgagaccctgatgctcctggccctgatcgccgtgctcaccggcggggtgaccctgttcttcctgagcggccgggggctcggcaagacctccatcggcctgctgtgcgtcatggccagctccgtgctcctgtggatggccagcgtggagccccactggatcgcggcctccatcatcctggagttcttcctcatggtcctgctgatccccgagccggaccgccagcggacgccccaggacaaccagctcgcctacgtggtgatcgggctgctgttcatgatcctcaccgtcgccgccaacgagatgggcctgctggagaccaccaagaaggacctcgggatcggccacgtggcggtggagaaccaccaccacgccgccatgctggacgtcgacctgcaccccgccagcgcctggacgctctacgcggtggccaccaccatcatcaccccgatgatgcgccacacgatcgagaacaccaccgccaacatctccctgaccgccatcgccaaccaggcggccatcctgatggggctcgacaagggctggcccatcagcaagatggacatcggcgtgcccctgctggccctcgggtgctactcccaggtcaaccccctgacgctgaccgccgcggtgctcatgctggtggcccactacgccatcatcggcccggggctgcaggccaaggccacccgcgaggcgcagaagcggaccgccgccggcatcatgaagaaccccacggtcgacgggatcgtggccatcgacctcgaccccgtggtctacgacgccaagttcgagaagcagctgggccagatcatgctgctcatcctgtgcaccagccagatcctgctcatgcgcaccacctgggcgctgtgcgagtccatcacgctggccaccggccccctcaccaccctgtgggaggggagcccgggcaagttctggaacacgaccatcgccgtgtccatggccaacatcttccgggggagctacctggccggcgcgggcctcgccttctccctgatgaagtccctcgggggcgggcgccgggggaccggggcccagggcgagaccctcggcgagaagtggaagcgccagctgaaccagctgagcaagtccgagttcaacacgtacaagcggagcgggatcatggaggtggaccgctccgaggccaaggagggcctcaagcgcggggagaccaccaagcacgcggtcagccgcggcaccgccaagctgcggtggttcgtggagcgcaacctggtgaagcccgaggggaaggtcatcgacctgggctgcggccgcggcgggtggtcctactactgcgccgggctcaagaaggtgacggaggtgaaggggtacaccaagggcggccccggccacgaggagcccatcccgatggccacctacgggtggaacctggtcaagctgcacagcggcaaggacgtgttcttcatcccgcccgagaagtgcgacaccctcctgtgcgacatcggggagtccagccccaacccgacgatcgaggagggccgcaccctgcgggtgctcaagatggtcgagccctggctgcgcgggaaccagttctgcatcaagatcctgaacccctacatgccctccgtggtggagaccctcgagcagatgcagcggaagcacggcggcatgctggtccgcaacccgctgagccggaactccacccacgagatgtactgggtgagctgcgggaccggcaacatcgtgtccgccgtcaacatgacgagccgcatgctcctgaaccgcttcaccatggcgcaccggaagcccacctacgagcgcgacgtggacctgggggccggcacccggcacgtggccgtcgagcccgagatcgccaacctcgacatcatcggccagcgcatcgagaacatcaagcacgagcacaagtccacgtggcactacgacgaggacaacccctacaagacctgggcctaccacgggagctacgaggtgaagccgtccggcagcgcgtccagcatggtgaacggggtcgtgaagctgctgaccaagccctgggacgtcatccccatggtgacccagatcgccatgacggacaccacccccttcggccagcagcgggtgttcaaggagaaggtcgacacccgcacgccgaaggccaagcgggggaccgcccagatcatggaggtgaccgccaagtggctctggggcttcctgagccgcaacaagaagccccggatctgcacccgcgaggagttcacgcggaaggtgcgctccaacgcggccatcggcgccgtcttcgtggacgagaaccagtggaacagcgccaaggaggcggtggaggacgagcggttctgggacctggtccaccgcgagcgggagctccacaagcaggggaagtgcgcgacctgcgtgtacaacatgatgggcaagcgcgagaagaagctgggggagttcggcaaggccaaggggtcccgggccatctggtacatgtggctgggcgcccgcttcctcgagttcgaggcgctgggcttcatgaacgaggaccactggttcagccgggagaactccctgagcggggtggagggcgaggggctccacaagctgggctacatcctgcgcgacatctccaagatccccgggggcaacatgtacgccgacgacaccgccggctgggacacccggatcacggaggacgacctccagaacgaggcccgcatcaccgacatcatggagccggagcacgccctgctggccaagagcatcttcaagctcacctaccagaacaaggtcgtgcgcgtgcagcggcccgccaagaacgggaccgtcatggacgtgatctcccgccgggaccagcgcggcagcggccaggtggggacgtacggcctgaacaccttcaccaacatggaggcccagctgatccggcagatggagtccgaggggatcttcagcccctccgagctcgagacccccaacctggccgagcgcgtcctggactggctcgagaagtacggcgtggagcggctgaagcgcatggccatcagcggggacgactgcgtggtcaagccgatcgacgaccggttcgcgacggccctgaccgccctcaacgacatgggcaaggtgcgcaaggacatcccccagtgggagccctccaaggggtggaacgactggcagcaggtccccttctgcagccaccacttccaccagctgatcatgaaggacggccgggagatcgtcgtgccgtgccgcaaccaggacgagctggtgggccgggcccgcgtctcccagggggccggctggagcctccgggagaccgcgtgcctgggcaagagctacgcccagatgtggcagctgatgtacttccaccgccgggacctccgcctggccgccaacgcgatctgctccgccgtgcccgtggactggatccccaccagccggacgacctggtccatccacgcccaccaccagtggatgaccaccgaggacatgctgagcgtctggaaccgcgtgtggatcgaggagaacccctggatggaggacaagacgcacatctccagctggggcgacgtgccgtacctcgggaagcgcgaggaccagtggtgcggctccctgatcggcctgaccgcccgggccacctgggcgaccaacatccaggtcgccatcaaccaggtgcgccggctcatcgggaacgagaactacctggactacatgaccagcatgaagcgcttcaagaacgagggcgaccccgagggggccctgtggtga

SEQ ID NO: 8486 - RNA, 9879 nt, synthetic construct
  misc_feature 1..9879: note = derived and/or modified CDS sequence (opt1) from DENV-1__GQ199776__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacacgatgacctacaagtgcccccgcatcaccgagaccgagcccgacgacgtggactgctggtgcaacgccacggacacctgggtgacctacgggacctgcagccagacgggcgagcaccggcgcgacaagcggtccgtggccctcgcgccccacgtgggcctggggctggagacccgcaccgagacctggatgagctccgagggcgcgtggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtcgggaagctggtgcaccagatcttcggcaccgcctacggggtgctgttctccggcgtcagctggacgatgaagatcgggatcggcgtgctgctgacctggctcggcctgaactcccgcagcacctccctgagcatgacctgcatcgccgtggggctcgtcacgctgtacctgggcgtgatggtgcaggccgactccgggtgcgtcatcaactggaagggccgggagctcaagtgcgggagcggcatcttcgtgaccaacgaggtgcacacctggaccgagcagtacaagttccaggccgacagcccgaagcgcctgtccgcggccatcggcaaggcctgggaggagggggtctgcggcatccggagcgccacccgcctggagaacatcatgtggaagcagatctccaacgagctcaaccacatcctgctggagaacgacatgaagttcacggtggtggtcggggacgtggccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtcgaggactacggcttcgggatcttcacgaccaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacgtgcatctggcccaagtcccacaccctgtggagcaacggcgtgctcgagtccgagatgatcatccccaagatctacgggggcccgatcagccagcacaactaccgccccgggtacttcacccaggccgccggcccctggcacctggggaagctggagctcgacttcgacctgtgcgagggcaccacggtggtcgtggacgagcactgcggcaaccgggggccgtccctgcgcaccaccaccgtgacgggcaagatcatccacgagtggtgctgccggagctgcaccctgccgcccctccgcttccgcggggaggacggctgctggtacgggatggagatccgccccgtcaaggagaaggaggagaacctggtgaagtccatggtgagcgccggcagcggcgaggtcgactccttcagcctcgggctgctgtgcatctccatcatgatcgaggaggtgatgcggagccgctggtcccggcgcatgctcatgaccggcaccctggccgtgttcttcctgctcatcatggggcagctgacgtggaacgacctgatccgcctctgcatcatggtcggcgcgaacgccagcgaccggatggggatgggcaccacctacctggccctgatggccaccttcaagatgcgcccgatgttcgccgtgggcctcctgttccggcgcctgacgtcccgggaggtgctcctgctgaccatcgggctcagcctggtcgcgtccgtggagctgcccaacagcctcgaggagctgggcgacgggctggccatgggcatcatgatcctcaagctgctgaccgacttccagtcccaccagctctgggccaccctgctgagcctcacgttcatcaagaccaccctgtccctgcactacgcctggaagaccatggcgatggtcctcagcatcgtgtccctgttccccctgtgcctcagcacgacctcccagaagaccacctggctgcccgtgctgctcggcagcctggggtgcaagccgctgacgatgttcctcatcgccgagaacaagatctggggccgccggtcctggcccctgaacgaggggatcatggccgtcggcatcgtgagcatcctgctcagctccctgctgaagaacgacgtgcccctcgccgggcccctgatcgccggcggcatgctgatcgcgtgctacgtcatcagcgggtccagcgccgacctctccctggagaaggccgccgaggtgagctgggaggaggaggccgagcactccggcgcgagccacaacatcctggtggaggtccaggacgacgggaccatgaagatcaaggacgaggagcgcgacgacaccctcaccatcctgctgaaggccaccctcctggccgtgtccggcgtgtacccgctgagcatccccgccaccctcttcgtctggtacttctggcagaagaagaagcagcggtccggggtgctgtgggacacccccagcccgcccgaggtggagcgcgccgtcctggacgacggcatctaccggatcatgcagcgcggcctgctcgggcggtcccaggtgggcgtgggggtcttccaggagaacgtgttccacaccatgtggcacgtgacccgcggcgcggtcctgatgtaccaggggaagcggctggagcccagctgggcctccgtgaagaaggacctcatcagctacggcggcgggtggcgcctgcagggctcctggaacacgggggaggaggtgcaggtcatcgccgtggagcccggcaagaaccccaagaacgtgcagaccgcccccgggaccttcaagacccccgagggcgaggtcggcgccatcgcgctggacttcaagcccgggacgagcggctcccccatcgtgaaccgggaggggaagatcgtgggcctctacggcaacggggtcgtgaccaccagcggcacctacgtgagcgccatcgcccaggccaaggcgtcccaggaggggccgctgcccgagatcgaggacgaggtcttccgcaagcggaacctgacgatcatggacctccaccccggcagcgggaagacccgccggtacctgccggccatcgtgcgcgaggccatcaagcgcaagctgcggaccctcatcctggcccccacccgcgtggtcgcctccgagatggcggaggccctgaagggcatgcccatccggtaccagacgaccgccgtcaagagcgagcacaccggcaaggagatcgtggacctcatgtgccacgccaccttcacgatgcgcctgctgtcccccgtccgggtgccgaactacaacatgatcatcatggacgaggcccacttcaccgaccccagctccatcgcggcccgcgggtacatcagcacccgggtgggcatgggggaggccgccgccatcttcatgaccgcgacgccgcccggctccgtcgaggccttcccgcagagcaacgccgtgatccaggacgaggagcgcgacatccccgagcggtcctggaacagcgggtacgagtggatcaccgacttccccggcaagaccgtgtggttcgtcccctccatcaagagcggcaacgacatcgccaactgcctccgcaagaacgggaagcgggtgatccagctgtcccgcaagaccttcgacacggagtaccagaagaccaagaacaacgactgggactacgtggtcaccaccgacatcagcgagatgggcgcgaacttccgggccgaccgcgtgatcgacccgcggcgctgcctgaagcccgtgatcctcaaggacgggcccgagcgggtcatcctggccggccccatgccggtgacggtcgcctccgccgcgcagcgccgggggcgcatcggccgcaaccacaacaaggagggcgaccagtacatctacatggggcagcccctgaacaacgacgaggaccacgcccactggaccgaggccaagatgctcctggacaacatcaacacccccgagggcatcatccccgccctgttcgagccggagcgggagaagtccgccgcgatcgacggggagtaccgcctccggggcgaggcccgcaagaccttcgtggagctgatgcggcgcggggacctgcccgtgtggctctcctacaaggtcgccagcgagggcttccagtacagcgaccggcgctggtgcttcgacggcgagcggaacaaccaggtgctggaggagaacatggacgtggagatctggacgaaggagggggagcgcaagaagctgcggccccgctggctcgacgcccggacctactccgaccccctggccctgcgcgagttcaaggagttcgcggccggccggcgcagcgtctccggggacctcatcctggagatcggcaagctgccgcagcacctcacccagcgggcccagaacgccctggacaacctggtgatgctccacaacagcgagcagggcgggcgcgcgtaccggcacgccatggaggagctgcccgacaccatcgagacgctgatgctcctggccctgatcgccgtgctcaccggcggggtcaccctgttcttcctgtccggccgcgggctcggcaagaccagcatcggcctgctgtgcgtgatggcctccagcgtgctcctgtggatggcgtccgtcgagccccactggatcgccgccagcatcatcctggagttcttcctcatggtgctgctgatccccgagccggaccggcagcgcacgccccaggacaaccagctcgcctacgtggtcatcgggctgctgttcatgatcctcacggtggccgcgaacgagatgggcctgctggagaccaccaagaaggacctcgggatcggccacgtggccgtcgagaaccaccaccacgccgccatgctggacgtggacctgcaccccgcctccgcgtggaccctctacgccgtggccacgaccatcatcaccccgatgatgcgccacaccatcgagaacacgaccgccaacatcagcctgaccgccatcgcgaaccaggccgccatcctgatggggctcgacaagggctggcccatctccaagatggacatcggcgtccccctgctggccctcgggtgctacagccaggtgaaccccctgaccctgacggcggccgtgctcatgctggtcgcccactacgccatcatcggcccggggctgcaggccaaggcgacccgggaggcccagaagcgcaccgccgccggcatcatgaagaaccccaccgtggacgggatcgtggccatcgacctcgaccccgtcgtgtacgacgcgaagttcgagaagcagctgggccagatcatgctgctcatcctgtgcacgtcccagatcctgctcatgcggaccacctgggccctgtgcgagagcatcaccctggccacgggccccctcaccaccctgtgggaggggtccccgggcaagttctggaacaccacgatcgccgtgagcatggccaacatcttccgcgggtcctacctggcgggcgccggcctcgccttcagcctgatgaagtccctcgggggcgggcggcgcgggaccggggcccagggcgagaccctcggcgagaagtggaagcggcagctgaaccagctgtccaagagcgagttcaacacctacaagcgctccgggatcatggaggtcgaccggagcgaggcgaaggagggcctcaagcgcggggagacgaccaagcacgccgtgtcccggggcaccgccaagctgcgctggttcgtggagcggaacctggtcaagcccgaggggaaggtgatcgacctgggctgcggccgcgggggctggagctactactgcgccgggctcaagaaggtgaccgaggtcaagggctacacgaagggcggccccggccacgaggagcccatcccgatggccacctacgggtggaacctggtgaagctgcactccggcaaggacgtgttcttcatcccgcccgagaagtgcgacaccctcctgtgcgacatcggggagagctcccccaacccgaccatcgaggagggccggacgctgcgcgtcctcaagatggtggagccctggctgcgggggaaccagttctgcatcaagatcctgaacccctacatgcccagcgtggtcgagaccctcgagcagatgcagcgcaagcacggcggcatgctggtgcggaacccgctgtcccgcaacagcacccacgagatgtactgggtgtcctgcgggaccggcaacatcgtcagcgcggtgaacatgacctcccgcatgctcctgaaccggttcacgatggcccaccgcaagcccacctacgagcgggacgtggacctgggggccggcacccgccacgtcgtggtggagcccgaggtcgccaacctcgacatcatcggccagcggatcgagaacatcaagcacgagcacaagagcacctggcactacgacgaggacaacccctacaagacgtgggcctaccacgggtcctacgaggtgaagccgagcggctccgcgagcagcatggtcaacggggtggtgaagctgctgaccaagccctgggacgtcatccccatggtgacccagatcgccatgaccgacacgacccccttcggccagcagcgcgtgttcaaggagaaggtcgacacccggaccccgaaggccaagcgcgggacggcccagatcatggaggtgaccgccaagtggctctggggcttcctgtcccggaacaagaagccccgcatctgcacccgggaggagttcacccgcaaggtgcggagcaacgcggccatcggcgccgtcttcgtggacgagaaccagtggaactccgccaaggaggcggtggaggacgagcgcttctgggacctggtccaccgggagcgcgagctccacaagcaggggaagtgcgccacgtgcgtgtacaacatgatgggcaagcgggagaagaagctgggggagttcggcaaggccaaggggagccgcgccatctggtacatgtggctgggcgcccggttcctcgagttcgaggcgctgggcttcatgaacgaggaccactggttctcccgcgagaacagcctgtccggggtggagggcgaggggctccacaagctgggctacatcctgcgggacatcagcaagatccccgggggcaacatgtacgccgacgacaccgccggctgggacacccgcatcaccgaggacgacctccagaacgaggcccgcatcacggacatcatggagccggagcacgccctgctggcgaagtccatcttcaagctcacctaccagaacaaggtcgtgcgggtgcagcgccccgccaagaacgggaccgtcatggacgtgatcagccggcgcgaccagcggggctccggccaggtggggacctacggcctgaacacgttcaccaacatggaggcccagctgatccgccagatggagagcgaggggatcttctcccccagcgagctcgagacccccaacctggccgagcgggtcctggactggctcgagaagtacggcgtggagcgcctgaagcggatggccatctccggggacgactgcgtggtcaagccgatcgacgaccgcttcgcgaccgccctgacggccctcaacgacatgggcaaggtgcggaaggacatcccccagtgggagcccagcaaggggtggaacgactggcagcaggtccccttctgctcccaccacttccaccagctgatcatgaaggacggccgcgagatcgtcgtgccgtgccggaaccaggacgagctggtgggccgcgcccgggtcagccagggggccggctggagcctccgcgagaccgcgtgcctggggaagtcctacgcccagatgtggcagctgatgtacttccaccggcgcgacctccggctggccgccaacgcgatctgcagcgccgtgcccgtggactggatccccacctcccgcaccacgtggagcatccacgcccaccaccagtggatgaccaccgaggacatgctgtccgtctggaaccgcgtgtggatcgaggagaacccctggatggaggacaagacccacatcagctcctggggcgacgtgccgtacctcgggaagcgggaggaccagtggtgcggcagcctgatcggcctgacggcccgcgccacctgggcgaccaacatccaggtcgccatcaaccaggtgcggcgcctcatcgggaacgagaactacctggactacatgacctccatgaagcggttcaagaacgagagcgaccccgagggcgccctgtggtga

SEQ ID NO: 8487 - RNA, 9879 nt, synthetic construct
  misc_feature 1..9879: note = derived and/or modified CDS sequence (opt1) from DENV-1__GQ199777__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagacctccgcgggggtgaacatgtgcaccctcatcgccatggacctgggcgagctgtgcgaggacacgatgacctacaagtgcccccgcatcaccgagaccgagcccgacgacgtggactgctggtgcaacgccacggacacctgggtgacctacgggacctgcagccagacgggcgagcaccggcgcgacaagcggtccgtggccctcgcgccccacgtgggcctggggctggagacccgcaccgagacctggatgagctccgagggcgcgtggaagcagatccagcgggtcgagacgtgggccctccgccaccccgggttcaccgtgatcgccctgttcctggcccacgtgatcggcaccagcatcacccagaaggggatcatcttcatcctcctgatgctggtcacgccctccatggcgatgcggtgcgtgggcatcggcagccgcgacttcgtggaggggctctccggcgccacctgggtcgacgtggtgctggagcacgggagctgcgtcaccaccatggccaaggacaagcccacgctggacatcgagctcctgaagaccgaggtgaccaaccccgccgtgctgcggaagctctgcatcgaggccaagatctccaacaccacgaccgacagccgctgcccgacccagggcgaggcgaccctggtcgaggagcaggacgccaacttcgtgtgccggcgcacgttcgtggaccggggctgggggaacggctgcgggctgttcggcaaggggtccctcatcacgtgcgccaagttcaagtgcgtcaccaagctggagggcaagatcgtgcagtacgagaacctgaagtacagcgtgatcgtcaccgtgcacacgggcgaccagcaccaggtcgggaacgagtccaccgagcacggcaccaccgccaccatcacgccccaggcccccaccaccgagatccagctcaccgactacggggcgctgacgctggactgcagcccccgcaccggcctcgacttcaacgagatggtgctgctgaccatgaaggagaagtcctggctcgtgcacaagcagtggttcctggacctgcccctcccctggaccagcggggccagcacgtcccaggagacctggaaccggcaggacctgctggtcaccttcaagaccgcccacgccaagaagcaggaggtggtggtcctcggcagccaggagggcgccatgcacacggcgctgaccggggccaccgagatccagacctccggcacgaccaccatcttcgccgggcacctgaagtgccgcctcaagatggacaagctgaccctgaagggcatgagctacgtgatgtgcacggggctgttcaagctggagaaggaggtggccgagacccagcacggcaccgtcctggtgcagatcaagtacgagggcaccgacgccccctgcaagatccccttctccacgcaggacgagaagggggtgacccagaacggccggctgatcaccgcgaacccgatcgtcaccgacaaggagaagcccgtgaacatcgaggccgagccgcccttcggggagagctacatcatcatcggcgccggcgagaaggccctcaagctgtcctggttcaagaaggggagctccatcggcaagatgttcgaggcgacggcccgcggggcccggcgcatggccatcctgggcgacaccgcctgggacttcgggagcatcggcggcgtgttcacctccgtcgggaagctcgtgcaccagatcttcggcaccgcgtacggggtgctgttcagcggcgtctcctggacgatgaagatcgggatcggcgtgctgctcacctggctgggcctgaacagccgctccaccagcctctccatgacctgcatcgccgtggggctggtcacgctgtacctcggcgtgatggtgcaggccgacagcgggtgcgtcatcaactggaagggccgggagctgaagtgcgggtccggcatcttcgtgaccaacgaggtgcacacctggaccgagcagtacaagttccaggccgacagcccgaagcgcctgagcgccgcgatcggcaaggcctgggaggagggggtctgcggcatccggtccgccacccgcctcgagaacatcatgtggaagcagatcagcaacgagctgaaccacatcctgctcgagaacgacatgaagttcacggtggtggtcggggacgtggccggcatcctggcccaggggaagaagatgatccggccccagcccatggagtacaagtactcctggaagtcctggggcaaggcgaagatcatcggcgccgacgtgcagaacaccaccttcatcatcgacgggcccaacaccccggagtgccccgacgaccagcgcgcctggaacatctgggaggtcgaggactacggcttcgggatcttcacgaccaacatctggctgaagctccgggactcctacacccaggtgtgcgaccaccgcctgatgagcgccgcgatcaaggactccaaggccgtgcacgccgacatgggctactggatcgagagcgagaagaacgagacctggaagctggcccgggcctccttcatcgaggtcaagacgtgcatctggcccaagagccacaccctctggtccaacggcgtgctggagagcgagatgatcatccccaagatctacgggggcccgatctcccagcacaactaccgccccgggtacttcacccagaccgcgggcccctggcacctggggaagctcgagctggacttcgacctgtgcgagggcacgaccgtggtcgtggacgagcactgcggcaaccgggggccgagcctccgcaccaccacggtgaccggcaagatcatccacgagtggtgctgccggtcctgcaccctgccgcccctgcgcttccgcggggaggacggctgctggtacgggatggagatccgccccgtcaaggagaaggaggagaacctcgtcaagagcatggtgtccgccggcagcggcgaggtcgacagcttctccctggggctgctctgcatcagcatcatgatcgaggaggtgatgcggtcccgctggagccggaagatgctgatgaccggcacgctggccgtgttcttcctcctgatcatggggcagctgacctggaacgacctcatccgcctgtgcatcatggtcggcgccaacgcctccgaccgcatggggatgggcaccacctacctggcgctcatggccacgttcaagatgcggccgatgttcgccgtgggcctgctgttccgccggctcaccagccgcgaggtgctgctgctcaccatcgggctgtccctggtcgccagcgtggagctccccaactccctggaggagctgggcgacgggctcgccatgggcatcatgatcctgaagctgctcgcggacttccagagccaccagctgtgggccaccctgctctccctgacgttcatcaagaccaccttcagcctgcactacgcctggaagaccatggccatggtcctctccatcgtgagcctgttccccctgtgcctctccacgaccagccagaagaccacctggctgcccgtgctgctcggctccctggggtgcaagccgctgacgatgttcctcatcgcggagaacaagatctggggccggcgcagctggcccctgaacgaggggatcatggccgtcggcatcgtgtccatcctgctcagcagcctgctgaagaacgacgtgcccctcgccgggcccctgatcgccggcggcatgctgatcgcctgctacgtcatctccgggagctccgcggacctcagcctggagaaggccgccgaggtgtcctgggaggaggaggccgagcacagcggcgcctcccacaacatcctggtggaggtccaggacgacgggaccatgaagatcaaggacgaggagcgggacgacaccctcaccatcctgctgaaggcgaccctcctggccgtgagcggcgtgtacccgctgtccatccccgccaccctcttcgtctggtacttctggcagaagaagaagcagcgcagcggggtgctgtgggacacccccagcccgcccgaggtggagcgggccgtcctggacgacggcatctaccgcatcatgcagcggggcctgctcgggcgcagccaggtgggcgtgggggtcttccaggagaacgtgttccacaccatgtggcacgtgacccggggcgccgtcctgatgtaccaggggaagcgcctggagccctcctgggcgagcgtgaagaaggacctcatctcctacggcggcgggtggcggctgcagggcagctggaacacgggggaggaggtgcaggtcatcgccgtggagcccggcaagaaccccaagaacgtgcagaccgcccccgggaccttcaagacccccgagggcgaggtcggcgccatcgccctggacttcaagcccgggacgtccggcagccccatcgtgaaccgcgaggggaagatcgtgggcctctacggcaacggggtcgtgaccacctccggcacctacgtgagcgcgatcgcccaggccaaggccagccaggaggggccgctgcccgagatcgaggacgaggtcttccggaagcgcaacctgacgatcatggacctccaccccggctccgggaagacccggcgctacctgccggcgatcgtgcgggaggccatcaagcgccgcctgcggaccctcatcctggcccccacccgcgtggtcgccagcgagatggccgaggcgctgaagggcatgcccatccggtaccagacgaccgccgtgaagtccgagcacaccggcaaggagatcgtggacctcatgtgccacgccaccttcacgatgcgcctgctgagccccgtccgggtgccgaactacaacatgatcatcatggacgaggcccacttcaccgacccctccagcatcgccgcgcgcgggtacatctccacccgggtgggcatgggggaggccgccgccatcttcatgaccgccacgccgcccggcagcgtcgaggcgttcccgcagtccaacgccgtgatccaggacgaggagcgcgacatccccgagcggagctggaactccgggtacgagtggatcaccgacttccccggcaagaccgtgtggttcgtccccagcatcaagtccggcaacgacatcgccaactgcctccgcaagaacgggaagcgggtgatccagctgagccgcaagaccttcgacacggagtaccagaagaccaagaacaacgactgggactacgtggtcaccaccgacatctccgagatgggcgccaacttccgggcggaccgcgtgatcgacccgcggcgctgcctgaagcccgtgatcctcaaggacgggcccgagcgggtcatcctggccggccccatgccggtgacggtcgccagcgccgcccagcgccgggggcgcatcggccgcaaccacaacaaggagggcgaccagtacatctacatggggcagcccctgaacaacgacgaggaccacgcgcactggaccgaggccaagatgctcctggacaacatcaacacccccgagggcatcatccccgccctgttcgagccggagcgggagaagtccgccgccatcgacggggagtaccgcctccggggcgaggcgcgcaagaccttcgtggagctgatgcggcgcggggacctgcccgtgtggctcagctacaaggtcgcctccgagggcttccagtacagcgaccggcgctggtgcttcgacggcgagcggaacaaccaggtgctggaggagaacatggacgtggagatctggacgaaggagggggagcgcaagaagctgcggccccgctggctcgacgcccggacctacagcgaccccctggccctgcgcgagttcaaggagttcgccgcgggccggcgctccgtcagcggggacctcatcctggagatcggcaagctgccgcagcacctcacccagcgggcccagaacgccctggacaacctggtgatgctccacaactccgagcagggcgggcgcgcctaccggcacgcgatggaggagctgcccgacaccatcgagacgctgatgctcctggccctgatcgccgtgctcaccggcggggtcaccctgttcttcctgagcggccgcgggctcggcaagacctccatcggcctgctgtgcgtgatggccagctccgtgctcctgtggatggccagcgtcgagccccactggatcgcggcctccatcatcctggagttcttcctcatggtgctgctgatccccgagccggaccggcagcgcacgccccaggacaaccagctcgcctacgtggtcatcgggctgctgttcatgatcctcacggtggccgccaacgagatgggcctgctggagaccaccaagaaggacctcgggatcggccacgtggcggtcgagaaccaccaccacgccgccatgctggacgtggacctgcaccccgccagcgcctggaccctctacgcggtggccacgaccatcatcaccccgatgatgcgccacaccatcgagaacacgaccgccaacatctccctgaccgccatcgccaaccaggcggccatcctgatggggctcgacaagggctggcccatcagcaagatggacatcggcgtccccctgctggccctcgggtgctactcccaggtgaaccccctgaccctgacggccgcggtgctcatgctggtcgcccactacgccatcatcggcccggggctgcaggccaaggccacccgggaggcgcagaagcgcaccgccgccggcatcatgaagaaccccaccgtggacgggatcgtggccatcgacctcgaccccgtcgtgtacgacgccaagttcgagaagcagctgggccagatcatgctgctcatcctgtgcacgagccagatcctgctcatgcggaccacctgggcgctgtgcgagtccatcaccctggccacgggccccctcaccaccctgtgggaggggagcccgggcaagttctggaacaccacgatcgccgtgtccatggccaacatcttccgcgggagctacctggccggcgcgggcctcgccttctccctgatgaagtccctcgggggcgggcggcgcgggaccggggcccagggcgagaccctcggcgagaagtggaagcggcagctgaaccagctgagcaagtccgagttcaacacctacaagcgcagcgggatcatggaggtcgaccggtccgaggccaaggagggcctcaagcgcggggagacgaccaagcacgcggtgagccggggcaccgccaagctgcgctggttcgtggagcggaacctggtcaagcccgaggggaaggtgatcgacctgggctgcggccgcgggggctggtcctactactgcgccgggctcaagaaggtgaccgaggtcaagggctacacgaagggcgggcccggccacgaggagcccatcccgatggccacctacgggtggaacctggtgaagctgcacagcggcaaggacgtgttcttcatcccgcccgagaagtgcgacaccctcctgtgcgacatcggggagtccagccccaacccgaccatcgaggagggccggacgctgcgcgtcctcaagatggtggagccctggctgcgggggaaccagttctgcatcaagatcctgaacccctacatgccctccgtggtcgagaccctcgagcagatgcagcgcaagcacggcggcatgctggtgcggaacccgctgagccgcaactccacccacgagatgtactgggtgagctgcgggaccggcaacatcgtctccgccgtgaacatgaccagccgcatgctcctgaaccggttcacgatggcgcaccgcaagcccacctacgagcgggacgtggacctgggggccggcacccgccacgtcgccgtggagcccgaggtggccaacctcgacatcatcggccagcggatcgagaacatcaagcacgagcacaagtccacctggcactacgacgaggacaacccctacaagacgtgggcctaccacgggagctacgaggtcaagccgtccggcagcgcgtccagcatggtgaacggggtcgtgaagctgctgaccaagccctgggacgtgatccccatggtcacccagatcgccatgaccgacacgacccccttcggccagcagcgcgtgttcaaggagaaggtggacacccggaccccgaaggccaagcgcgggacggcccagatcatggaggtcaccgccaagtggctctggggcttcctgagccggaacaagaagccccgcatctgcacccgggaggagttcacccgcaaggtgcggtccaacgcggccatcggcgccgtgttcgtcgacgagaaccagtggaacagcgccaaggaggcggtggaggacgagcgcttctgggacctggtgcaccgggagcgcgagctccacaagcaggggaagtgcgccacgtgcgtctacaacatgatgggcaagcgggagaagaagctgggggagttcggcaaggccaaggggtcccgcgccatctggtacatgtggctgggcgcccggttcctcgagttcgaggcgctgggcttcatgaacgaggaccactggttcagccgcgagaactccctgagcggggtggagggcgaggggctccacaagctgggctacatcctgcgggacatctccaagatccccgggggcaacatgtacgccgacgacaccgccggctgggacacccgcatcaccgaggacgacctccagaacgaggcccgcatcacggacatcatggagccggagcacgccctgctggccaagagcatcttcaagctcacctaccagaacaaggtggtccgggtgcagcgccccgccaagaacgggaccgtgatggacgtcatctcccggcgcgaccagcggggcagcggccaggtggggacctacggcctgaacacgttcaccaacatggaggcccagctgatccgccagatggagtccgaggggatcttcagcccctccgagctcgagacccccaacctggccgagcgggtgctggactggctcgagaagtacggcgtcgagcgcctgaagcggatggccatcagcggggacgactgcgtggtgaagccgatcgacgaccgcttcgcgaccgccctgacggccctcaacgacatgggcaaggtccggaaggacatcccccagtgggagccctccaaggggtggaacgactggcagcaggtccccttctgcagccaccacttccaccagctgatcatgaaggacggccgcgagatcgtggtcccgtgccggaaccaggacgagctggtgggccgcgcccgggtgtcccagggggccggctggagcctccgcgagaccgcgtgcctgggcaagagctacgcccagatgtggcagctgatgtacttccaccggcgcgacctccggctggccgccaacgcgatctgctccgccgtccccgtggactggatccccaccagccgcaccacgtggtccatccacgcccaccaccagtggatgaccaccgaggacatgctgagcgtgtggaaccgcgtctggatcgaggagaacccctggatggaggacaagacccacatctccagctggggcgacgtgccgtacctcgggaagcgggaggaccagtggtgcggctccctgatcggcctgacggcccgcgccacctgggcgaccaacatccaggtggccatcaaccaggtccggcgcctcatcgggaacgagaactacctggactacatgaccagcatgaagcggttcaagaacgagtccgaccccgagggcgccctgtggtga

SEQ ID NO: 8488 - RNA, 9879 nt, synthetic construct
  misc_feature 1..9879: note = derived and/or modified CDS sequence (opt1) from DENV-1__GQ199778__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgagaccgagcccgacgacgtggactgctggtgcaacgccaccgacacctgggtcacctacgggacctgcagccagacgggcgagcaccggcgcgacaagcggtccgtggccctcgcgccccacgtgggcctggggctggagacccgcaccgagacctggatgagctccgagggcgcctggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggaggcctggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtgctgttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggccgactccgggtgcgtcatcaactggaagggccgggagctcaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctggagaacatcatgtggaagcagatctccaacgagctcaaccacatcctgctggagaacgacatgaagttcaccgtggtggtcggggacgtggcgggcatcctcgcccaggggaagaagatgatccggccccagcccatggagtacaagtacagctggaagtcctggggcaaggccaagatcatcggcgccgacgtgcagaacacgaccttcatcatcgacgggcccaacaccccggagtgccccgacgaccagcgcgcgtggaacatctgggaggtcgaggactacggcttcgggatcttcaccacgaacatctggctgaagctgcgggacagctacacccaggtgtgcgaccaccgcctcatgtccgccgccatcaaggacagcaaggccgtgcacgccgacatgggctactggatcgagtccgagaagaacgagacctggaagctggcgcgggccagcttcatcgaggtcaagacctgcatctggcccaagtcccacacgctgtggagcaacggcgtgctcgagtccgagatgatcatccccaagatctacgggggcccgatcagccagcacaactaccgccccgggtacttcacccaggccgccggcccctggcacctggggaagctggagctcgacttcgacctgtgcgagggcaccaccgtggtcgtggacgagcactgcggcaaccgggggccgtccctgcgcacgaccaccgtgaccggcaagatcatccacgagtggtgctgccggagctgcacgctgccgcccctccgcttccgcggggaggacggctgctggtacgggatggagatccgccccatcaaggagaaggaggagaacctggtcaagtccatggtgagcgccggcagcggcgaggtggactccttcagcctcgggctgctgtgcatctccatcatgatcgaggaggtcatgcggagccgctggtcccggcgcatgctcatgaccggcaccctggcggtgttcttcctgctcatcatggggcagctgacctggaacgacctgatccgcctctgcatcatggtgggcgccaacgccagcgaccggatggggatgggcacgacctacctggccctgatggccaccttcaagatgcgcccgatgttcgcggtcggcctcctgttccggcgcctgacctcccgggaggtgctcctgctgacgatcgggctcagcctggtggcctccgtcgagctgcccaacagcctcgaggagctgggcgacgggctggccatgggcatcatgatcctcaagctgctgaccgacttccagtcccaccagctctgggccaccctgctgagcctcaccttcatcaagacgaccttctccctgcactacgcgtggaagaccatggccatggtgctgagcatcgtctccctcttccccctgtgcctgagcaccacgtcccagaagaccacctggctccccgtgctgctgggcagcctcgggtgcaagccgctgaccatgttcctgatcgccgagaacaagatctggggccgccggtcctggcccctcaacgaggggatcatggccgtgggcatcgtcagcatcctgctgagctccctcctgaagaacgacgtgcccctggccgggcccctcatcgcgggcggcatgctgatcgcctgctacgtgatcagcgggtccagcgccgacctgtccctcgagaaggccgccgaggtcagctgggaggaggaggcggagcactccggcgccagccacaacatcctggtggaggtgcaggacgacgggacgatgaagatcaaggacgaggagcgcgacgacaccctgaccatcctcctgaaggccaccctgctcgccgtctccggcgtgtacccgctgagcatccccgccaccctgttcgtgtggtacttctggcagaagaagaagcagcggtccggggtcctctgggacacgcccagcccgcccgaggtggagcgcgcggtgctggacgacggcatctaccggatcatgcagcgcggcctgctggggcggtcccaggtcggcgtgggggtgttccaggagaacgtcttccacaccatgtggcacgtgacccgcggcgccgtgctcatgtaccaggggaagcggctggagcccagctgggcctccgtcaagaaggacctgatcagctacggcggcgggtggcgcctccagggctcctggaacaccggggaggaggtccaggtgatcgccgtcgagcccggcaagaaccccaagaacgtgcagacggcccccgggaccttcaagacccccgagggcgaggtgggcgcgatcgccctggacttcaagcccgggaccagcggctcccccatcgtcaaccgggaggggaagatcgtgggcctgtacggcaacggggtggtcacgaccagcggcacctacgtgagcgccatcgcccaggcgaaggcctcccaggaggggccgctccccgagatcgaggacgaggtgttccgcaagcggaacctgaccatcatggacctgcaccccggcagcgggaagacgcgccggtacctcccggccatcgtccgcgaggccatcaagcgcaagctgcggaccctgatcctcgcccccacccgcgtggtggcgtccgagatggccgaggccctgaagggcatgcccatccggtaccagaccacggccgtcaagagcgagcacaccggcaaggagatcgtggacctgatgtgccacgccaccttcaccatgcgcctcctgtcccccgtgcgggtcccgaactacaacatgatcatcatggacgaggcgcacttcacggaccccagctccatcgccgcccgcgggtacatcagcacccgggtgggcatgggggaggccgccgcgatcttcatgaccgccacgccgcccggctccgtggaggccttcccgcagagcaacgccgtcatccaggacgaggagcgcgacatccccgagcggtcctggaacagcgggtacgagtggatcacggacttccccggcaagaccgtgtggttcgtgccctccatcaagagcggcaacgacatcgcgaactgcctgcgcaagaacgggaagcgggtcatccagctctcccgcaagaccttcgacaccgagtaccagaagacgaagaacaacgactgggactacgtggtgaccaccgacatcagcgagatgggcgccaacttccgggccgaccgcgtcatcgacccgcggcgctgcctgaagcccgtgatcctgaaggacgggcccgagcgggtgatcctcgccggccccatgccggtcaccgtggcctccgcggcccagcgccgggggcgcatcggccgcaaccacaacaaggagggcgaccagtacatctacatggggcagcccctgaacaacgacgaggaccacgcccactggacggaggccaagatgctgctcgacaacatcaacacccccgagggcatcatccccgccctgttcgagccggagcgggagaagtccgcggccatcgacggggagtaccgcctgcggggcgaggcccgcaagaccttcgtcgagctcatgcggcgcggggacctgcccgtgtggctgtcctacaaggtggccagcgagggcttccagtacagcgaccggcgctggtgcttcgacggcgagcggaacaaccaggtcctcgaggagaacatggacgtggagatctggaccaaggagggggagcgcaagaagctgcggccccgctggctggacgcccggacgtactccgaccccctcgcgctgcgcgagttcaaggagttcgccgccggccggcgcagcgtgtccggggacctgatcctcgagatcggcaagctgccgcagcacctgacccagcgggcccagaacgcgctcgacaacctggtcatgctgcacaacagcgagcagggcgggcgcgcctaccggcacgccatggaggagctccccgacaccatcgagaccctgatgctgctcgccctgatcgccgtgctgacgggcggggtgaccctcttcttcctgtccggccgcgggctgggcaagaccagcatcggcctcctgtgcgtcatggcgtccagcgtgctgctctggatggcctccgtggagccccactggatcgccgccagcatcatcctggagttcttcctgatggtcctcctgatccccgagccggaccggcagcgcacgccccaggacaaccagctggcctacgtggtgatcgggctcctgttcatgatcctgaccgtcgcggccaacgagatgggcctcctggagacgaccaagaaggacctggggatcggccacgtggccgtggagaaccaccaccacgccgccatgctcgacgtcgacctgcaccccgcgtccgcctggaccctgtacgccgtggccaccacgatcatcaccccgatgatgcgccacaccatcgagaacaccacggccaacatcagcctcaccgcgatcgccaaccaggccgccatcctgatggggctggacaagggctggcccatctccaagatggacatcggcgtgcccctcctggcgctggggtgctacagccaggtcaaccccctcaccctgaccgccgccgtgctgatgctcgtggcccactacgccatcatcggcccggggctgcaggcgaaggccacgcgggaggcccagaagcgcaccgccgccggcatcatgaagaaccccaccgtcgacgggatcgtggcgatcgacctggaccccgtggtctacgacgccaagttcgagaagcagctcggccagatcatgctgctgatcctctgcacctcccagatcctgctgatgcggacgacctgggccctctgcgagagcatcaccctggccaccggccccctgacgaccctctgggaggggtccccgggcaagttctggaacaccaccatcgccgtgagcatggcgaacatcttccgcgggtcctacctggccggcgccggcctggccttcagcctcatgaagtccctcgggggcgggcggcgcgggacgggggcgcagggcgagaccctgggcgagaagtggaagcggcagctcaaccagctgtccaagagcgagttcaacacctacaagcgctccgggatcatggaggtggaccggagcgaggccaaggagggcctgaagcgcggggagaccacgaagcacgccgtctcccggggcaccgccaagctccgctggttcgtggagcggaacctggtgaagcccgaggggaaggtcatcgacctgggctgcggccgcgggggctggagctactactgcgccgggctgaagaaggtgaccgaggtgaagggctacaccaagggcggccccggccacgaggagcccatcccgatggcgacgtacgggtggaacctcgtcaagctgcactccggcaaggacgtgttcttcatcccgcccgagaagtgcgacaccctgctctgcgacatcggggagagctcccccaacccgaccatcgaggagggccggaccctgcgcgtgctgaagatggtcgagccctggctccgggggaaccagttctgcatcaagatcctgaacccctacatgcccagcgtggtggagacgctggagcagatgcagcgcaagcacggcggcatgctcgtccggaacccgctgtcccgcaacagcacccacgagatgtactgggtgtcctgcgggaccggcaacatcgtgagcgccgtcaacatgacctcccgcatgctgctcaaccggttcaccatggcccaccgcaagcccacgtacgagcgggacgtggacctgggggccggcacccgccacgtggccgtcgagcccgaggtggcgaacctggacatcatcggccagcggatcgagaacatcaagcacgagcacaagagcacctggcactacgacgaggacaacccctacaagacctgggcctaccacgggtcctacgaggtgaagccgagcggctccgccagcagcatggtcaacggggtggtcaagctcctgacgaagccctgggacgtgatccccatggtgacccagatcgccatgaccgacaccacgcccttcggccagcagcgcgtcttcaaggagaaggtggacacccggaccccgaaggccaagcgcgggaccgcgcagatcatggaggtgacggccaagtggctgtggggcttcctctcccggaacaagaagccccgcatctgcacccgggaggagttcacccgcaaggtccggagcaacgccgccatcggcgcggtgttcgtggacgagaaccagtggaactccgccaaggaggccgtcgaggacgagcgcttctgggacctggtgcaccgggagcgcgagctgcacaagcaggggaagtgcgcgacctgcgtgtacaacatgatgggcaagcgggagaagaagctcggggagttcggcaaggccaaggggagccgcgcgatctggtacatgtggctgggcgcccggttcctggagttcgaggccctcggcttcatgaacgaggaccactggttctcccgcgagaacagcctgtccggggtcgagggcgaggggctgcacaagctcggctacatcctgcgggacatcagcaagatccccgggggcaacatgtacgccgacgacacggccggctgggacacccgcatcaccgaggacgacctgcagaacgaggcgcgcatcaccgacatcatggagccggagcacgccctcctggccaagtccatcttcaagctgacgtaccagaacaaggtggtgcgggtccagcgccccgccaagaacgggaccgtgatggacgtgatcagccggcgcgaccagcggggctccgggcaggtcggcacctacggcctcaacaccttcacgaacatggaggcccagctgatccgccagatggagagcgaggggatcttctcccccagcgagctggagacccccaacctcgcggagcgggtgctggactggctggagaagtacggcgtggagcgcctcaagcggatggccatctccggggacgactgcgtcgtgaagccgatcgacgaccgcttcgccaccgccctgaccgccctgaacgacatgggcaaggtgcggaaggacatcccccagtgggagcccagcaaggggtggaacgactggcagcaggtccccttctgctcccaccacttccaccagctcatcatgaaggacggccgcgagatcgtggtgccgtgccggaaccaggacgagctggtcggccgcgcgcgggtgagccagggggccggctggagcctgcgcgagacggcctgcctcgggaagtcctacgcccagatgtggcagctgatgtacttccaccggcgcgacctgcggctcgcggccaacgccatctgcagcgccgtgcccgtcgactggatccccacctcccgcaccacctggagcatccacgcccaccaccagtggatgacgaccgaggacatgctgtccgtgtggaaccgcgtgtggatcgaggagaacccctggatggaggacaagacccacatcagctcctggggcgacgtcccgtacctggggaagcgggaggaccagtggtgcggcagcctcatcggcctgaccgcgcgcgccacgtgggccaccaacatccaggtggccatcaaccaggtgcggcgcctgatcgggaacgagaactacctcgactacatgacctccatgaagcggttcaagaacgagagcgaccccgagggcgccctgtggtga

SEQ ID NO: 8489 - RNA, 9879 nt, synthetic construct
  misc_feature 1..9879: note = derived and/or modified CDS sequence (opt1) from DENV-1__GQ199780__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagacctccgccggggtgaacatgtgcaccctcatcgccatggacctgggcgagttctgcgaggacaccatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtcgagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggaccagcggggcctccaccagccaggagacctggaaccggaaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctcgtccagatcaagtacgagggcaccgacgccccctgcaagatccccttctccacccaggacgagaagggggtgacccagaacggccggctgatcacggccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacaccgcctgggacttcgggagcatcggcggcgtgttcacgtccgtcgggaagctggtgcaccagatcttcggcaccgcctacggggtgctgttcagcggcgtctcctggaccatgaagatcgggatcggcgtgctcctgacctggctgggcctcaacagccgctccacgagcctgtccatgacctgcatcgccgtggggctggtcaccctctacctgggcgtgatggtgcaggccgacagcgggtgcgtcatcaactggaagggccgggagctgaagtgcgggagcggcatcttcgtgaccaacgaggtgcacacgtggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagttcaccgtggtggtcggggacgtggcgggcatcctggcccaggggaagaagatgatccggccccagcccatggagtacaagtactcctggaagtcctggggcaaggccaagatcatcggcgccgacgtgcagaacaccacgttcatcatcgacgggcccaacaccccggagtgccccgacgaccagcgcgcgtggaacatctgggaggtcgaggactacggcttcgggatcttcaccaccaacatctggctcaagctgcgggactcctacacccaggtgtgcgaccaccgcctgatgagcgccgccatcaaggactccaaggccgtgcacgccgacatgggctactggatcgagagcgagaagaacgagacctggaagctcgcgcgggcctccttcatcgaggtcaagacctgcatctggcccaagagccacaccctgtggtccaacggcgtgctggagagcgagatgatcatccccaagatctacgggggcccgatctcccagcacaactaccgccccgggtacttcacgcagaccgccggcccctggcacctcgggaagctggagctggacttcgacctctgcgagggcaccaccgtggtcgtggacgagcactgcggcaaccgggggccgagcctgcgcacgaccaccgtgaccggcaagatcatccacgagtggtgctgccggtcctgcacgctgccgcccctgcgcttcaagggggaggacggctgctggtacgggatggagatccggcccgtcaaggagaaggaggagaacctggtcaagagcatggtgagcgccggctccggcgaggtcgacagcttctccctggggctcctgtgcatcagcatcatgatcgaggaggtgatgcgctcccggtggagccgcaagatgctgatgaccggcaccctcgccgtgttcttcctgctgatcatggggcagctcacctggaacgacctgatccggctgtgcatcatggtcggcgcgaacgcctccgaccgcatggggatgggcacgacctacctcgccctgatggccaccttcaagatgcgcccgatgttcgccgtggggctcctgttccggcgcctgaccagccgggaggtgctgctcctgacgatcgggctgtccctcgtcgcgagcgtggagctgcccaactccctggaggagctcggcgacgggctggccatgggcatcatgatcctgaagctcctgaccgacttccagagccaccagctgtgggccaccctcctgtccctgaccttcatcaagacgaccttcagcctccactacgcctggaagaccatggcgatggtcctgtccatcgtgagcctgttccccctctgcctgtccaccacgagccagaagaccacctggctgcccgtgctcctgggctccctggggtgcaagccgctcaccatgttcctgatcgccgagaacaagatctggggccgcaagagctggcccctgaacgaggggatcatggccgtcggcatcgtgagcatcctcctgtccgccctgctcaagaacgacgtgcccctggccgggcccctgatcgcgggcggcatgctcatcgcctgctacgtcatcagcgggtccagcgccgacctgtccctggagaaggccgccgaggtgagctgggaggaggaggcggagcactccggcgccagccacaacatcctcgtggaggtccaggacgacgggacgatgaagatcaaggacgaggagcgggacgacaccctgaccatcctgctcaaggccaccctgctggccgtgtccggcgtgtacccgctcagcatccccgccaccctgttcgtctggtacttctggcagaagaagaagcagcgctccggggtgctgtgggacacgcccagcccgcccgaggtggagcgggcggtcctcgacgacggcatctaccgcatcatgcagcggggcctgctggggcgctcccaggtgggcgtgggggtcttccaggagaacgtgttccacaccatgtggcacgtgacccggggcgccgtcctgatgtaccaggggaagcgcctcgagcccagctgggcctccgtgaagaaggacctgatcagctacggcggcgggtggcggctgcagggctcctggaacaccggggaggaggtgcaggtcatcgccgtggagcccggcaagaaccccaagaacgtgcagacggcccccgggaccttcaagaccagcgagggcgaggtcggcgcgatcgccctcgacttcaagcccgggacctccggcagccccatcgtgaaccgcgaggggaagatcgtgggcctgtacggcaacggggtcgtgacgaccagcggcacctacgtgtccgccatcgcccaggcgaaggccagccaggaggggcccctgccggagatcgaggacgaggtcttccggaagcgcaacctcaccatcatggacctgcaccccggctccgggaagacgcggcgctacctgcccgccatcgtgcgggaggccatcaagcgcaagctccggaccctgatcctggccccgacccgcgtggtcgcgagcgagatggccgaggccctcaagggcatgcccatccgctaccagaccacggccgtgaagtccgagcacaccggcaaggagatcgtggacctgatgtgccacgccaccttcaccatgcggctgctcagccccgtccgcgtgcccaactacaacatgatcatcatggacgaggcgcacttcacggacccgtccagcatcgccgcccgggggtacatctccacccgcgtgggcatgggggaggccgccgcgatcttcatgaccgccacgccgcccggcagcgtcgaggccttcccccagtccaacgccgtgatccaggacgaggagcgggacatcccggagcgcagctggaactccgggtacgagtggatcacggacttccccggcaagaccgtgtggttcgtccccagcatcaagtccggcaacgacatcgcgaactgcctgcggaagaacgggaagcgcgtgatccagctgagccggaagaccttcgacaccgagtaccagaagacgaagaacaacgactgggactacgtggtcaccaccgacatctccgagatgggcgccaacttccgcgccgaccgggtgatcgacccccgccggtgcctcaagccggtgatcctgaaggacgggcccgagcgcgtcatcctggccggccccatgcccgtgaccgtcgccagcgcggcccagcggcgcgggcggatcggccgcaaccacaacaaggagggcgaccagtacatctacatggggcagccgctcaacaacgacgaggaccacgcccactggacggaggccaagatgctgctggacaacatcaacacccccgagggcatcatccccgccctcttcgagcccgagcgggagaagtccgcggccatcgacggggagtaccgcctgcgcggcgaggcccggaagaccttcgtggagctgatgcgccgcggggacctcccggtgtggctgagctacaaggtcgccagcgagggcttccagtactccgaccgccggtggtgcttcgacggcgagcgcaacaaccaggtgctggaggagaacatggacgtggagatctggaccaaggagggggagcggaagaagctccgcccccggtggctggacgcccgcacgtacagcgaccccctggcgctccgggagttcaaggagttcgccgccggccgccggtccgtcagcggggacctgatcctggagatcggcaagctcccccagcacctgacccagcgcgcccagaacgcgctggacaacctcgtgatgctgcacaactccgagcagggcgggcgggcctaccgccacgccatggaggagctgccggacaccatcgagaccctcatgctgctggccctcatcgccgtgctgacgggcggggtcaccctgttcttcctcagcggccgggggctgggcaagacctccatcggcctgctctgcgtgatggcgagctccgtgctgctgtggatggccagcgtcgagccccactggatcgccgcctccatcatcctcgagttcttcctgatggtgctgctcatccccgagcccgaccgccagcggaccccgcaggacaaccagctggcctacgtggtcatcgggctcctcttcatgatcctgaccgtggcggccaacgagatgggcctgctcgagacgaccaagaaggacctggggatcggccacgtggccgtcgagaaccaccaccacgccgccatgctggacgtggacctccaccccgcgagcgcctggaccctgtacgccgtggccaccacgatcatcacccccatgatgcgccacaccatcgagaacaccacggccaacatctccctgaccgcgatcgccaaccaggccgccatcctcatggggctggacaagggctggccgatcagcaagatggacatcggcgtccccctgctcgcgctggggtgctactcccaggtgaaccccctgaccctcaccgccgccgtgctgatgctggtcgcccactacgccatcatcggccccgggctccaggcgaaggccacgcgggaggcccagaagcgcaccgccgccggcatcatgaagaacccgaccgtggacgggatcgtggcgatcgacctggaccccgtcgtgtacgacgccaagttcgagaagcagctgggccagatcatgctcctgatcctgtgcaccagccagatcctcctgatgcgcacgacctgggccctgtgcgagtccatcaccctcgccaccggccccctgacgaccctgtgggaggggagccccggcaagttctggaacaccaccatcgccgtgtccatggcgaacatcttccgggggagctacctcgccggcgccggcctggccttcagcctgatgaagtccctcgggggcgggcgccggggcacgggggcgcagggcgagaccctgggcgagaagtggaagcgccagctgaaccagctcagcaagtccgagttcaacacctacaagcggagcgggatcatggaggtcgaccgctccgaggccaaggagggcctgaagcgcggggagaccacgaagcacgccgtgagccgcggcaccgccaagctgcggtggttcgtggagcgcaacctcgtcaagccggaggggaaggtgatcgacctgggctgcggccgcggcgggtggtcctactactgcgccgggctgaagaaggtgaccgaggtcaaggggtacaccaagggcgggcccggccacgaggagcccatccccatggcgacgtacgggtggaacctggtgaagctccacagcggcaaggacgtgttcttcatcccgcccgagaagtgcgacaccctgctgtgcgacatcggggagtccagccccaaccccaccatcgaggagggccgcaccctccgggtcctgaagatggtggagccgtggctgcgcgggaaccagttctgcatcaagatcctcaacccctacatgccctccgtggtcgagacgctggagcagatgcagcggaagcacggcggcatgctggtgcgcaaccccctcagccggaactccacccacgagatgtactgggtgagctgcgggaccggcaacatcgtctccgccgtgaacatgaccagccgcatgctgctgaaccggttcaccatggcccaccgcaagccgacgtacgagcgcgacgtggacctcggggccggcacccggcacgtcgccgtggagcccgaggtggcgaacctggacatcatcggccagcgcatcgagaacatcaagcacgagcacaagtccacctggcactacgacgaggacaacccctacaagacctgggcctaccacgggagctacgaggtcaagccctccggcagcgccagctccatggtgaacggggtcgtgaagctgctcacgaagccgtgggacgtgatccccatggtcacccagatcgccatgaccgacaccacgcccttcggccagcagcgggtgttcaaggagaaggtggacacccgcacccccaaggccaagcgggggaccgcgcagatcatggaggtcacggccaagtggctgtggggcttcctgagccgcaacaagaagccgcggatctgcacccgcgaggagttcacccggaaggtgcgctccaacgccgccatcggcgcggtgttcgtcgacgagaaccagtggaacagcgccaaggaggccgtggaggacgagcggttctgggacctcgtgcaccgcgagcgggagctgcacaagcaggggaagtgcgcgacctgcgtctacaacatgatgggcaagcgcgagaagaagctgggggagttcggcaaggccaaggggtcccgggcgatctggtacatgtggctcggcgcccgcttcctggagttcgaggccctgggcttcatgaacgaggaccactggttcagccgggagaactccctcagcggggtggagggcgaggggctgcacaagctgggctacatcctccgcgacatctccaagatccccgggggcaacatgtacgccgacgacacggccggctgggacacccggatcaccgaggacgacctgcagaacgaggcgaagatcaccgacatcatggagcccgagcacgccctgctcgccaagagcatcttcaagctgacgtaccagaacaaggtggtccgcgtgcagcggccggccaagaacgggaccgtgatggacgtcatctcccgccgcgaccagcggggcagcggccaggtgggcacctacggcctgaacaccttcacgaacatggaggcccagctcatccgccagatggagtccgaggggatcttcagcccctccgagctggagacccccaacctggcgggccgggtgctcgactggctggagaagcacggggtcgagcgcctgaagcggatggccatcagcggcgacgactgcgtggtgaagcccatcgacgaccgcttcgccaccgccctcaccgccctgaacgacatggggaaggtccggaaggacgtgccgcagtgggagccctccaagggctggaacgactggcagcaggtccccttctgcagccaccacttccaccagctgatcatgaaggacggccgcgagatcgtcgtgccctgccggaaccaggacgagctcgtggggcgcgcgcgggtcagccagggcgccgggtggtccctgcgcgagacggcctgcctgggcaagagctacgcccagatgtggcagctcatgtacttccaccggcgcgacctgcggctggcggccaacgccatctgctccgccgtgccggtggactgggtccccaccagccgcaccacctggtccatccacgcccaccaccagtggatgacgaccgaggacatgctcagcgtgtggaaccgggtgtggatcgaggagaacccctggatggaggacaagacccacatctccagctggggcgacgtcccctacctgggcaagcgcgaggaccagtggtgcggctccctgatcgggctcaccgcgcgggccacgtgggccaccaacatccaggtggccatcaaccaggtgcgccgcctgatcggcaacgagaactacctggactacatgaccagcatgaagcggttcaagaacgagtccgacccggagggggccctctggtga

SEQ ID NO: 8490 - RNA, 9879 nt, synthetic construct
  misc_feature 1..9879: note = derived and/or modified CDS sequence (opt1) from DENV-1__GQ199781__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgcgggggtgaacatgtgcaccctcatcgccatggacctgggggagctgtgcgaggacaccatgacctacaagtgcccccggatcaccgaggccgagcccgacgacgtggactgctggtgcaacgccacggacacctgggtgacctacgggacctgcagccagacgggggagcaccggcgcgacaagcggagcgtggccctcgcgccccacgtgggcctggggctggagacccgcaccgagacctggatgtccagcgagggcgcctggaagcagatccagcgggtggagacgtgggccctccgccaccccgggttcaccgtgatcgccctgttcctggcccacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcatccagaacggccggctgatcacggccaacccgatcgtgaccgacaaggagaagcccgtgaacatcgaggccgagccgcccttcggggagtcctacatcgtcatcggcgtgggcgagaaggcgctgaagctcagctggttcaagaaggggtccagcatcggcaagatgttcgaggccaccgcccgcggggcccggcgcatggccatcctgggcgacaccgcgtgggacttcgggtccatcggcggcgtgttcacgagcgtcgggaagctggtgcaccagatcttcggcaccgcctacggggtcctgttctccggcgtcagctggaccatgaagatcgggatcggcgtgctgctgacctggctcggcctgaactcccgcagcacgtccctgagcatgacctgcatcgccgtggggctcgtcaccctgtacctgggcgtgatggtgcaggccgactccgggtgcgtcatcaactggaagggccgggagctcaagtgcgggagcggcatcttcgtgaccaacgaggtgcacacgtggaccgagcagtacaagttccaggccgacagcccgaagcgcctgtccgcggccatcggcaaggcctgggaggagggggtctgcggcatccggagcgccacccgcctggagaacatcatgtggaagcagatctccaacgagctcaaccacatcctgctggagaacgacatgaagttcaccgtggtggtcggggacgtggtgggcatcctcgcccaggggaagaagatgatccggccccagcccatggagcacaagtacagctggaagtcctggggcaaggcgaagatcatcggcgccgacgcccagaacaccacgttcatcatcgacgggcccaacaccccggagtgccccgacgaccagcgcgcctggaacatctgggaggtcgaggactacggcttcgggatcttcaccaccaacatctggctgaagctgcgggacagctacacgcaggcgtgcgaccaccgcctcatgtccgccgccatcaaggacagcaaggccgtgcacgccgacatgggctactggatcgagtccgagaagaacgagacctggaagctggcgcgggccagcttcatcgaggtgaagacctgcatctggcccaagtcccacaccctgtggagcaacggcgtcctcgagtccgagatggtgatccccaagatctacgggggcccgatcagccagcacaactaccgccccgggtacttcacgcagaccgccggcccctggcacctggggaagctggagctcgacttcgacctgtgcgagggcaccaccgtggtcgtggacgagcactgcggcaaccgggggccgtccctgcgcacgaccaccgtgaccggcaagatcatccacgagtggtgctgccggagctgcacgctgccgcccctccgcttcaagggggaggacggctgctggtacgggatggagatccggcccgtcaaggagaaggaggagaacctggtgaagtccatggtgagcgccggcagcggcgaggtcgactccttcagcctcgggctgctgtgcatctccatcatgatcgaggaggtgatgcgcagccggtggtcccgcaagatgctcatgaccggcaccctggccgtgttcctgctcctgatcatggggcagctgacctggaacgacctcatccggctgtgcatcatggtcggcgcgaacgccagcgaccgcatggggatgggcacgacctacctggccctcatggccaccttcaagatgcgcccgatgttcgccgtgggcctgctgttccggcgcctcacctcccgggaggtgctgctgctcacgatcgggctgagcctggtcgcgtccgtggagctccccaacagcctggaggagctgggcgacgggctcgccatgggcatcatgatcctgaagctgctcaccgacttccagtcccaccagctgtgggccaccctgctcagcctgaccttcatcaagacgaccctgtccctccactacgcctggaagaccatggcgatggtcctgagcatcgtgtccctgttccccctctgcctgagcaccacgtcccagaagaccacctggctgcccgtgctcctgggcagcctggggtgcaagccgctcaccatgttcctgatcgccgagaacaagatctggggccgcaagtcctggcccctgaacgaggggatcatggccgtcggcgtggtgagcatcctcctgagctccctgctcaagaacgacgtccccctggccgggcccctgatcgccggcggcatgctcatcgcgtgctacgtgatcagcgggtccagcgccgacctgtccctggagaaggccgccgaggtgagctgggaggaggaggccgagcactccggcgcgagccacaacatcctcgtcgaggtgcaggacgacgggacgatgaagatcaaggacgaggagcgggacgacaccctgaccatcctgctcaaggccaccctgctggccgtgtccggcgtctacccgctcagcatccccgccaccctgttcgtgtggtacttctggcagaagaagaagcagcgctccggggtgctgtgggacacgcccagcccgcccgaggtcgagcgggccgtgctggacgacggcatctaccgcatcatgcagcggggcctcctggggcgctcccaggtgggcgtcggggtgttccaggagaacgtgttccacaccatgtggcacgtcacccggggcgcggtgctgatgtaccaggggaagcgcctcgagcccagctgggcctccgtgaagaaggacctgatcagctacggcggcgggtggcggctgcagggctcctggaacaccggggaggaggtccaggtgatcgccgtggagcccggcaagaaccccaagaacgtccagacggcccccgggaccttcaagacccccgagggcgaggtgggcgccatcgcgctcgacttcaagcccgggaccagcggctcccccatcgtgaaccgcgaggggaagatcgtcggcctgtacggcaacggggtggtgacgaccagcggcacctacgtcagcgccatcgcccagaccaaggcctcccaggaggggccgctgcccgagatcgaggacgaggtgttccggaagcgcaacctcacgatcatggacctgcaccccggcagcgggaagacccggcgctacctgccggcgatcatccgggaggccatcaagcgcaagctccggaccctgatcctggcccccacccgcgtggtcgcctccgagatggccgaggcgctcaagggcatgcccatccgctaccagacgaccgccgtcaagagcgagcacaccggcaaggagatcgtggacctgatgtgccacgccaccttcacgatgcggctgctctcccccgtccgcgtgccgaactacaacatgatcatcatggacgaggcccacttcaccgaccccagctccatcgccgcgcgggggtacatcagcacccgcgtgggcatgggggaggccgccgccatcttcatgaccgccacgccgcccggctccgtcgaggcgttcccgcagagcaacgccgtgatccaggacgaggagcgggacatccccgagcgctcctggaacagcgggtacgagtggatcaccgacttccccggcaagaccgtgtggttcgtcccctccatcaagagcggcaacgacatcgccaactgcctgcggaagaacgggaagcgcgtgatccagctgtcccggaagaccttcgacacggagtaccagaagaccaagaacaacgactgggactacgtggtcaccaccgacatcagcgagatgggcgccaacttccgcgcggaccgggtgatcgacccgcgccggtgcctcaagcccgtgatcctgaaggacgggcccgagcgcgtcatcctggccggccccatgccggtgacggtcgcctccgccgcccagcggcgcgggcggatcggccgcaaccacaacaaggagggcgaccagtacatctacatggggcagcccctcaacaacgacgaggaccacgcgcactggaccgaggccaagatgctgctggacaacatcaacacccccgagggcatcatccccgccctcttcgagccggagcgggagaagtccgccgccatcgacggggagtaccgcctgcgcggcgaggcgcggaagaccttcgtggagctgatgcgccgcggggacctccccgtgtggctgtcctacaaggtcgccagcgagggcttccagtacagcgaccgccggtggtgcttcgacggcgagcgcaacaaccaggtgctggaggagaacatggacgtggagatctggacgaaggagggggagcggaagaagctccgcccccggtggctggacgcccgcacctactccgaccccctggccctccgggagttcaaggagttcgccgcgggccgccggagcgtctccggggacctgatcctggagatcggcaagctcccgcagcacctgacccagcgcgcccagaacgccctggacaacctcgtgatgctgcacaacagcgagcagggcgggcgggcctaccgccacgcgatggaggagctgcccgacaccatcgagacgctcatgctgctggccctcatcgccgtgctgaccggcggggtcaccctgttcttcctctccggccgggggctgggcaagaccagcatcggcctgctctgcgtgatggcctccagcgtgctgctgtggatggcctccgtcgagccccactggatcgcggccagcatcatcctcgagttcttcctgatggtgctgctcatccccgagccggaccgccagcggacgccccaggacaaccagctggcctacgtggtcatcgggctcctcttcatgatcctgacggtggccgccaacgagatgggcctgctcgagaccaccaagaaggacctggggatcggccacgtggcggtcgagaaccaccaccacgccaccatgctggacgtggacctccaccccgcctccgcctggacgctgtacgccgtggcgaccaccatcatcaccccgatgatgcgccacacgatcgagaacaccaccgccaacatcagcctgaccgccatcgccaaccaggccgcgatcctcatggggctggacaagggctggcccatctccaagatggacatcggcgtccccctgctcgccctggggtgctacagccaggtgaaccccctgacgctcaccgccgccgtgctgatgctggtcgcgcactacgccatcatcggcccggggctccaggccaaggccacccgggaggcccagaagcgcaccgcggccggcatcatgaagaaccccacggtggacgggatcgtggccatcgacctggaccccgtcgtgtacgacgccaagttcgagaagcagctgggccagatcatgctcctgatcctgtgcacctcccagatcctcctgatgcgcaccacctgggccctgtgcgagagcatcacgctcgcgaccggccccctgaccaccctgtgggaggggtccccgggcaagttctggaacacgaccatcgccgtgagcatggccaacatcttccgggggtcctacctcgccggcgccggcctggcgttcagcctgatgaagtccctcgggggcgggcgccggggcaccggggcccagggcgagaccctgggcgagaagtggaagcgccagctgaaccagctctccaagagcgagttcaacatctacaagcggtccgggatcatggaggtcgaccgcagcgaggccaaggagggcctgaagcgcggggagacgacccgccacgccgtgtcccggggcaccgcgaagctgcgctggttcgtggagcggaacctggtcaagcccgaggggaaggtgatcgacctcggctgcggccgcgggggctggagctactactgcgccgggctgaagaaggtgaccgaggtcaagggctacacgaagggcgggcccggccacgaggagcccatcccgatggccacctacgggtggaacctggtgaagctccactccggcaaggacgtgttcttcgcgccgcccgagaagtgcgacaccctgctgtgcgacatcggggagagctcccccaacccgaccatcgaggagggccggacgctccgcgtcctgaagatggtggagccctggctgcgggggaaccagttctgcatcaagatcctcaacccctacatgcccagcgtggtcgagaccctggagcagatgcagcgcaagcacggcggcatgctggtgcggaacccgctctcccgcaacagcacccacgagatgtactgggtgtcctgcgggaccggcaacatcgtcagcgccgtgaacatgacctcccggatgctgctgaaccgcttcacgatggcgcaccgcaagcccacctacgagcgggacgtggacctcggggccggcacccgccacgtcgccgtggagcccgaggtggccaacctggacatcatcggccagcggatcgagaacatcaagcacgagcacaagagcacctggcactacgacgaggacaacccctacaagacgtgggcctaccacgggtcctacgaggtcaagccgagcggctccgcgagcagcatggtgaacggggtcgtgaagctgctcaccaagccctgggacgtgatccccatggtcacccagatcgccatgaccgacacgacccccttcggccagcagcgcgtgttcaaggagaaggtggacacccggaccccgaaggcccgccgggggacggcccagatcatggaggtcaccgcccgctggctgtggggcttcctgtcccggaacaagaagccccgcatctgcacccgggaggagttcacccgcaaggtgcggagcaacgcggccatcggcgccgtgttcgtcgacgagaaccagtggaactccgccaaggaggcggtggaggacgagcgcttctgggacctcgtgcagaaggagcgggagctgcacaagcaggggaagtgcgccacgtgcgtctacaacatgatgggcaagcgcgagaagaagctgggggagttcggcaaggccaaggggagccgggccatctggtacatgtggctcggcgcccgcttcctggagttcgaggcgctgggcttcatgaacgaggaccactggttctcccgggagaacagcctctccggggtggagggcgaggggctgcacaagctgggctacatcctccgcgacatcagcaagatccccgggggcaacatgtacgccgacgacaccgccggctgggacacccggatcaccgaggacgacctgcagaacgaggccaagatcacggacatcatggagccggagcacgccctgctcgcgacctccatcttcaagctgacctaccagaacaaggtggtccgcgtgcagcgccccgccaagaacgggaccgtgatggacgtcatcagccggcgcgaccagcggggctccggccaggtgggcacgtacggcctgaacaccttcaccaacatggaggcccagctcatccgccagatggagagcgaggggatcttcctgccctccgagctggagacccccaacctcgccgagcgggtgctggactggctggagaagcacggcgtcgagcgcctcaagcggatggccatcagcggggacgactgcgtggtgaagccgatcgacgaccgcttcgcgacggccctgaccgccctgaacgacatgggcaaggtccggaaggacatcccccagtgggagccctccaaggggtggaacgactggcagcaggtccccttctgcagccaccacttccaccagctcatcatgaaggacggccgcgagatcgtggtcccgtgccggaaccaggacgagctggtgggccgcgcccgggtgtcccagggggccggctggagcctgcgcgagaccgcgtgcctcggcaagagctacgcccagatgtggcagctgatgtacttccaccggcgcgacctgcggctcgccgccaacgcgatctgctccgccgtccccgtggactgggtgcccaccagccgcacgacctggtccatccacgcccaccaccagtggatgaccaccgaggacatgctgagcgtctggaaccgggtgtggatcgaggagaacccctggatggaggacaagacgcacgtgtccagctggggcgacgtcccgtacctggggaagcgcgaggaccagtggtgcggctccctcatcggcctgaccgcccgcgccacctgggcgagcaacatccaggtggccatcaaccaggtgcggcgcctgatcgggaacgagaactacctcgactacatgacctccatgaagcggttcaagaacgagggcgaccccgagggggccctgtggtga

SEQ ID NO: 8491 - RNA, 9879 nt, synthetic construct
  misc_feature 1..9879: note = derived and/or modified CDS sequence (opt1) from DENV-1__GQ199782__SS-prME
  source 1..9879: mol_type = other RNA
agcgtgaccatgctgctcatgctgatgcccaccgccctggccttccacctcaccacccgcggcggggagccccacatgatcgtgaccaagcaggagcggggcaagagcctgctgttcaagaccagcgccggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtgacctacgggacctgcagccagacgggcgagcaccggcgcgacaagcggagcgtggccctcgcgccccacgtgggcctggggctggagacccgcaccgagacctggatgtccagcgagggcgcctggaagcagatccagcgggtggagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccgtgggcggcgtgttcaccagcgtcgggaagctggtgcaccagatcttcggcaccgcctacggggtcctgttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggccgactccgggtgcgtcatcaactggaagggccgggagctcaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctggagaacatcatgtggaagcagatctccaacgagctcaaccacatcctgctggagaacgacatgaagttcaccgtggtggtcggggacgtggtgggcatcctcgcgcaggggaagaagatgatccggccccagcccatggagcacaagtacagctggaagtcctggggcaaggccaagatcatcggcgccgacatccagaacacgaccttcatcatcgacgggcccaacaccccggagtgccccgacgaccagcgcgcctggaacatctgggaggtcgaggactacggcttcgggatcttcaccacgaacatctggctgcggctgcgcgacagctacacccaggtgtgcgaccaccggctcatgtccgcggccatcaaggacagcaaggccgtgcacgccgacatgggctactggatcgagtccgagaagaacgagacctggaagctggcccgcgcgagcttcatcgaggtcaagacctgcatctggcccaagtcccacacgctgtggagcaacggcgtgctcgagtccgagatgatcatccccaagatctacgggggcccgatcagccagcacaactaccggcccgggtacttcacccagaccgccggcccctggcacctggggaagctggagctcgacttcgacctgtgcgagggcaccacggtggtcgtggacgagcactgcggcaaccgcgggccgtccctgcggaccaccaccgtgacgggcaagatcatccacgagtggtgctgccgcagctgcaccctgccgcccctccggttcaagggggaggacggctgctggtacgggatggagatccgccccgtcaaggagaaggaggagaacctggtgaagtccatggtgagcgccggcagcggcgaggtcgactccttcagcctcgggctgctgtgcatctccatcatggtggaggaggtgatgcggagccgctggtcccggaagatgctcatgaccggcaccctggccgtcttcctgctcctgatcatggggcagctgacgtggaacgacctcatccgcctgtgcatcatggtgggcgccaacgcgagcgaccgcatggggatgggcaccacctacctggccctcatggccaccttcaagatccggccgatgttcgccgtggggctgctggtccgccggctcacgtcccgcgaggtgctgctgctcaccatcgggctgagcctggtcgcctccgtggagctccccaacagcctggaggagctgggcgacgggctcgcgatgggcatcatgatcctgaagctgctcaccgacttccagtcccaccagctgtgggccaccctgctcagcctgacgttcatcaagaccaccctgtccctccactacgcctggaagaccatggccatggtgctgagcatcgtctccctgttccccctctgcctgagcacgacctcccagaagaccacctggctgcccgtgctcctgggcagcctggggtgcaagccgctcacgatgttcctgatcaccgagaacaagatctggggccggaagtcctggcccctgaacgaggggatcatggcggtgggcgtcgtgagcatcctcctgagctccctgctcaagaacgacgtgcccctggccgggcccctgatcgccggcggcatgctcatcgcctgctacgtcatcagcgggtccagcgccgacctgtccctggagaaggcggccgaggtgagctgggaggaggaggccgagcactccggcgccagccacaacatcctcgtggaggtccaggacgacgggaccatgaagatcaaggacgaggagcgcgacgacaccctgaccatcctgctcaaggccacgctgctggcggtgtccggcgtgtacccgctcagcatccccgccaccctgttcgtctggtacttctggcagaagaagaagcagcggtccggggtgctgtgggacacccccagcccgcccgaggtggagcgcgccgtcctggacgacggcatctaccggatcatgcagcgcggcctcctggggcggtcccaggtgggcgtgggggtcttccaggagaacgtgttccacaccatgtggcacgtgacgcgcggcgccgtcctgatgtaccaggggaagcggctcgagcccagctgggcctccgtgaagaaggacctgatcagctacggcggcgggtggcgcctgcagggctcctggaacaccggggaggaggtgcaggtcatcgcggtggagcccggcaagaaccccaagaacgtgcagaccgcccccgggaccttcaagacgcccgagggcgaggtcggcgccatcgccctcgacttcaagcccgggaccagcggctcccccatcgtgaaccgggaggggaagatcgtgggcctgtacggcaacggggtcgtgaccaccagcggcacgtacgtgagcgccatcgcgcaggccaaggcctcccaggaggggccgctgcccgagatcgaggacgaggtcttccgcaagcggaacctcaccatcatggacctgcaccccggcagcgggaagacccgccggtacctgccggccatcgtgcgcgaggcgatcaagcggaagctccgcaccctgatcctggcccccacgcgcgtggtcgcctccgagatggccgaggccctcaagggcatgcccatccggtaccagaccaccgcggtcaagagcgagcacaccggcaaggagatcgtggacctgatgtgccacgccacgttcaccatgcgcctgctctcccccgtccgggtgccgaactacaacatgatcatcatggacgaggcccacttcaccgaccccagctccatcgccgcccgcgggtacatcagcacccgggtgggcatgggggaggcggccgccatcttcatgacggccacgccgcccggctccgtcgaggccttcccgcagagcaacgcggtgatccaggacgaggagcgcgacatccccgagcggtcctggaacagcgggtacgagtggatcaccgacttccccggcaagaccgtgtggttcgtcccctccatcaagagcggcaacgacatcgccaactgcctgcgcaagaacgggaagcgggtgatccagctgtcccgcaagacgttcgacaccgagtaccagaagaccaagaacaacgactgggactacgtggtcaccacggacatcagcgagatgggcgccaacttccgggccgaccgcgtgatcgacccgcggcgctgcctcaagcccgtcatcctgaaggacgggcccgagcgggtgatcctggcgggccccatgccggtgaccgtcgcctccgccgcccagcgccgggggcgcatcggccggaaccacaacaaggagggcgaccagtacatctacatggggcagcccctcaacaacgacgaggaccacgcccactggaccgaggcgaagatgctgctggacaacatcaacacccccgagggcatcatccccgccctcttcgagccggagcgcgagaagtccgccgccatcgacggggagtaccgcctgcggggcgaggcccgcaagacgttcgtggagctgatgcggcgcggggacctccccgtgtggctgtcctacaaggtcgcgagcgagggcttccagtacagcgaccggcgctggtgcttcgacggcgagcggaacaaccaggtgctggaggagaacatggacgtggagatctggaccaaggagggggagcgcaagaagctccggccccgctggctggacgcccggacctactccgaccccctggccctccgcgagttcaaggagttcgccgccggccggcgcagcgtctccggggacctgatcctggagatcggcaagctcccgcagcacctgacccagcgggcgcagaacgccctggacaacctcgtgatgctgcacaacagcgagcagggcgggcgcgcctaccggcacgccatggaggagctgcccgacacgatcgagaccctcatgctgctggcgctcatcgccgtgctgaccggcggggtcaccctgttcttcctctccggccgcgggctgggcaagaccagcatcggcctgctctgcgtgatggcctccagcgtgctgctgtggatggcctccgtcgagccccactggatcgccgcgagcatcatcctcgagttcttcctgatggtgctgctcatccccgagccggaccggcagcgcacgccccaggacaaccagctggcctacgtggtcatcgggctcctcttcatgatcctgaccgtggccgccaacgagatgggcctgctcgagaccaccaagaaggacctggggatcggccacgtggccgtcgagaaccaccaccacgcgacgatgctggacgtggacctccaccccgcctccgcctggaccctgtacgccgtggccaccaccatcatcacgccgatgatgcggcacaccatcgagaacaccaccgcgaacatcagcctgacggccatcgccaaccaggccgccatcctcatggggctggacaagggctggcccatctccaagatggacatcggcgtccccctgctcgcgctggggtgctacagccaggtgaaccccctgaccctcaccgccgccgtgctgatgctggtcgcccactacgcgatcatcggcccggggctccaggccaaggccacccgcgaggcccagaagcgcacggccgcgggcatcatgaagaaccccaccgtggacgggatcgtggccatcgacctggaccccgtcgtgtacgacgccaagttcgagaagcagctgggccagatcatgctcctgatcctgtgcacctcccagatcctcctgatgcggaccacgtgggccctgtgcgagagcatcaccctcgccaccggccccctgaccacgctgtgggaggggtccccgggcaagttctggaacaccaccatcgcggtgagcatggccaacatcttccgcgggtcctacctcgccggcgccggcctggccttcagcctgatgaagtccctcgggggcgggcggcgcggcaccggggcgcagggcgagacgctgggcgagaagtggaagcggcagctgaaccagctctccaagagcgagttcaacatctacaagcgctccgggatcatggaggtcgaccggagcgaggccaaggagggcctgaagcgcggggagaccacccggcacgccgtgtcccgcggcaccgccaagctgcggtggttcgtggagcgcaacctggtcaagcccgaggggaaggtgatcgacctcggctgcggccgcggcgggtggagctactactgcgcggggctgaagaaggtgacggaggtcaaggggtacaccaagggcgggcccggccacgaggagcccatcccgatggccacctacgggtggaacctggtgaagctccactccggcaaggacgtgttcttcacgccgcccgagaagtgcgacacgctgctgtgcgacatcggggagagctcccccaacccgaccatcgaggagggccgcaccctccgggtcctgaagatggtggagccctggctgcgcgggaaccagttctgcatcaagatcctcaacccctacatgcccagcgtggtcgagaccctggagcagatgcagcggaagcacggcggcatgctggtgcgcaacccgctctcccggaacagcacccacgagatgtactgggtgtcctgcgggacgggcaacatcgtcagcgccgtgaacatgacctcccgcatgctgctgaaccgcttcaccatggcccaccggaagcccacctacgagcgcgacgtggacctcggggccggcacgcggcacgtcgcggtggagcccgaggtcgccaacctggacatcatcggccagcgcatcgagaacatgaagcacgagcacaagagcacctggcactacgacgaggacaacccctacaagacctgggcctaccacgggtcctacgaggtgaagccgagcggctccgccagcagcatggtgaacggggtcgtgaagctgctcaccaagccctgggacgtgatccccatggtcacgcagatcgccatgaccgacaccacccccttcggccagcagcgggtgttcaaggagaaggtggacacgcgcaccccgaaggcgaagcgggggaccgcccagatcatggaggtcaccgcccgctggctgtggggcttcctgtcccggaacaagaagccccgcatctgcacgcgggaggagttcacccgcaaggtgcggagcaacgccgccatcggcgcggtgttcgtcgacgagaaccagtggaactccgccaaggaggccgtggaggacgagcgcttctgggacctcgtgcagaaggagcgggagctgcacaagcaggggaagtgcgcgacctgcgtctacaacatgatgggcaagcgcgagaagaagctgggggagttcggcaaggcgaaggggagccgggccatctggtacatgtggctcggcgcccgcttcctggagttcgaggccctgggcttcatgaacgaggaccactggttctcccgggagaacagcctctccggggtggagggcgaggggctgcacaagctgggctacatcctccgcgacatcagcaagatccccgggggcaacatgtacgccgacgacaccgcgggctgggacacgcggatcaccgaggacgacctgcagaacgaggccaagatcaccgacatcatggagccggagcacgccctgctcgccacctccatcttcaagctgacgtaccagaacaaggtggtccgcgtgcagcgccccgccaagaacgggaccgtgatggacgtcatcagccggcgcgaccagcggggctccggccaggtgggcacctacggcctgaacaccttcacgaacatggaggcgcagctcatccgccagatggagagcgaggggatcttcctgccctccgagctggagacccccaacctcgccgagcgggtgctggactggctggagaagtacggcgtcgagcgcctcaagcggatggccatcagcggggacgactgcgtggtgaagccgatcgacgaccgcttcgccaccgccctgaccgcgctgaacgacatgggcaaggtccggaaggacatcccccagtgggagccctccaaggggtggaacgactggcagcaggtccccttctgcagccaccacttccaccagctcatcatgaaggacggccgcgagatcgtggtcccgtgccggaaccaggacgagctggtgggccgcgcccgggtgtcccagggggccggctggagcctgcgcgagacggcctgcctcggcaagagctacgcccagatgtggcagctgatgtacttccaccggcgcgacctgcggctcgcggccaacgccatctgctccgccgtccccgtggactgggtgcccaccagccgcaccacctggtccatccacgcgcaccaccagtggatgacgaccgaggacatgctgagcgtctggaaccgggtgtggatcgaggagaacccctggatggaggacaagacccacgtgtccagctggggcgacgtcccgtacctggggaagcgcgaggaccagtggtgcggctccctcatcggcctgaccgcccgcgccacctgggccagcaacatccaggtggccatcaaccaggtgcggcgcctgatcgggaacgagaactacctcgactacatgacgtccatgaagcggttcaagaacgagggcgaccccgagggggcgctgtggtga

SEQ ID NO: 8492 - RNA, 9879 nt, synthetic construct
  misc_feature 1..9879: note = derived and/or modified CDS sequence (opt1) from DENV-1__GQ199783__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagtccctgctgttcaagaccagcgcgggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtgacctacgggacctgctcccagaccggcgagcaccggcgcgacaagcggagcgtggccctcgcgccccacgtgggcctggggctggagacccgcaccgagacctggatgtccagcgagggcgcctggaagcagatccagcgggtcgagacctgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggaccagcggcgccacctgggtggacgtcgtgctcgagcacgggtcctgcgtgaccacgatggccaaggacaagcccaccctggacatcgagctgctcaagaccgaggtcaccaaccccgcggtgctgcggaagctgtgcatcgaggccaagatcagcaacacgaccaccgactcccgctgccccacccagggcgaggccacgctcatggaggagcaggacgccaacttcgtgtgccggcgcaccttcgtcgaccggggctgggggaacggctgcgggctgttcggcaaggggagcctgatcacgtgcgccaagttcaagtgcgtgaccaagctcgagggcaagatcgtgcagtacgagaacctgaagtactccgtcatcgtgacggtgcacaccggcgaccagcaccaggtcgggaacgagagcaccgagcacggcaccaccgcgacgatcacgccccaggcccccacctccgagatccagctgaccgactacggggccctcacgctggactgcagcccccgcaccggcctggacttcaacgagatggtgctcctgaccatgaaggagaagtcctggctggtccacaagcagtggttcctcgacctgccgctgccctggaccagcggggccagcacgtcccaggagacctggaaccggcaggacctcctggtgaccttcaagaccgcccacgcgaagaagcaggaggtggtcgtgctgggcagccaggagggcgccatgcacacggccctcaccggggccaccgagatccagacctccggcacgaccaccatcttcgccgggcacctgaagtgccgcctgaagatggacaagctcaccctgaagggcatgagctacgtgatgtgcacggggtccttcaagctggagaaggaggtcgcggagacccagcacggcaccgtgctcgtgcagatcaagtacgagggcaccgacgccccctgcaagatccccttcagcacgcaggacgagaagggggtcacccagaacggccggctgatcaccgccaacccgatcgtgaccgacaaggagaagcccgtgaacatcgaggccgagccgcccttcggggagtcctacatcgtcatcggcgcgggcgagaaggccctgaagctgagctggttcaagaaggggtccagcatcggcaagatgttcgaggccacggcccgcggggcccggcgcatggcgatcctcggcgacaccgcctgggacttcgggtccgtgggcggcgtgttcaccagcgtcgggaagctggtgcaccagatcttcggcaccgcctacggggtgctgttctccggcgtcagctggacgatgaagatcgggatcggcgtgctcctgacctggctgggcctcaactcccgcagcacctccctgagcatgacctgcatcgccgtggggctggtcacgctctacctgggcgtgatggtgcaggccgactccgggtgcgtcatcaactggaagggccgggagctgaagtgcgggagcggcatcttcgtgaccaacgaggtgcacacctggaccgagcagtacaagttccaggcggacagcccgaagcgcctctccgccgccatcggcaaggcctgggaggagggggtctgcggcatccggagctccacccgcctggagaacatcatgtggaagcagatcagcaacgagctgaaccacatcctcctggagaacgacatgaagttcacggtggtggtcggggacgtggtgggcatcctggcccaggggaagaagatgatccggccccagcccatggagcacaagtactcctggaagtcctggggcaaggcgaagatcatcggcgccgacgtccagaacaccaccttcatcatcgacgggcccaacaccccggagtgccccgacgaccagcgcgcctggaacatctgggaggtggaggactacggcttcgggatcttcacgaccaacatctggctcaagctgcgggactcctacacccaggtgtgcgaccaccgcctgatgagcgccgcgatcaaggactccaaggccgtccacgccgacatgggctactggatcgagagcgagaagaacgagacctggaagctcgcccgggcctccttcatcgaggtgaagacgtgcatctggcccaagagccacaccctgtggtccaacggcgtgctggagagcgagatgatcatccccaagatctacgggggcccgatctcccagcacaactaccgccccgggtacttcacccagaccgcgggcccctggcacctcgggaagctggagctggacttcgacctctgcgagggcacgaccgtcgtggtggacgagcactgcggcaaccgggggccgagcctgcgcaccaccacggtcaccggcaagatcatccacgagtggtgctgccggtcctgcaccctgccgcccctgcgcttcaagggggaggacggctgctggtacgggatggagatccggcccgtgaaggagaaggaggagaacctggtcaagagcatggtcagcgccggctccggcgaggtggacagcttctccctggggctcctgtgcatcagcatcatgatcgaggaggtgatgcgctcccggtggagccgcaagatgctgatgaccggcacgctcgccgtcttcctgctgctcatcatggggcagctgacctggaacgacctgatccggctctgcatcatggtgggcgccaacgcctccgaccgcatggggatgggcaccacctacctggcgctgatggccacgttcaagatccgcccgatgttcgccgtgggcctcctgttccggcgcctgaccagccgggaggtcctcctgctgaccatcgggctctccctggtggccagcgtcgagctgcccaactccctcgaggagctgggcgacgggctggccatgggcatcatgatcctcaagctgctgaccgacttccagagccaccagctctgggcgacgctgctgtccctcaccttcatcaagaccaccctgagcctgcaccacgcctggaagacgatggccatggtgctctccatcgtgagcctgttccccctgtgcctctccaccaccagccagaagaccacgtggctgcccgtcctgctcggctccctggggtgcaagccgctgaccatgttcctcatcaccgagaacaagatctggggccgcaagagctggcccctgaacgaggggatcatggccgtgggcgtggtcagcatcctgctctccagcctgctgaagaacgacgtgcccctcgcggggcccctgatcgccggcggcatgctgatcgcctgctacgtgatctccgggagctccgccgacctcagcctggagaaggccgcggaggtctcctgggaggaggaggccgagcacagcggcgcctcccacaacatcctggtggaggtgcaggacgacgggaccatgaagatcaaggacgaggagcgggacgacaccctcacgatcctgctgaaggccaccctcctggccgtcagcggcgtgtacccgctgtccatccccgcgaccctcttcgtgtggtacttctggcagaagaagaagcagcgcagcggggtcctgtgggacacccccagcccgcccgaggtggagcgggccgtgctggacgacggcatctaccgcatcatgcagcggggcctgctcgggcgcagccaggtcggcgtgggggtgttccaggagaacgtcttccacacgatgtggcacgtgacccggggcgccgtgctgatgtaccaggggaagcgcctggagccctcctgggccagcgtcaagaaggacctcatctcctacggcggcgggtggcggctgcagggcagctggaacaccggggaggaggtccaggtgatcgccgtcgagcccggcaagaaccccaagaacgtgcagaccgcgcccgggacgttcaagacccccgagggcgaggtgggcgccatcgccctggacttcaagcccgggacctccggcagccccatcgtcaaccgcgaggggaagatcgtgggcctctacggcaacggggtggtcaccacgagcggcacctacgtgtccgccatcgcccagaccaaggcgagccaggaggggccgctgcccgagatcgaggacgaggtgttccggaagcgcaacctgaccatcatggacctccaccccggctccgggaagacgcggcgctacctgccggccatcgtccgggaggccatcaagcgcaagctgcggaccctcatcctggcccccacccgcgtggtggcgagcgagatggccgaggccctgaagggcatgcccatccgctaccagaccacggccgtcaagtccgagcacaccggcaaggagatcgtggacctcatgtgccacgccaccttcaccatgcggctgctgagccccgtgcgcgtcccgaactacaacatgatcatcatggacgaggcgcacttcacggacccctccagcatcgccgcccgggggtacatctccacccgcgtgggcatgggggaggccgccgcgatcttcatgaccgccacgccgcccggcagcgtggaggccttcccgcagtccaacgccgtcatccaggacgaggagcgggacatccccgagcgcagctggaactccgggtacgagtggatcacggacttccccggcaagaccgtgtggttcgtgcccagcatcaagtccggcaacgacatcgccaactgcctccggaagaacgggaagcgcgtcatccagctgagccggaagaccttcgacaccgagtaccagaagacgaagaacaacgactgggactacgtggtgaccaccgacatctccgagatgggcgcgaacttccgcgccgaccgggtcatcgacccgcgccggtgcctgaagcccgtgatcctcaaggacgggcccgagcgcgtcatcctggccggccccatgccggtgaccgtggccagcgcggcccagcggcgcgggcggatcggccgcaaccacaacaaggagggcgaccagtacatctacatggggcagcccctgaacaacgacgaggaccacgcccactggacggaggccaagatgctcctggacaacatcaacacccccgagggcatcatccccgccctgttcgagccggagcgggagaagtccgcggccatcgacggggagtaccgcctccgcggcgaggcccggaagaccttcgtcgagctgatgcgccgcggggacctgcccgtgtggctcagctacaaggtggccagcgagggcttccagtactccgaccgccggtggtgcttcgacggcgagcgcaacaaccaggtcctggaggagaacatggacgtggagatctggaccaaggagggggagcggaagaagctgcgcccccggtggctcgacgcccgcacgtacagcgaccccctggcgctgcgggagttcaaggagttcgccgccggccgccggtccgtgagcggggacctcatcctggagatcggcaagctgccgcagcacctcacccagcgcgcccagaacgccctggacaacctggtcatgctccacaactccgagcagggcgggcgggcgtaccgccacgccatggaggagctgcccgacaccatcgagaccctgatgctcctggccctgatcgccgtgctcaccggcggggtgacgctgttcttcctgagcggccgggggctcggcaagacctccatcggcctgctgtgcgtcatggcgagctccgtgctcctgtggatggccagcgtggagccccactggatcgccgcctccatcatcctggagttcttcctcatggtcctgctgatccccgagccggaccgccagcggacgccccaggacaaccagctcgcctacgtggtgatcgggctgctgttcatgatcctcaccgtcgcggccaacgagatgggcctgctggagacgaccaagaaggacctcgggatcggccacgtggccgtggagaaccaccaccacgccaccatgctggacgtcgacctgcaccccgccagcgcgtggaccctctacgccgtggccacgaccatcatcaccccgatgatgcgccacaccatcgagaacacgaccgccaacatctccctgaccgccatcgcgaaccaggccgccatcctgatggggctcgacaagggctggcccatcagcaagatggacatcggcgtgcccctgctggccctcgggtgctactcccaggtcaaccccctgaccctgacggccgcggtgctcatgctggtggcccactacgccatcatcggcccggggctgcaggccaaggcgacccgggaggcccagaagcgcaccgccgccggcatcatgaagaaccccaccgtcgacgggatcgtggccatcgacctcgaccccgtggtctacgacgcgaagttcgagaagcagctgggccagatcatgctgctcatcctgtgcacgagccagatcctgctcatgcgcaccacctgggccctgtgcgagtccatcaccctggccacgggccccctcaccaccctgtgggaggggagcccgggcaagttctggaacaccacgatcgccgtgtccatggccaacatcttccgggggagctacctggcgggcgccggcctcgccttcagcctgatgaagtccctcgggggcgggcgccgggggaccggggcccagggcgagaccctcggcgagaagtggaagcgccagctgaaccagctgagcaagtccgagttcaacatctacaagcggagcgggatcatggaggtggaccgctccgaggccaaggagggcctcaagcgcggggagaccacgcgccacgcggtcagccggggcaccgccaagctgcgctggttcgtggagcggaacctggtgaagcccgaggggaaggtcatcgacctgggctgcggccgcgggggctggtcctactactgcgccgggctcaagaaggtgaccgaggtgaagggctacaccaagggcggccccggccacgaggagcccatcccgatggccacgtacgggtggaacctggtcaagctgcacagcggcaaggacgtgttcttcacgccgcccgagaagtgcgacaccctcctgtgcgacatcggggagtccagccccaacccgaccatcgaggagggccggaccctgcgcgtgctcaagatggtcgagccctggctgcgggggaaccagttctgcatcaagatcctgaacccctacatgccctccgtggtggagacgctcgagcagatgcagcgcaagcacggcggcatgctggtccggaacccgctgagccgcaactccacccacgagatgtactgggtgagctgcgggaccggcaacatcgtgtccgcggtcaacatgaccagccggatgctcctgaaccgcttcacgatggcccaccgcaagcccacctacgagcgggacgtggacctgggggccggcacccgccacgtggccgtcgagcccgaggtggccaacctcgacatcatcggccagcggatcgagaacatcaagcacgagcacaagtccacctggcactacgacgaggacaacccctacaagacgtgggcgtaccacgggagctacgaggtcaagccgtccggcagcgccagctccatggtgaacggggtggtcaagctgctgaccaagccctgggacgtgatccccatggtgacccagatcgccatgaccgacacgacccccttcggccagcagcgcgtcttcaaggagaaggtggacacccggaccccgaaggccaagcgcgggacggcccagatcatggaggtgaccgcgcggtggctctggggcttcctgagccgcaacaagaagccccggatctgcacccgcgaggagttcacccggaaggtccgctccaacgccgccatcggcgccgtgttcgtggacgagaaccagtggaacagcgccaaggaggcggtcgaggacgagcggttctgggacctggtgcagaaggagcgcgagctccacaagcaggggaagtgcgccacgtgcgtgtacaacatgatgggcaagcgggagaagaagctgggggagttcggcaaggccaaggggtcccgcgccatctggtacatgtggctgggcgcgcggttcctcgagttcgaggccctgggcttcatgaacgaggaccactggttcagccgcgagaactccctgagcggggtcgagggcgaggggctccacaagctgggctacatcctgcgggacatctccaagatccccgggggcaacatgtacgccgacgacaccgccggctgggacacccgcatcaccgaggacgacctccagaacgaggccaagatcacggacatcatggagccggagcacgcgctgctggccaccagcatcttcaagctcacctaccagaacaaggtggtgcgggtccagcgccccgccaagaacgggaccgtgatggacgtgatctcccgccgggaccagcgcggcagcgggcaggtcggcacgtacggcctgaacaccttcaccaacatggaggcccagctgatccggcagatggagtccgaggggatcttcctccccagcgagctggagacccccaacctggccgagcgcgtgctcgactggctggagaagtacggcgtggagcggctgaagcgcatggcgatctccggggacgactgcgtcgtgaagccgatcgacgaccggttcgccacggccctcaccgccctgaacgacatgggcaaggtgcgcaaggacatcccccagtgggagcccagcaaggggtggaacgactggcagcaggtccccttctgctcccaccacttccaccagctgatcatgaaggacggccgggagatcgtggtgccgtgccgcaaccaggacgagctcgtcggccgggcccgcgtgagccagggggcgggctggagcctgcgggagaccgcctgcctggggaagtcctacgcccagatgtggcagctcatgtacttccaccgccgggacctgcgcctggccgccaacgcgatctgcagcgccgtgcccgtcgactgggtgcccacctcccggacgacctggagcatccacgcccaccaccagtggatgaccaccgaggacatgctctccgtgtggaaccgcgtctggatcgaggagaacccctggatggaggacaagacccacgtgagctcctggggcgacgtgccgtacctggggaagcgggaggaccagtggtgcggcagcctgatcggcctcacggcccgcgcgacctgggcctccaacatccaggtcgccatcaaccaggtgcgccggctgatcgggaacgagaactacctggactacatgaccagcatgaagcgcttcaagaacgagggcgaccccgagggggccctctggtga

SEQ ID NO: 8493 - RNA, 9879 nt, synthetic construct
  misc_feature 1..9879: note = derived and/or modified CDS sequence (opt1) from DENV-1__GQ199784__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgcgggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtcacctacgggacctgcagccagaccggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgtgatcggcacctccatcacccagaaggggatcatcttcatcctcctgatgctggtcacgcccagcatggccatgcggtgcgtgggcatcggctcccgcgacttcgtggaggggctcagcggcgccacctgggtcgacgtggtgctggagcacgggtcctgcgtcaccaccatggccaaggacaagcccacgctggacatcgagctcctgaagaccgaggtgaccaaccccgccgtgctgcggaagctctgcatcgaggcgaagatcagcaacaccacgaccgactcccgctgccccacccagggcgaggccaccctgatggaggagcaggacgccaacttcgtctgccggcgcacgttcgtggaccggggctgggggaacggctgcgggctgttcggcaaggggagcctcatcacgtgcgccaagttcaagtgcgtgaccaagctggagggcaagatcgtccagtacgagaacctgaagtactccgtgatcgtgaccgtccacacgggcgaccagcaccaggtggggaacgagagcaccgagcacggcaccaccgccaccatcacgccccaggcgcccacctccgagatccagctcaccgactacggggccctgaccctggactgcagcccccgcacgggcctcgacttcaacgagatggtcctgctgaccatgaaggagaagtcctggctcgtgcacaagcagtggttcctggacctgccgctcccctggaccagcggggccagcacctcccaggagacgtggaaccggcaggacctgctggtgaccttcaagaccgcccacgccaagaagcaggaggtcgtggtgctcggcagccaggagggcgcgatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggccgagacgcagcacggcaccgtgctggtccagatcaagtacgagggcaccgacgcgccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccaccgcccgcggggcccggcgcatggccatcctgggcgacacggcgtgggacttcgggtccatcggcggcgtgttcaccagcgtcgggaagctggtgcaccagatcttcggcaccgcctacggggtgctgttctccggcgtcagctggaccatgaagatcgggctgggcgtgctgctcacgtggctgggcctgaactcccgcagcacctccctcagcatgacctgcatcgccgtggggctggtcaccctgtacctcggcgtgatggtgcaggccgactccgggtgcgtcatcaactggaagggccgggagctgaagtgcgggagcggcatcttcgtgacgaacgaggtgcacacctggaccgagcagtacaagttccaggccgacagcccgaagcgcctgtccgcggccatcggcaaggcctgggaggagggggtctgcggcatccggagcgccacccgcctcgagaacatcatgtggaagcagatctccaacgagctgaaccacatcctgctcgagaacgacatgaagttcaccgtggtggtcggggacgtggtgggcatcctggcccaggggaagaagatgatccggccccagcccatggagcacaagtacagctggaagtcctggggcaaggcgaagatcatcggcgccgacgtccagaacacgaccttcatcatcgacgggcccaacaccccggagtgccccgacgaccagcgcgcctggaacatctgggaggtggaggactacggcttcgggatcttcaccacgaacatctggctgaagctccgggacagccacacccaggtgtgcgaccaccgcctgatgtccgccgcgatcaaggacagcaaggccgtccacgccgacatgggctactggatcgagtccgagaagaacgagacctggaagctggcccgggccagcttcatcgaggtgaagacctgcatctggcccaagtcccacacgctctggagcaacggcgtgctggagtccgagatgatcatccccaagatctacgggggcccgatcagccagcacaactaccgccccgggtacttcacccagaccgcgggcccctggcacctggggaagctcgagctggacttcgacctgtgcgagggcaccacggtcgtggtggacgagcactgcggcaaccgggggccgtccctccgcaccaccaccgtcacgggcaagatcatccacgagtggtgctgccggagctgcaccctgccgcccctgcgcttcaagggggaggacggctgctggtacgggatggagatccggcccgtgaaggagaaggaggagaacctcgtgaagtccatggtcagcgccggcagcggcgaggtggactccttcagcctggggctgctctgcatctccatcatgatcgaggaggtgatgcgcagccggtggtcccgcaagatgctgatgaccggcaccctggccgtcttcctcctgctgatcatggggcagctcacgtggaacgacctgatccggctgtgcatcatggtgggcgccaacgccagcgaccgcatggggatgggcaccacctacctcgcgctgatggccaccttcaagatgcgcccgatgttcgccgtgggcctcctgttccggcgcctgacgtcccgggaggtcctgctcctgaccatcgggctgagcctcgtggcctccgtcgagctgcccaacagcctggaggagctcggcgacgggctggccatgggcatcatgatcctgaagctcctgaccgacttccagtcccaccagctgtgggcgaccctcctgagcctgacgttcatcaagaccaccctctccctgcactacgcctggaagaccatggccatggtgctgagcatcgtgtccctcttccccctgtgcctgagcacgacctcccagaagaccacctggctccccgtcctgctgggcagcctcgggtgcaagccgctggccatgttcctgatcgcggagaacaagatctggggccgcaagtcctggcccctcaacgaggggatcatggccgtgggcgtggtcagcatcctgctgagctccctcctgaagaacgacgtgcccctggccgggcccctcatcgccggcggcatgctgatcgcctgctacgtgatcagcgggtccagcgcggacctgtccctcgagaaggccgccgaggtcagctgggaggaggaggccgagcactccggcgccagccacaacatcctggtggaggtgcaggacgacgggacgatgaagatcaaggacgaggagcgggacgacaccctgaccatcctcctgaaggcgaccctgctcgccgtctccggcgtgtacccgctgagcatccccgccaccctgttcgtgtggtacttctggcagaagaagaagcagcgctccggggtcctgtgggacacgcccagcccgcccgaggtggagcgggccgtgctcgacgacggcatctaccgcatcatgcagcggggcctgctggggcgctcccaggtcggcgtgggggtgttccaggagaacgtcttccacaccatgtggcacgtgacccggggcgccgtgctcatgtaccaggggaagcgcctggagcccagctgggcgtccgtcaagaaggacctgatcagctacggcggcgggtggcggctccagggctcctggaacaccggggaggaggtccaggtgatcgccgtcgagcccggcaagaaccccaagaacgtgcagacggcccccgggaccttcaagacccccgagggcgaggtgggcgccatcgccctggacttcaagcccgggaccagcggctcccccatcgtcaaccgcgaggggaagatcgtgggcctgtacggcaacggggtggtcacgaccagcggcacctacgtgagcgcgatcgcccaggccaaggcctcccaggaggggccgctccccgagatcgaggacgaggtgttccggaagcgcaacctgaccatcatggacctgcaccccggcagcgggaagacgcggcgctacctcccggcgatcgtccgggaggccatcaagcgcaagctgcggaccctgatcctcgcccccacccgcgtggtggcctccgagatggccgaggcgctgaagggcatgcccatccgctaccagaccacggccgtcaagagcgagcacaccggcaaggagatcgtggacctgatgtgccacgccaccttcaccatgcggctcctgtcccccgtgcgcgtcccgaactacaacatgatcatcatggacgaggcccacttcacggaccccagctccatcgccgcgcgggggtacatcagcacccgcgtgggcatgggggaggccgccgccatcttcatgaccgccacgccgcccggctccgtggaggcgttcccgcagagcaacgccgtcatccaggacgaggagcgggacatccccgagcgctcctggaacagcgggtacgagtggatcacggacttccccggcaagaccgtgtggttcgtgccctccatcaagagcggcaacgacatcgccaactgcctgcggaagaacgggaagcgcgtcatccagctctcccggaagaccttcgacaccgagtaccagaagacgaagaacaacgactgggactacgtggtgaccaccgacatcagcgagatgggcgccaacttccgcgcggaccgggtcatcgacccgcgccggtgcctgaagcccgtgatcctgaaggacgggcccgagcgcgtcatcctcgccggccccatgccggtgaccgtggcctccgccgcccagcggcgcgggcggatcggccgcaaccacaacaaggagggcgaccagtacatctacatggggcagcccctgaacaacgacgaggaccacgcgcactggacggaggccaagatgctgctcgacaacatcaacacccccgagggcatcatccccgccctgttcgagccggagcgggagaagtccgccgccatcgacggggagtaccgcctgcgcggcgaggcgcggaagaccttcgtcgagctcatgcgccgcggggacctgcccgtgtggctgtcctacaaggtggccagcgagggcttccagtacagcgaccgccggtggtgcttcgacggcgagcgcaacaaccaggtcctcgaggagaacatggacgtggagatctggaccaaggagggggagcggaagaagctgcgcccccggtggctggacgcccgcacgtactccgaccccctcgccctgcgggagttcaaggagttcgccgcgggccgccggagcgtgtccggggacctgatcctcgagatcggcaagctgccgcagcacctgacccagcgcgcccagaacgccctcgacaacctggtcatgctgcacaacagcgagcagggcgggcgggcctaccgccacgcgatggaggagctccccgacaccatcgagaccctgatgctgctcgccctgatcgccgtgctgacgggcggggtgaccctcttcttcctgtccggccgggggctgggcaagaccagcatcggcctcctgtgcgtcatggcctccagcgtgctgctctggatggcctccgtggagccccactggatcgcggccagcatcatcctggagttcttcctgatggtcctcctgatccccgagccggaccgccagcggacgccccaggacaaccagctggcctacgtggtgatcgggctcctgttcatgatcctgaccgtcgccgccaacgagatgggcctcctggagacgaccaagaaggacctggggatcggccacgtggcggtggagaaccaccaccacgccaccatgctcgacgtcgacctgcaccccgcctccgcctggaccctgtacgccgtggcgacgaccatcatcaccccgatgatgcgccacaccatcgagaacacgaccgccaacatcagcctcaccgccatcgccaaccaggccgcgatcctgatggggctggacaagggctggcccatctccaagatggacatcggcgtgcccctcctggccctggggtgctacagccaggtcaaccccctcaccctgacggccgccgtgctgatgctcgtggcgcactacgccatcatcggcccggggctgcaggccaaggccacccgggaggcccagaagcgcaccgcggccggcatcatgaagaaccccaccgtcgacgggatcgtggccatcgacctggaccccgtggtctacgacgccaagttcgagaagcagctcggccagatcatgctgctgatcctctgcacgtcccagatcctgctgatgcgcaccacctgggccctctgcgagagcatcaccctggcgacgggccccctgaccaccctctgggaggggtccccgggcaagttctggaacaccacgatcgccgtgagcatggccaacatcttccgggggtcctacctggccggcgccggcctggcgttcagcctcatgaagtccctcgggggcgggcgccgggggaccggggcccagggcgagaccctgggcgagaagtggaagcgccagctcaaccagctgtccaagagcgagttcaacatctacaagcggtccgggatcatggaggtggaccgcagcgaggccaaggagggcctgaagcgcggggagaccacgcgccacgccgtctcccggggcaccgcgaagctgcgctggttcgtggagcggaacctcgtgaagcccgaggggaaggtcatcgacctgggctgcggccgcgggggctggagctactactgcgccgggctgaagaaggtgaccgaggtgaagggctacaccaagggcgggcccggccacgaggagcccatcccgatggccacgtacgggtggaacctcgtcaagctgcactccggcaaggacgtgttcttcacgccgcccgagaagtgcgacaccctgctctgcgacatcggggagagctcccccaacccgaccatcgaggagggccggacgctgcgcgtgctgaagatggtcgagccctggctccgggggaaccagttctgcatcaagatcctgaacccctacatgcccagcgtggtggagaccctggagcagatgcagcgcaagcacggcggcatgctcgtccggaacccgctgtcccgcaacagcacccacgagatgtactgggtgtcctgcgggaccggcaacatcgtgagcgccgtcaacatgacctcccggatgctgctcaaccgcttcacgatggcccaccgcaagcccacctacgagcgggacgtggacctgggggcgggcacccgccacgtggccgtcgagcccgaggtggccaacctggacatcatcggccagcggatcgagaacatcaagcacgagcacaagagcacctggcactacgacgaggacaacccctacaagacgtgggcctaccacgggtcctacgaggtcaagccgagcggctccgccagcagcatggtgaacggggtggtcaagctcctgaccaagccctgggacgtgatccccatggtgacccagatcgcgatgaccgacacgacccccttcggccagcagcgcgtcttcaaggagaaggtggacacccggaccccgaaggccaagcgcgggacggcccagatcatggaggtgaccgcccggtggctgtggggcttcctctcccgcaacaagaagccccggatctgcacccgcgaggagttcacccggaaggtccgcagcaacgccgcgatcggcgccgtgttcgtggacgagaaccagtggaactccgccaaggaggccgtcgaggacgagcggttctgggacctggtgcagaaggagcgcgagctgcacaagcaggggaagtgcgcgacgtgcgtgtacaacatgatgggcaagcgggagaagaagctcggggagttcggcaaggccaaggggagccgcgccatctggtacatgtggctgggcgcccggttcctggagttcgaggccctcggcttcatgaacgaggaccactggttctcccgcgagaacagcctgtccggggtcgagggcgaggggctgcacaagctcggctacatcctgcgggacatcagcaagatccccgggggcaacatgtacgcggacgacaccgccggctgggacacccgcatcaccgaggacgacctgcagaacgaggcccggatcacggacatcatggagccggagcacgccctcctggccacctccatcttcaagctgacctaccagaacaaggtggtgcgcgtccagcgccccgcgaagaacgggaccgtgatggacgtgatcagccggcgcgaccagcggggctccgggcaggtcggcacgtacggcctcaacaccttcaccaacatggaggcccagctgatccgccagatggagagcgaggggatcttcctgccctccgagctcgagacccagaacctggccgagcgggtgctggactggctcgagaagtacggcgtggagcgcctgaagcggatggccatcagcggggacgactgcgtcgtgaagcccatcgacgaccgcttcgccacggcgctgaccgccctcaacgacatgggcaaggtgcggaaggacatcccgcagtgggagccctccaaggggtggaacgactggcagcaggtccccttctgcagccaccacttccaccagctgatcatgaaggacggccgcgagatcgtggtgccctgccggaaccaggacgagctggtcggccgcgcccgggtgtcccagggggccggctggagcctccgcgagaccgcctgcctgggcaagagctacgcgcagatgtggcagctgatgtacttccaccggcgcgacctccggctggccgccaacgccatctgctccgcggtgccggtcgactgggtgcccaccagccgcacgacctggtccatccacgcccaccaccagtggatgaccaccgaggacatgctgagcgtgtggaaccgggtctggatcgaggagaacccctggatggaggacaagacgcacgtgtccagctggggcgacgtgccctacctcgggaagcgcgaggaccagtggtgcggctccctgatcggcctgaccgcccgcgccacctgggccagcaacatccaggtcgcgatcaaccaggtgcggcgcctcatcgggaacgagaactacctggactacatgacctccatgaagcggttcaagaacgagggcgacccggagggggccctgtggtga

SEQ ID NO: 8494 - RNA, 9879 nt, synthetic construct
  misc_feature 1..9879: note = derived and/or modified CDS sequence (opt1) from DENV-1__GQ199785__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgaggtggagcccgacgacgtggactgctggtgcaacaccaccgacacctgggtgacctacgggacctgcagccagacgggcgagcaccggcgcgacaagcggagcgtggccctcgcgccccacgtcggcctggggctggagacccgcgccgagacctggatgagctccgagggcgcgtggaagcagatccagaaggtggagacctgggccctccggcaccccgggttcacggtgatcgccctgttcctggcccacgcgatcggcaccagcatcacccagaaggggatcatcttcatcctcctgatgctggtcaccccctccatggccatgcgctgcgtgggcatcggcagccgggacttcgtggaggggctctccggcgccacgtgggtcgacgtggtgctggagcacgggagctgcgtcaccaccatggccaaggacaagcccaccctggacatcgagctcctgaagacggaggtgaccaaccccgccgtgctgcgcaagctctgcatcgaggcgaagatctccaacaccaccacggacagccggtgcccgacccagggcgaggccaccctggtcgaggagcaggacgccaacttcgtgtgccgccggaccttcgtggaccgcggctgggggaacggctgcgggctgttcggcaaggggtccctcatcacgtgcgccaagttcaagtgcgtcaccaagctggagggcaagatcgtgcagtacgagaacctgaagtacagcgtgatcgtcaccgtgcacaccggcgaccagcaccaggtcgggaacgagtccacggagcacggcaccaccgccaccatcacgccccaggcgcccacgagcgagatccagctcaccgactacggggccctgaccctggactgcagcccccggaccggcctcgacttcaacgagatggtgctgctgacgatgaaggagaagtcctggctcgtgcacaagcagtggttcctggacctgcccctcccctggaccagcggggcctccaccagccaggagacctggaaccgccaggacctgctggtcacgttcaagaccgcccacgccaagaagcaggaggtggtggtcctcggctcccaggagggcgcgatgcacaccgccctgaccggggccacggagatccagaccagcggcaccaccacgatcttcgccgggcacctgaagtgccggctcaagatggacaagctgaccctgaagggcatgtcctacgtgatgtgcaccgggagcttcaagctcgagaaggaggtggccgagacccagcacggcacggtcctggtgcagatcaagtacgagggcaccgacgcgccctgcaagatccccttctccacccaggacgagaagggggtgacccagaacggccgcctgatcacggccaacccgatcgtcaccgacaaggagaagcccgtgaacatcgaggccgagccgcccttcggggagagctacatcgtgatcggcgccggcgagaaggcgctgaagctctcctggttcaagaaggggagctccatcggcaagatgttcgaggccaccgcccgcggggcccgccggatggccatcctgggcgacaccgcgtgggacttcgggagcatcggcggcgtcttcacgtccgtggggaagctggtgcaccagatcttcggcaccgcctacggggtcctcttcagcggcgtgtcctggaccatgaagatcgggatcggcgtgctgctgacctggctcggcctgaacagccgctccacgagcctgtccatgacctgcatcgccgtcgggctcgtgaccctgtacctgggcgtgatggtccaggccgacagcgggtgcgtgatcaactggaagggccgcgagctcaagtgcgggagcggcatcttcgtgaccaacgaggtccacacgtggaccgagcagtacaagttccaggccgactccccgaagcggctgagcgcggccatcggcaaggcctgggaggagggggtgtgcggcatccgctccgccacccggctggagaacatcatgtggcgccagatcagcaacgagctcaaccacatcctgctggagaacgacatgaagttcaccgtggtcgtgggggacgtggtcggcatcctcgcccaggggaagaagatgatccggccccagcccatggagcacaagtactcctggaagtcctggggcaaggcgaagatcatcggcgccgacgtgcagaacaccacgttcatcatcgacgggcccaacaccccggagtgccccgacgaccagcgcgcctggaacatctgggaggtggaggactacggcttcgggatcttcaccaccaacatctggctgaagctgcgggactcctacacgcaggtctgcgaccaccgcctcatgagcgccgcgatcaaggactccaaggccgtgcacgccgacatgggctactggatcgagagcgagaagaacgagacctggaagctggcccgggcctccttcatcgaggtgaagacctgcatctggcccaagagccacaccctgtggtccaacggcgtcctcgagagcgagatgatcatccccaagatctacgggggcccgatctcccagcacaactaccgccccgggtacttcacgcagaccgcgggcccctggcacctggggaagctggagctcgacttcgacctgtgcgagggcaccaccgtggtggtcgacgagcactgcggcaaccgggggccgagcctgcgcacgaccaccgtgaccggcaagatcatccacgagtggtgctgccggtcctgcacgctgccgcccctccgcttcaagggggaggacggctgctggtacgggatggagatccggcccgtgaaggagaaggaggagaacctggtcaagagcatggtgagcgccggctccggcgaggtggacagcttctccctcgggctgctgtgcatcagcatcatgatcgaggaggtcatgcgctcccggtggagccgcaagatgctcatgaccggcaccctggccgtgttcttcctgctcatcatggggcagctgacctggaacgacctgatccggtcctgcatcatggtgggcgccaacgccagcgaccgcatggggatgggcacgacctacctcgcgctgatggccaccttcaagatgcgcccgatgttcgccgtcgggctgctgttccggcgcctgacctcccgggaggtgctgctcctgacgatcgggctgagcctcgtcgcctccgtggagctgcccaacagcctggaggagctcggcgacgggctggccatgggcatcatgatcctgaagctcctgaccgacttccagtcctaccagctgtgggcgaccctcctgagcctgaccttcatcaagacgaccttctccctccactacgcctggaagaccatggccatggtgctgagcatcgtctccctgctccccctgtgcctgagcaccacgtcccagaagaccacctggctccccgtgctgctgggcagcctcgggtgcaagccgctgaccatgttcctgatcgccgagaacaagatctggggccgcaagagctggcccctcaacgaggggatcatggcggtgggcatcgtctccatcctgctgagctccctcctgaagaacgacgtgcccctggccgggcccctcatcgccggcggcatgctgatcgcctgctacgtgatcagcgggtccagcgccgacctgtccctcgagaaggcggccgaggtcagctgggaggaggaggccgagcactccggcgccagccacaacatcctggtggaggtgcaggacgacgggacgatgaagatcaaggacgaggagcgggacgacaccctgaccatcctcctgaaggccaccctgctcgcggtctccggcgtgtacccgctgagcatccccgccaccctgttcgtgtggtacttctggcagaagaagaagcagcgctccggggtcctctgggacacgcccagcccgcccgaggtggagcgggccgtgctggacgacggcatctaccgcatcatgcagcggggcctgctggggcgctcccaggtcggcgtgggggtgttccaggagaacgtcttccacaccatgtggcacgtgacccggggcgccgtgctcatgtaccaggggaagcgcctggagcccagctgggcctccgtcaagaaggacctgatcagctacggcggcgggtggcggctccagggctcctggaacaccggggaggaggtccaggtgatcgcggtcgagcccggcaagaaccccaagaacgtgcagacggcccccgggaccttcaagacccccgagggcgaggtgggcgccatcgccctggacttcaagcccgggaccagcggcagccccatcgtcaaccgcgaggggaagatcgtgggcctgtacggcaacggggtggtcacgacctccggcacctacgtgagcgccatcgcgcaggccaaggcctcccaggaggggccgctccccgagatcgaggacgaggtgttccggaagcgcaacctgaccatcatggacctgcaccccggcagcgggaagacgcggcgctacctcccggccatcgtccgggaggcgatcaagcgcaagctgcggaccctgatcctcgcccccacccgcgtggtggcctccgagatggccgaggccctgaagggcatgcccatccgctaccagaccacggcggtcaagagcgagcacaccggccgggagatcgtggacctgatgtgccacgccaccttcaccatgcgcctcctgtcccccgtgcgggtcccgaactacaacatgatcatcatggacgaggcccacttcacggaccccagctccatcgccgcccgcgggtacatcagcacccgggtgggcatgggggaggcggccgccatcttcatgaccgccacgccgcccggctccgtggaggccttcccgcagagcaacgcggtcatccaggacgaggagcgcgacatccccgagcggtcctggaacagcgggtacgagtggatcacggacttccccggcaagaccgtgtggttcgtgccctccatcaagagcggcaacgacatcgccaactgcctgcgcaagaacgggaagcgggtcatccagctctcccgcaagaccttcgacaccgagtaccagaagacgaagaacaacgactgggactacgtggtgaccaccgacatcagcgagatgggcgccaacttccgggccgaccgcgtcatcgacccgcggcgctgcctgaagcccgtgatcctgaaggacgggcccgagcgggtcatcctcgcgggccccatgccggtgaccgtggcctccgccgcccagcgccgggggcgcatcggccggaaccacaacaaggagggcgaccagtacatctacatggggcagcccctgaacaacgacgaggaccacgcccactggacggaggcgaagatgctgctcgacaacatcaacacccccgagggcatcatccccgccctgttcgagccggagcgcgagaagtccgccgccatcgacggggagtaccgcctgcggggcgaggcccgcaagaccttcgtcgagctcatgcggcgcggggacctgcccgtgtggctgagctacaaggtggcgtccgagggcttccagtacagcgaccggcgctggtgcttcgacggcgagcggaacaaccaggtcctcgaggagaacatggacgtggagatctggaccaaggagggggagcgcaagaagctgcggccccgctggctggacgcccggacgtactccgaccccctcgccctgcgcgagttcaaggagttcgccgccggccggcgcagcgtgtccggggacctgatcctcgagatcggcaagctgccgcagcacctgacccagcgggcgcagaacgccctcgacaacctggtcatgctgcacaacagcgagcagggcgggcgcgcctaccggcacgccatggaggagctccccgacaccatcgagaccctgatgctgctcgcgctgatcgccgtgctgacgggcggggtgaccctcttcttcctgtccggcaaggggctgggcaagaccagcatcggcctcctgtgcgtcatggcctccagcgccctgctctggatggcctccgtggagccccactggatcgcggccagcatcatcctggagttcttcctgatggtgctcctgatccccgagccggaccgccagcggacgccccaggacaaccagctggcctacgtcgtgatcgggctcctgttcatgatcctgaccgtggccgccaacgagatgggcctcctggagacgaccaagaaggacctggggatcggccacgtcgcggtggagaaccaccaccacgccaccatgctcgacgtggacctgcaccccgcctccgcctggaccctgtacgccgtcgcgacgaccatcatcaccccgatgatgcgccacaccatcgagaacacgaccgccaacatcagcctcaccgccatcgccaaccaggccgcgatcctgatggggctggacaagggctggcccatctccaagatggacatcggcgtgcccctcctggccctggggtgctacagccaggtgaaccccctcaccctgacggccgccgtcctgatgctcgtggcgcactacgccatcatcggcccggggctgcaggccaaggccacccgggaggcccagaagcgcaccgcggccggcatcatgaagaaccccaccgtggacgggatcgtcgccatcgacctggaccccgtggtgtacgacgccaagttcgagaagcagctcggccagatcatgctgctgatcctctgcacgtcccagatcctgctgatgcgcaccacctgggccctctgcgagagcatcaccctggcgacgggccccctgaccaccctctgggaggggtccccgggcaagttctggaacaccacgatcgccgtcagcatggccaacatcttccgggggagctacctggccggcgccggcctggcgttctccctcatgaagtccctcgggggcgggcgccgggggaccggggcccagggcgagaccctgggcgagaagtggaagcgccagctcaaccagctgtccaagagcgagttcaacacctacaagcggtccgggatcatggaggtggaccgcagcgaggccaaggagggcctgcggcgcggggagacgaccaagcacgccgtgtcccggggcaccgcgaagctccgctggttcgtcgagcggaacctggtgaagcccgaggggaaggtgatcgacctgggctgcggccgcgggggctggagctactactgcgccgggctgaagaaggtcaccgaggtgaagggctacacgaagggcgggcccggccacgaggagcccatcccgatggccacctacgggtggaacctcgtgaagctgcactccggcaaggacgtcttcttcatcccgcccgagaagtgcgacaccctgctctgcgacatcggggagagctcccccaacccgaccatcgaggagggccggacgctgcgcgtgctgaagatggtggagccctggctccgggggaaccagttctgcatcaagatcctgaacccctacatgcccagcgtcgtggagaccctggagcagatgcagcgcaagcacggcggcatgctcgtgcggaacccgctgtcccgcaacagcacccacgagatgtactgggtctcctgcgggaccggcaacatcgtgagcgccgtgaacatgacctcccggatgctgctcaaccgcttcacgatggcccaccgcaagcccacctacgagcgggacgtcgacctgggggcgggcacccgccacgtggccgtggagcccgaggtcgccaacctggacatcatcggccagcggatcgagaacatcaagcacgagcacaagagcacctggcactacgacgaggacaacccctacaagacgtgggcctaccacgggtcctacgaggtgaagccgagcggcagcgcctccagcatggtcaacggggtggtgaagctcctgaccaagccctgggacgtcatccccatggtgacccagatcgcgatgaccgacacgacccccttcggccagcagcgcgtgttcaaggagaaggtcgacacccggaccccgaaggccaagcgcgggacggcccagatcatggaggtgaccgccaagtggctgtggggcttcctctcccggaacaagaagccccgcatctgcacccgggaggagttcacccgcaaggtgcggagcaacgccgcgatcggcgccgtcttcgtggacgagaaccagtggaactccgccaaggaggccgtggaggacgagcgcttctgggacctggtccaccgggagcgcgagctgcacaagcaggggaagtgcgcgacgtgcgtgtacaacatgatgggcaagcgggagaagaagctcggggagttcggcaaggccaaggggagccgcgccatctggtacatgtggctgggcgcccggttcctggagttcgaggccctcggcttcatgaacgaggaccactggttctcccgcgagaacagcctgtccggggtggagggcgaggggctgcacaagctcggctacatcctgcgggacatcagcaagatccccgggggcaacatgtacgcggacgacaccgccggctgggacacccgcatcaccgaggacgacctgcagaacgaggccaagatcacggacatcatgaagccggagcacgccctcctggccacctccatcttcaagctgacctaccagaacaaggtcgtgcgggtgcagcgccccgcgcgcaacgggaccgtcatggacgtgatcagccggcgcgaccagcggggctccggccaggtgggcacgtacggcctcaacaccttcaccaacatggaggcccagctgatccgccagatggagagcgaggggatcttctcccccagcgagctggagacccccaacctcgccgagcgggtcctggactggctggagaagcacggcgtggagcgcctcaagcggatggccatctccggggacgactgcgtggtcaagccgatcgacgaccgcttcgccacggcgctgagcgccctgaacgacatgggcaaggtgcggaaggacatcccccagtgggagcccagcaaggggtggaacgactggcagcaggtccccttctgctcccaccacttccaccagctcatcatgaaggacggccgcgagatcgtcgtgccgtgccggaaccaggacgagctggtgggccgcgcccgggtcagccagggggccggctggtccctgcgcgagaccgcctgcctcggcaagagctacgcgcagatgtggcagctgatgtacttccaccggcgcgacctgcggctcgccgccaacgccatctgctccgcggtgcccgtggactgggtccccaccagccgcaccacgtggtccatccacgcccaccaccagtggatgaccaccgaggacatgctgagcgtgtggaaccgggtgtggatcgaggagaacccctggatggaggacaagacccacatctccagctggggcgacgtcccgtacctggggaagcgcgaggaccagtggtgcggctccctcatcggcctgacggcccgcgccacctgggccaccaacatccaggtggcgatcaaccaggtgcggcgcctgatcgggaacgagaactacctcgactacatgaccagcatgaagcggttcaagaacgagtccgaccccgagggcgccctgtggtga

SEQ ID NO: 8495 - RNA, 9879 nt, synthetic construct
  misc_feature 1..9879: note = derived and/or modified CDS sequence (opt1) from DENV-1__GQ199786__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccaccgacacctgggtgacctacgggacctgcagccagacgggcgagcaccggcgggacaagcggtccgtggccctcgcgccccacgtgggcctggggctggagacccgcaccgagacctggatgagctccgagggcgcgtggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtcgggaagctggtgcaccagatcttcggcaccgcctacggggtgctgttctccggcgtcagctggacgatgaagatcgggatcggcgtgctgctgacctggctcggcctgaactcccgcagcacctccctgagcatgacctgcatcgccgtggggctcgtcacgctgtacctgggcgtgatggtgcaggccgactccgggtgcgtcatcaactggaagggccgggagctcaagtgcgggagcggcatcttcgtgaccaacgaggtgcacacctggaccgagcagtacaagttccaggccgacagcccgaagcgcctgtccgcggccatcggcaaggcctgggaggagggggtctgcggcatccggagcgccacccgcctggagaacatcatgtggaagcagatctccaacgagctcaaccacatcctgctggagaacgacatgaagttcacggtggtggtcggggacgtggccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtcgaggactacggcttcgggatcttcacgaccaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacgtgcatctggcccaagtcccacaccctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcacgaccgtggtcgtggacgagcactgcggcaaccgggggccgtccctgcgcaccaccacggtgaccggcaagatcatccacgagtggtgctgccggagctgcaccctgccgcccctccgcttccgcggggaggacggctgctggtacgggatggagatccgccccgtcaaggagaaggaggagaacctggtgaagtccatggtgagcgccggcagcggcgaggtcgactccttcagcctcgggctgctgtgcatctccatcatgatcgaggaggtgatgcggagccgctggtcccggaagatgctcatgaccggcacgctggccgtgttcttcctgctcatcatggggcagctgacctggaacgacctgatccgcctctgcatcatggtcggcgccaacgcgagcgaccgcatggggatgggcaccacctacctggccctgatggccacgttcaagatgcggccgatgttcgccgtgggcctcctgttccgccggctgacctcccgcgaggtgctcctgctgaccatcgggctcagcctggtcgcctccgtggagctgcccaacagcctcgaggagctgggcgacgggctggcgatgggcatcatgatcctcaagctgctgaccgacttccagtcccaccagctctgggccacgctgctgagcctcaccttcatcaagaccaccttctccctgcactacgcctggaagacgatggccatggtcctgagcatcgtgtccctcttccccctgtgcctgagcaccacctcccagaagaccacgtggctccccgtgctgctgggcagcctcgggtgcaagccgctgaccatgttcctgatcgcggagaacaagatctggggccggcgctcctggcccctcaacgaggggatcatggccgtcggcatcgtgagcatcctgctgagctccctcctgaagaacgacgtgcccctggccgggcccctcatcgccggcggcatgctgatcgcctgctacgtcatcagcgggtccagcgcggacctgtccctcgagaaggccgccgaggtgagctgggaggaggaggccgagcactccggcgccagccacaacatcctggtggaggtccaggacgacgggaccatgaagatcaaggacgaggagcgggacgacaccctgaccatcctcctgaaggcgacgctgctcgccgtgtccggcgtgtacccgctgagcatccccgccaccctgttcgtctggtacttctggcagaagaagaagcagcgctccggggtgctctgggacacccccagcccgcccgaggtggagcgggccgtcctggacgacggcatctaccgcatcatgcagcggggcctgctggggcgctcccaggtgggcgtgggggtcttccaggagaacgtgttccacaccatgtggcacgtgacgcggggcgccgtcctcatgtaccaggggaagcgcctggagcccagctgggcgtccgtgaagaaggacctgatcagctacggcggcgggtggcggctccagggctcctggaacaccggggaggaggtgcaggtcatcgccgtggagcccggcaagaaccccaagaacgtgcagaccgcccccgggaccttcaagacgcccgagggcgaggtcggcgccatcgccctggacttcaagcccgggaccagcggctcccccatcgtgaaccgcgaggggaagatcgtgggcctgtacggcaacggggtcgtgaccaccagcggcacgtacgtgagcgcgatcgcccaggccaaggcctcccaggaggggccgctccccgagatcgaggacgaggtcttccggaagcgcaacctgaccatcatggacctgcaccccggcagcgggaagacccggcgctacctcccggcgatcgtgcgggaggccatcaagcgcaagctgcgcaccctgatcctcgcccccacgcgggtggtcgcctccgagatggccgaggcgctgaagggcatgcccatccgctaccagaccaccgccgtcaagagcgagcacaccggcaaggagatcgtggacctgatgtgccacgccacgttcaccatgcggctcctgtcccccgtccgcgtgccgaactacaacatgatcatcatggacgaggcccacttcaccgaccccagctccatcgccgcgcgggggtacatcagcacccgcgtgggcatgggggaggccgccgccatcttcatgacggccacgccgcccggctccgtcgaggcgttcccgcagagcaacgccgtgatccaggacgaggagcgggacatccccgagcgctcctggaacagcgggtacgagtggatcaccgacttccccggcaagaccgtgtggttcgtcccctccatcaagagcggcaacgacatcgccaactgcctgcggaagaacgggaagcgcgtgatccagctctcccggaagacgttcgacaccgagtaccagaagaccaagaacaacgactgggactacgtggtcaccacggacatcagcgagatgggcgccaacttccgcgcggaccgggtgatcgacccgcgccggtgcctgaagcccgtgatcctgaaggacgggcccgagcgcgtcatcctcgccggccccatgccggtgaccgtcgcctccgccgcccagcggcgcgggcggatcggccgcaaccacaacaaggagggcgaccagtacatctacatggggcagcccctgaacaacgacgaggaccacgcgcactggaccgaggccaagatgctgctcgacaacatcaacacccccgagggcatcatccccgccctgttcgagccggagcgcgagaagtccgccgccatcgacggggagtaccggctgcgcggcgaggcgcggaagacgttcgtggagctcatgcgccgcggggacctgcccgtgtggctgtcctacaaggtcgccagcgagggcttccagtacagcgaccgccggtggtgcttcgacggcgagcgcaacaaccaggtgctcgaggagaacatggacgtggagatctggaccaaggagggggagcggaagaagctgcgcccccggtggctggacgcccgcacctactccgaccccctcgccctgcgggagttcaaggagttcgccgcgggccgccggagcgtctccggggacctgatcctcgagatcggcaagctgccgcagcacctgacccagcgcgcccagaacgccctcgacaacctggtgatgctgcacaacagcgagcagggcgggcgggcctaccgccacgcgatggaggagctccccgacacgatcgagaccctgatgctgctcgccctgatcgccgtgctgaccggcggggtcatcctcttcttcctgtccggccgggggctgggcaagaccagcatcggcctcctgtgcgtgatggcctccagcgtgctgctctggatggcctccgtcgagccccactggatcgcggccagcatcatcctggagttcttcctgatggtgctcctgatccccgagccggaccgccagcggacgccccaggacaaccagctggcctacgtggtcatcgggctcctgttcatgatcctgacggtggccgccaacgagatgggcctcctggagaccaccaagaaggacctggggatcggccacgtggcggtcgagaaccaccaccacgccgccatgctcgacgtggacctgcaccccgcctccgcctggaccctgtacgcggtggccacgaccatcatcaccccgatgatgcgccacaccatcgagaacacgaccgccaacatcagcctcaccgccatcgccaaccaggcggccatcctgatggggctggacaagggctggcccatctccaagatggacatcggcgtccccctcctggccctggggtgctacagccaggtgaaccccctcaccctgacggccgcggtgctgatgctcgtcgcccactacgccatcatcggcccggggctgcaggccaaggccacccgcgaggcgcagaagcggaccgccgccggcatcatgaagaaccccaccgtggacgggatcgtggccatcgacctggaccccgtcgtgtacgacgccaagttcgagaagcagctcggccagatcatgctgctgatcctctgcacgtcccagatcctgctgatgcgcaccacctgggcgctctgcgagagcatcaccctggccacgggccccctgaccaccctctgggaggggtccccgggcaagttctggaacaccacgatcgccgtgagcatggccaacatcttccgggggtcctacctggccggcgcgggcctggccttcagcctcatgaagtccctcgggggcgggcgccgggggaccggggcccagggcgagaccctgggcgagaagtggaagcgccagctcaaccagctgtccaagagcgagttcaacacctacaagcggtccgggatcatggaggtcgaccgcagcgaggccaaggagggcctgaagcgcggggagacgaccaagcacgcggtgtcccgcggcaccgccaagctccggtggttcgtggagcgcaacctggtcaagcccgaggggaaggtgatcgacctgggctgcggccgcgggggctggagctactactgcgccgggctgaagaaggtgaccgaggtcaagggctacacgaagggcggccccggccacgaggagcccatcccgatggccacctacgggtggaacctcgtgaagctgcactccggcaaggacgtgttcttcatcccgcccgagaagtgcgacaccctgctctgcgacatcggggagagctcccccaacccgaccatcgaggagggccgcacgctgcgggtcctgaagatggtggagccctggctccgcgggaaccagttctgcatcaagatcctgaacccctacatgcccagcgtggtcgagaccctggagcagatgcagcggaagcacggcggcatgctcgtgcgcaacccgctgtcccggaacagcacccacgagatgtactgggtgtcctgcgggaccggcaacatcgtcagcgccgtgaacatgacctcccgcatgctgctcaaccgcttcacgatggcgcaccggaagcccacctacgagcgcgacgtggacctgggggccggcacccggcacgtcgccgtggagcccgaggtggccaacctggacatcatcggccagcgcatcgagaacatcaagcacgagcacaagagcacctggcactacgacgaggacaacccctacaagacgtgggcctaccacgggtcctacgaggtcaagccgagcggctccgcgagcagcatggtgaacggggtcgtgaagctcctgaccaagccctgggacgtgatccccatggtcacccagatcgccatgaccgacacgacccccttcggccagcagcgggtgttcaaggagaaggtggacacccgcaccccgaaggccaagcgggggacggcccagatcatggaggtcaccgccaagtggctgtggggcttcctctcccgcaacaagaagccccggatctgcacccgcgaggagttcacccggaaggtgcgcagcaacgcggccatcggcgccgtgttcgtcgacgagaaccagtggaactccgccaaggaggcggtggaggacgagcggttctgggacctggtgcaccgcgagcgggagctgcacaagcaggggaagtgcgccacgtgcgtctacaacatgatgggcaagcgcgagaagaagctcggggagttcggcaaggccaaggggagccgggccatctggtacatgtggctgggcgcccgcttcctggagttcgaggcgctcggcttcatgaacgaggaccactggttctcccgggagaacagcctgtccggggtggagggcgaggggctgcacaagctcggctacatcctgcgcgacatcagcaagatccccgggggcaacatgtacgccgacgacaccgccggctgggacacccggatcaccgaggacgacctgcagaacgaggcccgcatcacggacatcatggagccggagcacgccctcctggcgcgctccatcttcaagctgacctaccagaacaaggtggtccgggtgcagcgccccgccaagaacgggaccgtgatggacgtcatcagccggcgcgaccagcggggctccggccaggtggggacctacggcctcaacacgttcaccaacatggaggcccagctgatccgccagatggagagcgaggggatcttctcccccagcgagctggagacccccaacctcgccgagcgggtgctggactggctggagaagtacggcgtcgagcgcctcaagcggatggccatctccggggacgactgcgtggtgaagccgatcgacgaccgcttcgcgaccgccctgacggccctgaacgacatgggcaaggtccggaaggacatcccccagtgggagcccagcaaggggtggaacgactggcagcaggtccccttctgctcccaccacttccaccagctcatcatgaaggacggccgcgagatcgtggtcccgtgccggaaccaggacgagctggtgggccgcgcccgggtgagccagggggccggctggagcctgcgcgagaccgcgtgcctcgggaagtcctacgcccagatgtggcagctgatgtacttccaccggcgcgacctgcggctcgccgccaacgcgatctgcagcgccgtccccgtggactggatccccacctcccgcaccacgtggagcatccacgcccaccaccagtggatgaccaccgaggacatgctgtccgtgtggaaccgcgtctggatcgaggagaacccctggatggaggacaagacccacatcagctcctggggcgacgtgccgtacctggggaagcgggaggaccagtggtgcggcagcctcatcggcctgacggcccgcgccacctgggcgaccaacatccaggtggccatcaaccaggtccggcgcctgatcgggaacgagaactacctcgactacatgacctccatgaagcggttcaagaacgagagcgaccccgagggcgccctgtggtga

SEQ ID NO: 8496 - RNA, 9879 nt, synthetic construct
  misc_feature 1..9879: note = derived and/or modified CDS sequence (opt1) from DENV-1__GQ199787__SS-prME
  source 1..9879: mol_type = other RNA
agcgtgaccatgctgctgatgctggtgcccaccgccctggccttccacctcaccacccggggcggggagccccacatgatcgtgaccaagcaggagcggggcaagagcctgctgttcaagaccagcgcgggggtgaacatgtgcaccctcatcgccatggacctgggcgagctgtgcgaggacaccatgacctacaagtgcccccggatcaccgaggccgagcccgacgacgtcgactgctggtgcaacgccaccgacacctgggtgacctacgggacctgcagccagaccggcgagcaccggcgcgacaagcggagcgtggccctcgcgccccacgtcggcctggggctggagacccgcaccgagacctggatgtccagcgagggcgcctggaagcagatccagcgggtggagacgtgggccctccgccaccccgggttcaccgtgatcgccctgttcctggcgcacgccatcggcacctccatcacccagaaggggatcatcttcatcctcctgatgctggtcacgcccagcatggccatgcggtgcgtgggcatcggctcccgcgacttcgtggaggggctcagcggcgccacctgggtcgacgtggtgctggagcacgggtcctgcgtcaccaccatggccaaggacaagcccacgctggacatcgagctcctgaagaccgaggtgaccaaccccgcggtgctgcggaagctctgcatcgaggccaagatcagcaacaccacgaccgactcccgctgccccacccagggcgaggccaccctgatggaggagcaggacgccaacttcgtctgccggcgcacgttcgtggaccggggctgggggaacggctgcgggctgttcggcaaggggagcctcatcacgtgcgccaagttcaagtgcgtgaccaagctggagggcaagatcgtccagtacgagaacctgaagtactccgtgatcgtgaccgtccacacgggcgaccagcaccaggtggggaacgagagcaccgagcacggcaccaccgcgaccatcacgccccaggcccccacctccgagatccagctcaccgactacggggccctgaccctggactgcagcccccgcacgggcctcgacttcaacgagatggtcctgctgaccatgaaggagaagtcctggctcgtgcacaagcagtggttcctggacctgccgctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgatccagaacggccggctgatcacggccaacccgatcgtgaccgacaaggagaagcccgtcaacatcgaggccgagccgcccttcggggagtcctacatcgtgatcggcgtgggcgagaaggcgctgaagctcagctggttcaagaaggggtccagcatcggcaagatgttcgaggccaccgcccgcggggcccggcgcatggccatcctgggcgacaccgcgtgggacttcgggtccatcggcggcgtcttcacgagcgtggggaagctggtgcaccagatcttcggcaccgcctacggggtcctcttctccggcgtgagctggaccatgaagatcgggatcggcgtgctgctgacctggctcggcctgaactcccgcagcacgtccctgagcatgacctgcatcgccgtcgggctcgtgaccctgtacctgggcgtgatggtccaggccgactccgggtgcgtgatcaactggaagggccgggagctcaagtgcgggagcggcatcttcgtgaccaacgaggtccacacgtggaccgagcagtacaagttccaggccgacagcccgaagcgcctgtccgcggccatcggcaaggcctgggaggagggggtgtgcggcatccggagcgccacccgcctggagaacatcatgtggaagcagatctccaacgagctcaaccacatcctgctggagaacgacatgaagttcaccgtggtcgtgggggacgtggtcggcatcctcgcccaggggaagaagatgatccggccccagcccatggagcacaagtacagctggaagtcctggggcaaggcgaagatcatcggcgccgacgtgcagaacaccacgttcatcatcgacgggcccaacaccccggagtgccccgacgaccagcgcgcctggaacatctgggaggtggaggactacggcttcgggatcttcaccaccaacatctggctgaagctgcgggacagctacacgcaggcctgcgaccaccgcctcatgtccgcggccatcaaggacagcaaggccgtccacgccgacatgggctactggatcgagtccgagaagaacgagacctggaagctggcccgggcgagcttcatcgaggtgaagacctgcatctggcccaagtcccacaccctgtggagcaacggcgtgctcgagtccgagatggtcatccccaagatctacgggggcccgatcagccagcacaactaccgccccgggtacttcacgcagaccgccggcccctggcacctggggaagctggagctcgacttcgacctgtgcgagggcaccaccgtggtggtcgacgagcactgcggcaaccgggggccgtccctgcgcacgaccaccgtgaccggcaagatcatccacgagtggtgctgccggagctgcacgctgccgcccctccgcttcaagggggaggacggctgctggtacgggatggagatccggcccgtgaaggagaaggaggagaacctggtcaagtccatggtgagcgccggcagcggcgaggtggactccttcagcctcgggctgctgtgcatctccatcatgatcgaggaggtcatgcgcagccggtggtcccgcaagatgctcatgaccggcaccctggccgtgttcctgctcctgatcatggggcagctgacctggaacgacctcatccggctgtgcatcatggtgggcgccaacgcgagcgaccgcatggggatgggcacgacctacctggccctcatggccaccttcaagatgcgcccgatgttcgccgtcggcctgctgttccggcgcctcacctcccgggaggtgctgctgctcacgatcgggctgagcctggtcgcctccgtggagctccccaacagcctggaggagctgggcgacgggctcgcgatgggcatcatgatcctgaagctgctcaccgacttccagtcccaccagctgtgggccaccctgctcagcctgaccttcatcaagacgaccctgtccctccactacgcctggaagaccatggccatggtgctgagcatcgtctccctgttccccctctgcctgagcaccacgtcccagaagaccacctggctgcccgtgctcctgggcagcctggggtgcaagccgctcaccatgttcctgatcgcggagaacaagatctggggccgcaagtcctggcccctgaacgaggggatcatggccgtgggcgtcgtgagcatcctcctgagctccctgctcaagaacgacgtgcccctggccgggcccctgatcgccggcggcatgctcatcgcctgctacgtcatcagcgggtccagcgcggacctgtccctggagaaggccgccgaggtgagctgggaggaggaggccgagcactccggcgccagccacaacatcctcgtggaggtccaggacgacgggacgatgaagatcaaggacgaggagcgggacgacaccctgaccatcctgctcaaggcgaccctgctggccgtgtccggcgtgtacccgctcagcatccccgccaccctgttcctgtggtacttctggcagaagaagaagcagcgctccggggtcctgtgggacacgcccagcccgcccgaggtggagcgggccgtgctcgacgacggcatctaccgcatcatgcagcggggcctgctggggcgctcccaggtcggcgtgggggtgttccaggagaacgtcttccacaccatgtggcacgtgacccggggcgccgtgctcatgtaccaggggaagcgcctggagcccagctgggcgtccgtcaagaaggacctgatcagctacggcggcgggtggcggctccagggctcctggaacaccggggaggaggtccaggtgatcgccgtcgagcccggcaagaaccccaagaacgtgcagacggcccccgggaccttcaagacccccgagggcgaggtgggcgccatcgccctggacttcaagcccgggaccagcggctcccccatcgtcaaccgcgaggggaagatcgtgggcctgtacggcaacggggtggtcacgaccagcggcacctacgtgagcgcgatcgcccaggccaaggcctcccaggaggggccgctccccgagatcgaggacgaggtgttccggaagcgcaacctgaccatcatggacctgcaccccggcagcgggaagacgcggcgctacctcccggcgatcgtccgggaggccatcaagcgcaagctgcggaccctgatcctcgcccccacccgcgtggtggcctccgagatggccgaggcgctgaagggcatgcccatccgctaccagaccacggccgtcaagagcgagcacaccggcaaggagatcgtggacctgatgtgccacgccaccttcaccatgcggctcctgtcccccgtgcgcgtcccgaactacaacatgatcatcatggacgaggcccacttcacggaccccagctccatcgccgcgcgggggtacatcagcacccgcgtgggcatgggggaggccgccgccatcttcatgaccgccacgccgcccggctccgtggaggcgttcccgcagagcaacgccgtcatccaggacgaggagcgggacatccccgagcgctcctggaacagcgggtacgagtggatcacggacttccccggcaagaccgtgtggttcgtgccctccatcaagagcggcaacgacatcgccaactgcctgcggaagaacgggaagcgcgtcatccagctctcccggaagaccttcgacaccgagtaccagaagacgaagaacaacgactgggactacgtggtgaccaccgacatcagcgagatgggcgccaacttccgcgcggaccgggtcatcgacccgcgccggtgcctgaagcccgtgatcctgaaggacgggcccgagcgcgtcatcctcgccggccccatgccggtgaccgtggcctccgccgcccagcggcgcgggcggatcggccgcaaccacaacaaggagggcgaccagtacatctacatggggcagcccctgaacaacgacgaggaccacgcgcactggacggaggccaagatgctgctcgacaacatcaacacccccgagggcatcatccccgccctgttcgagccggagcgggagaagtccgccgccatcgacggggagtaccgcctgcgcggcgaggcgcggaagaccttcgtcgagctcatgcgccgcggggacctgcccgtgtggctgtcctacaaggtggccagcgagggcttccagtacagcgaccgccggtggtgcttcgacggcgagcgcaacaaccaggtcctcgaggagaacatggacgtggagatctggaccaaggagggggagcggaagaagctgcgcccccggtggctggacgcccgcacgtactccgaccccctcgccctgcgggagttcaaggagttcgccgcgggccgccggagcgtgtccggggacctgatcctcgagatcggcaagctgccgcagcacctgacccagcgcgcccagaacgccctcgacaacctggtcatgctgcacaacagcgagcagggcgggcgggcctaccgccacgcgatggaggagctccccgacaccatcgagaccctgatgctgctcgccctgatcgccgtgctgacgggcggggtgaccctcttcttcctgtccggccgggggctgggcaagaccagcatcggcctcctgtgcgtcatggcctccagcgtgctgctctggatggcctccgtggagccccactggatcgcggccagcatcatcctggagttcttcctgatggtcctcctgatccccgagccggaccgccagcggacgccccaggacaaccagctggcctacgtggtgatcgggctcctgttcatgatcctgaccgtcgccgccaacgagatgggcctcctggagacgaccaagaaggacctggggatcggccacgtggcggtggagaaccaccaccacgccaccatgctcgacgtcgacctgcaccccgcctccgcctggaccctgtacgccgtggcgacgaccatcatcaccccgatgatgcgccacaccatcgagaacacgaccgccaacatcagcctcaccgccatcgccaaccaggccgcgatcctgatggggctggacaagggctggcccatctccaagatggacatcggcgtgcccctcctggccctggggtgctacagccaggtcaaccccctcaccctgacggccgccgtgctgatgctcgtggcgcactacgccatcatcggcccggggctgcaggccaaggccacccgggaggcccagaagcgcaccgcggccggcatcatgaagaaccccaccgtcgacgggatcgtggccatcgacctggaccccgtggtctacgacgccaagttcgagaagcagctcggccagatcatgctgctgatcctctgcacgtcccagatcctgctgatgcgcaccacctgggccctctgcgagagcatcaccctggcgacgggccccctgaccaccctctgggaggggtccccgggcaagttctggaacaccacgatcgccgtgagcatggccaacatcttccgggggtcctacctggccggcgccggcctggcgttcagcctcatgaagtccctcgggggcgggcgccgggggaccggggcccagggcgagaccctgggcgagaagtggaagcgccagctcaaccagctgtccaagagcgagttcaacatctacaagcggtccgggatcatggaggtggaccgcagcgaggccaaggagggcctgaagcgcggggagaccacgcgccacgccgtctcccggggcaccgcgaagctgcgctggttcgtggagcggaacctcgtgaagcccgaggggaaggtcatcgacctgggctgcggccgcgggggctggagctactactgcgccgggctgaagaaggtgaccgaggtgaagggctacaccaagggcgggcccggccacgaggagcccatcccgatggccacgtacgggtggaacctcgtcaagctgcactccggcaaggacgtgttcttcacgccgcccgagaagtgcgacaccctgctctgcgacatcggggagagctcccccaacccgaccatcgaggagggccggacgctgcgcgtgctgaagatggtcgagccctggctccgggggaaccagttctgcatcaagatcctgaacccctacatgcccagcgtggtggagaccctggagcagatgcagcgcaagcacggcggcatgctcgtccggaacccgctgtcccgcaacagcacccacgagatgtactgggtgtcctgcgggaccggcaacatcgtgagcgccgtcaacatgacctcccggatgctgctcaaccgcttcacgatggcccaccgcaagcccacctacgagcgggacgtggacctgggggcgggcacccgccacgtggccgtcgagcccgaggtggccaacctggacatcatcggccagcggatcgagaacatcaagcacgagcacaagagcacctggcactacgacgaggacaacccctacaagacgtgggcctaccacgggtcctacgaggtcaagccgagcggctccgccagcagcatggtgaacggggtggtcaagctcctgaccaagccctgggacgtgatccccatggtgacccagatcgcgatgaccgacacgacccccttcggccagcagcgcgtcttcaaggagaaggtggacacccggaccccgaaggccaagcgcgggacggcccagatcatggaggtgaccgcccggtggctgtggggcttcctctcccgcaacaagaagccccggatctgcacccgcgaggagttcacccggaaggtccgcagcaacgccgcgatcggcgccgtgttcgtggacgagaaccagtggaactccgccaaggaggccgtcgaggacgagcggttctgggacctggtgcagaaggagcgcgagctgcacaagcaggggaagtgcgcgacgtgcgtgtacaacatgatgggcaagcgggagaagaagctcggggagttcggcaaggccaaggggagccgcgccatctggtacatgtggctgggcgcccggttcctggagttcgaggccctcggcttcatgaacgaggaccactggttctcccgcgagaacagcctgtccggggtcgagggcgaggggctgcacaagctcggctacatcctgcgggacatcagcaagatccccgggggcaacatgtacgcggacgacaccgccggctgggacacccgcatcaccgaggacgacctgcagaacgaggccaagatcacggacatcatggagccggagcacgccctcctggccacctccatcttcaagctgacctaccagaacaaggtggtgcgggtccagcgccccgcgaagaacgggaccgtgatggacgtgatcagccgccgggaccagcgcggctccgggcaggtcggcacgtacggcctcaacaccttcaccaacatggaggcccagctgatccggcagatggagagcgaggggatcttcctgccctccgagctcgagacccccaacctggccgagcgcgtgctggactggctcgagaagcacggcgtggagcggctgaagcgcatggccatcagcggggacgactgcgtcgtgaagccgatcgacgaccggttcgccacggcgctgaccgccctcaacgacatgggcaaggtgcgcaaggacatcccccagtgggagccctccaaggggtggaacgactggcagcaggtccccttctgcagccaccacttccaccagctgatcatgaaggacggccgggagatcgtggtgccgtgccgcaacgaggacgagctggtcggccgggcccgcgtgtcccagggggccggctggagcctccgggagaccgcctgcctgggcaagagctacgcgcagatgtggcagctgatgtacttccaccgccgggacctccgcctggccgccaacgccatctgctccgcggtgcccgtcgactgggtgcccaccagccggacgacctggtccatccacgcccaccaccagtggatgaccaccgaggacatgctgagcgtgtggaaccgcgtctggatcgaggagaacccctggatggaggacaagacgcacgtgtccagctggggcgacgtgccgtacctcgggaagcgggaggaccagtggtgcggctccctgatcggcctgaccgcccgcgccacctgggccagcaacatccaggtcgcgatcaaccaggtgcgccggctcatcgggaacgagaactacctggactacatgacctccatgaagcgcttcaagaacgagggcgaccccgagggggccctgtggtga

SEQ ID NO: 8497 - RNA, 9879 nt, synthetic construct
  misc_feature 1..9879: note = derived and/or modified CDS sequence (opt1) from DENV-1__GQ199788__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagaccagcgcgggggtgaacatgtgcaccctcatcgccatggacctgggcgagttctgcgaggacacgatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagaccgtccagtacgagaacctgaagtacagcgtgatcgtgaccgtccacacgggcgaccagcaccaggtggggaacgagtccaccgagcacggcaccaccgcgaccatcacgccccaggcccccagcaccgagatccagctgaccgactacggggccctcaccctggactgcagcccccggacgggcctggacttcaacgagatggtcctcctgaccatgaaggagaagtcctggctggtgcacaagcagtggttcctcgacctgccgctgccctggaccagcggggcctccaccagccaggagacgtggaaccggaaggacctcctggtgaccttcaagaccgcccacgcgaagaagcaggaggtcgtggtgctgggctcccaggagggcgccatgcacaccgccctcacgggggccaccgagatccagaccagcggcaccacgaccatcttcgccgggcacctgaagtgccgcctgaagatggacaagctcaccctgaagggcatgtcctacgtcatgtgcaccgggagcttcaagctggagaaggaggtggcggagacgcagcacggcaccgtgctcgtccagatcaagtacgagggcaccgacgccccctgcaagatccccttctccacccaggacgagaagggggtgacgcagaacggccggctgatcaccgccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacacggcctgggacttcgggagcatcggcggcgtgttcacctccgtcgggaagctggtgcaccagatcttcggcaccgcctacggggtgctgttcagcggcgtctcctggaccatgaagatcgggatcggcgtgctcctgacgtggctgggcctcaacagccgctccaccagcctgtccatgacctgcatcgccgtggggctggtcaccctctacctgggcgtgatggtgcaggccgacagcgggtgcgtcatcaactggaagggccgggagctgaagtgcgggagcggcatcttcgtgacgaacgaggtgcacacctggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagttcaccgtggtggtcggggacgtggcgggcatcctggcccaggggaagaagatgatccggccccagcccatggagtacaagtactcctggaagtcctggggcaaggccaagatcatcggcgccgacgtgcagaacacgaccttcatcatcgacgggcccaacaccccggagtgccccgacgaccagcgcgcgtggaacatctgggaggtcgaggactacggcttcgggatcttcaccacgaacatctggctcaagctgcgggactcctacacccaggtgtgcgaccaccgcctgatgagcgccgccatcaaggactccaaggccgtgcacgccgacatgggctactggatcgagagcgagaagaacgagacctggaagctcgcgcgggcctccttcatcgaggtcaagacctgcatctggcccaagagccacacgctgtggtccaacggcgtgctggagagcgagatgatcatccccaagatctacgggggcccgatctcccagcacaactaccgccccgggtacttcacccagaccgccggcccctggcacctcgggaagctggagctggacttcgacctctgcgagggcaccacggtggtcgtggacgagcactgcggcaaccgggggccgagcctgcgcaccaccaccgtgacgggcaagatcatccacgagtggtgctgccggtcctgcaccctgccgcccctgcgcttcaagggggaggacggctgctggtacgggatggagatccggcccgtcaaggagaaggaggagaacctggtcaagagcatggtgagcgccggctccggcgaggtcgacagcttctccctggggctcctgtgcatcagcatcatgatcgaggaggtgatgcgctcccggtggagccgcaagatgctgatgaccggcaccctcgccgtgttcttcctgctgatcatggggcagctcacgtggaacgacctgatccggctgtgcatcatggtcggcgcgaacgcctccgaccgcatggggatgggcaccacctacctcgccctgatggccaccttcaagatgcgcccgatgttcgccgtgggcctcctgttccggcgcctgacgagccgggaggtgctgctcctgaccatcgggctgtccctcgtcgcgagcgtggagctgcccaactccctggaggagctcggcgacgggctggccatgggcatcatgatcctgaagctcctgaccgacttccagagccaccagctgtgggccaccctcctgtccctgacgttcatcaagaccaccttcagcctccactacgcctggaagaccatggcgatggtcctgtccatcgtgagcctgttccccctctgcctgtccacgaccagccagaagaccacctggctgcccgtgctcctgggctccctggggtgcaagccgctcacgatgttcctgatcgccgagaacaagatctggggccgcaagagctggcccctgaacgaggggatcatggccgtcggcatcgtgagcatcctcctgtccagcctgctcaagaacgacgtgcccctggccgggcccctgatcgccggcggcatgctcatcgcgtgctacgtcatctccgggagctccgccgacctgagcctggagaaggccgccgaggtgtcctgggaggaggaggccgagcacagcggcgcgtcccacaacatcctcgtggaggtccaggacgacgggaccatgaagatcaaggacgaggagcgggacgacaccctgaccatcctgctcaaggccaccctgctggccgtgagcggcgtgtacccgctctccatccccgccacgctgttcgtctggtacttctggcagaagaagaagcagcgcagcggggtgctgtgggacacccccagcccgcccgaggtggagcgggccgtcctcgacgacggcatctaccgcatcatgcagcggggcctgctggggcgcagccaggtgggcgtgggggtcttccaggagaacgtgttccacaccatgtggcacgtgacccggggcgcggtcctgatgtaccaggggaagcgcctcgagccctcctgggccagcgtgaagaaggacctgatctcctacggcggcgggtggcggctgcagggcagctggaacacgggggaggaggtgcaggtcatcgccgtggagcccggcaagaaccccaagaacgtgcagaccgcccccgggaccttcaagacctccgagggcgaggtcggcgccatcgcgctcgacttcaagcccgggacgagcggcagccccatcgtgaaccgcgaggggaagatcgtgggcctgtacggcaacggggtcgtgaccacctccggcacctacgtgagcgccatcgcccaggccaaggcgtcccaggaggggcccctgccggagatcgaggacgaggtcttccggaagcgcaacctcacgatcatggacctgcaccccggcagcgggaagacccggcgctacctgcccgccatcgtgcgggaggccatcaagcgcaagctccggaccctgatcctggccccgacccgcgtggtcgcctccgagatggcggaggccctcaagggcatgcccatccgctaccagacgaccgccgtcaagagcgagcacaccggcaaggagatcgtggacctgatgtgccacgccaccttcacgatgcggctgctctcccccgtccgcgtgcccaactacaacatgatcatcatggacgaggcccacttcaccgacccgagctccatcgcggcccgggggtacatcagcacccgcgtgggcatgggggaggccgccgccatcttcatgaccgcgacgccgcccggctccgtcgaggccttcccccagagcaacgccgtgatccaggacgaggagcgggacatcccggagcgctcctggaacagcgggtacgagtggatcaccgacttccccggcaagaccgtgtggttcgtcccctccatcaagagcggcaacgacatcgccaactgcctgcggaagaacgggaagcgcgtgatccagctgtcccggaagaccttcgacacggagtaccagaagaccaagaacaacgactgggactacgtggtcaccaccgacatcagcgagatgggcgcgaacttccgcgccgaccgggtgatcgacccccgccggtgcctcaagccggtgatcctgaaggacgggcccgagcgcgtcatcctggccggccccatgcccgtgacggtcgcctccgccgcgcagcggcgcgggcggatcggccgcaaccacaacaaggagggcgaccagtacatctacatggggcagccgctcaacaacgacgaggaccacgcccactggaccgaggccaagatgctgctggacaacatcaacacccccgagggcatcatccccgccctcttcgagcccgagcgggagaagtccgccgcgatcgacggggagtaccgcctgcgcggcgaggcccggaagaccttcgtggagctgatgcgccgcggggacctcccggtgtggctgagctacaaggtcgcctccgagggcttccagtacagcgaccgccggtggtgcttcgacggcgagcgcaacaaccaggtgctggaggagaacatggacgtggagatctggacgaaggagggggagcggaagaagctccgcccccggtggctggacgcccgcacctactccgaccccctggccctccgggagttcaaggagttcgcggccggccgccggagcgtctccggggacctgatcctggagatcggcaagctcccccagcacctgacccagcgcgcccagaacgccctggacaacctcgtgatgctgcacaacagcgagcagggcgggcgggcgtaccgccacgccatggaggagctgccggacaccatcgagacgctcatgctgctggccctcatcgccgtgctgaccggcggggtcaccctgttcttcctctccggccgggggctgggcaagaccagcatcggcctgctctgcgtgatggcctccagcgtgctgctgtggatggcgtccgtcgagccccactggatcgccgccagcatcatcctcgagttcttcctgatggtgctgctcatccccgagcccgaccgccagcggaccccgcaggacaaccagctggcctacgtggtcatcgggctcctcttcatgatcctgacggtggccgcgaacgagatgggcctgctcgagaccaccaagaaggacctggggatcggccacgtggccgtcgagaaccaccaccacgccgccatgctggacgtggacctccaccccgcctccgcgtggaccctgtacgccgtggccacgaccatcatcacccccatgatgcgccacaccatcgagaacacgaccgccaacatcagcctgaccgccatcgcgaaccaggccgccatcctcatggggctggacaagggctggccgatctccaagatggacatcggcgtccccctgctcgccctggggtgctacagccaggtgaaccccctgaccctcacggcggccgtgctgatgctggtcgcccactacgccatcatcggccccgggctccaggccaaggcgacccgggaggcccagaagcgcaccgccgccggcatcatgaagaacccgaccgtggacgggatcgtggccatcgacctggaccccgtcgtgtacgacgcgaagttcgagaagcagctgggccagatcatgctcctgatcctgtgcacgtcccagatcctcctgatgcgcaccacctgggccctgtgcgagagcatcaccctcgccacgggccccctgaccaccctgtgggaggggtcccccggcaagttctggaacaccacgatcgccgtgagcatggccaacatcttccgggggagctacctcgcgggcgccggcctggccttctccctgatgaagtccctcgggggcgggcgccggggcaccggggcccagggcgagaccctgggcgagaagtggaagcgccagctgaaccagctctccaagagcgagttcaacacctacaagcggtccgggatcatggaggtcgaccgcagcgaggcgaaggagggcctgaagcgcggggagacgaccaagcacgccgtgtcccgcggcaccgccaagctgcggtggttcgtggagcgcaacctcgtcaagccggaggggaaggtgatcgacctgggctgcggccgcggcgggtggagctactactgcgccgggctgaagaaggtgaccgaggtcaaggggtacacgaagggcgggcccggccacgaggagcccatccccatggccacctacgggtggaacctggtgaagctccactccggcaaggacgtgttcttcatcccgcccgagaagtgcgacaccctgctgtgcgacatcggggagagctcccccaaccccaccatcgaggagggccgcacgctccgggtcctgaagatggtggagccgtggctgcgcgggaaccagttctgcatcaagatcctcaacccctacatgcccagcgtggtcgagaccctggagcagatgcagcggaagcacggcggcatgctggtgcgcaaccccctctcccggaacagcacccacgagatgtactgggtgtcctgcgggaccggcaacatcgtcagcgcggtgaacatgacctcccgcatgctgctgaaccggttcacgatggcccaccgcaagccgacctacgagcgcgacgtggacctcggggccggcacccggcacgtcgccgtggagcccgaggtggccaacctggacatcatcggccagcgcatcgagaacatcaagcacgagcacaagagcacctggcactacgacgaggacaacccctacaagacgtgggcgtaccacgggtcctacgaggtcaagcccagcggcagcgcctccagcatggtgaacggggtcgtgaagctgctcaccaagccgtgggacgtgatccccatggtcacccagatcgccatgaccgacacgacccccttcggccagcagcgggtgttcaaggagaaggtggacacccgcacccccaaggccaagcgggggacggcccagatcatggaggtcaccgcgaagtggctgtggggcttcctgtcccgcaacaagaagccgcggatctgcacccgcgaggagttcacccggaaggtgcgcagcaacgccgccatcggcgccgtgttcgtcgacgagaaccagtggaactccgcgaaggaggccgtggaggacgagcggttctgggacctcgtgcaccgcgagcgggagctgcacaagcaggggaagtgcgccacgtgcgtctacaacatgatgggcaagcgcgagaagaagctgggggagttcggcaaggccaaggggagccgggccatctggtacatgtggctcggcgcgcgcttcctggagttcgaggccctgggcttcatgaacgaggaccactggttctcccgggagaacagcctctccggggtggagggcgaggggctgcacaagctgggctacatcctccgcgacatcagcaagatccccgggggcaacatgtacgccgacgacaccgccggctgggacacccggatcaccgaggacgacctgcagaacgaggccaagatcacggacatcatggagcccgagcacgcgctgctcgccaagtccatcttcaagctgacctaccagaacaaggtggtccgcgtgcagcggccggccaagaacgggaccgtgatggacgtcatcagccgccgcgaccagcggggctccggccaggtgggcacctacggcctgaacacgttcaccaacatggaggcccagctcatccgccagatggagagcgaggggatcttctcccccagcgagctggagacccccaacctggcccggcgcgtgctcgactggctggagaagcacggcgtcgagcggctgaagcgcatggcgatctccggggacgactgcgtggtgaagcccatcgacgaccggttcgccaccgccctcacggccctgaacgacatgggcaaggtccgcaaggacatcccgcagtgggagcccagcaaggggtggaacgactggcagcaggtccccttctgcagccaccacttccaccagctgatcatgaaggacggccgggagatcgtggtcccctgccgcaaccaggacgagctcgtgggccgggcccgcgtgtcccagggggcgggctggagcctgcgggagaccgcctgcctggggaagtcctacgcccagatgtggcagctcatgtacttccaccgccgggacctgcgcctggccgcgaacgccatctgcagcgccgtcccggtggactgggtgcccacctcccggaccacgtggagcatccacgcccaccaccagtggatgaccaccgaggacatgctctccgtctggaaccgcgtgtggatcgaggagaacccctggatggaggacaagacccacatcagctcctggggcgacgtgccctacctggggaagcgggaggaccagtggtgcggcagcctgatcggcctcacggcccgcgcgacctgggccaccaacatccaggtcgccatcaaccaggtgcgccggctgatcgggaacgagaactacctggactacatgacctccatgaagcgcttcaagaacgagagcgacccggagggcgccctctggtga

SEQ ID NO: 8498 - RNA, 9879 nt, synthetic construct
  misc_feature 1..9879: note = derived and/or modified CDS sequence (opt1) from DENV-1__GQ199789__SS-prME
  source 1..9879: mol_type = other RNA
agcgtgaccatgctgctcatgctgatgcccaccgccctggccttccacctcacgacccggggcggggagccccacatgatcgtgtccaagcaggagcggggcaagagcctgctgttcaagacctccgccggggtgaacatgtgcaccctcatcgccatggacctgggcgagttctgcgaggacaccatgacctacaagtgcccccggatcaccgaggccgagcccgacgacgtggactgctggtgcaacgccaccgacacgtgggtgacctacgggacctgcagccagaccggcgagcaccggcgcgacaagcggtccgtggccctggcgccccacgtgggcctcgggctggagacgcgcaccgagacctggatgagctccgagggcgcctggaagcagatccagaaggtcgagacctgggccctgcggcaccccgggttcacggtgatcgccctcttcctggcgcacgccatcggcaccagcatcacccagaaggggatcatcttcatcctgctcatgctggtgaccccctccatggccatgcgctgcgtcggcatcggcagccgggacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcgcaagctgtgcatcgaggccaagatctccaacaccaccacggacagccggtgcccgacccagggcgaggccaccctcgtggaggagcaggacgccaacttcgtctgccgccggaccttcgtggaccgcggctgggggaacggctgcgggctgttcggcaaggggtccctgatcacgtgcgccaagttcaagtgcgtgaccaagctcgagggcaagaccgtccagcacgagaacctgaagtacagcgtgatcgtgaccgtccacacgggcgaccagcaccaggtggggaacgagtccaccgagcacggcaccaccgcgaccatcacgccccaggcccccagcaccgagatccagctgaccgactacggggccctcaccctggactgcagcccccggacgggcctggacttcaacgagatggtcctcctgaccatgaaggagaagtcctggctggtgcacaagcagtggttcctcgacctgccgctgccctggaccagcggggcctccaccagccaggagacgtggaaccgcaaggacctcctggtgaccttcaagaccgcccacgcgaagaagcaggaggtcgtggtgctgggctcccaggagggcgccatgcacaccgccctcacgggggccaccgagatccagaccagcggcaccacgaccatcttcgccgggcacctgaagtgccggctgaagatggacaagctcaccctgaagggcacctcctacgtcatgtgcacggggagcttcaagctggagaaggaggtggcggagacccagcacggcaccgtgctcgtccagatcaagtacgagggcaccgacgccccctgcaagatccccttctccacgcaggacgagaagggggtgacccagaacggccgcctgatcaccgccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccacggcccgcggggcccgccggatggcgatcctcggcgacaccgcctgggacttcgggagcatcggcggcgtgttcacctccgtcgggaagctggtgcaccagatcttcggcaccgcctacggggtgctgttcagcggcgtctcctggacgatgaagatcgggatcggcgtgctcctgacctggctgggcctcaacagccgctccaccagcctgtccatgacctgcatcgccgtggggctggtcacgctctacctgggcgtgatggtgcaggccgacagcgggtgcgtcatcaactggaagggccgcgagctgaagtgcgggagcggcatcttcgtgaccaacgaggtgcacacctggaccgagcagtacaagttccaggcggactccccgaagcggctcagcgccgccatcggcaaggcctgggaggagggggtctgcggcatccgctccgccacccggctggagaacatcatgtggaagcagatcagcaacgagctgaaccacatcctcctggagaacgacatgaagttcacggtggtggtcggggacgtggcgggcatcctggcccaggggaagaagatgatccgcccccagcccatggagtacaagtactcctggaagtcctggggcaaggccaagatcatcggcgccgacgtgcagaacaccaccttcatcatcgacgggcccaacaccccggagtgccccgacgaccagcgggcgtggaacatctgggaggtcgaggactacggcttcgggatcttcacgaccaacatctggctcaagctgcgcgactcctacacccaggtgtgcgaccaccggctgatgagcgccgccatcaaggactccaaggccgtgcacgccgacatgggctactggatcgagagcgagaagaacgagacctggaagctcgcgcgcgcctccttcatcgaggtcaagacgtgcatctggcccaagagccacaccctgtggtccaacggcgtgctggagagcgagatgatcatccccaagatctacgggggcccgacctcccagcacaactaccggcccgggtacttcacccagacggccggcccctggcacctcgggaagctggagctggacttcgacctctgcgagggcaccaccgtggtcgtggacgagcactgcggcaaccgcgggccgagcctgcggaccacgaccgtgaccggcaagatcatccacgagtggtgctgccgctcctgcaccctgccgcccctgcggttcaagggggaggacggctgctggtacgggatggagatccgccccgtcaaggagaaggaggagaacctggtcaagagcatggtgagcgccggctccggcgaggtcgacagcttctccctggggctcctgtgcatcagcatcatgatcgaggaggtgatgcggtcccgctggagccggaagatgctgatgacgggcaccctcgccgtgttcttcctgctgatcatggggcagctcacctggaacgacctgatccgcctgtgcatcatggtcggcgcgaacgcctccgaccggatggggatgggcaccacgtacctcgccctgatggccaccttcaagatgcgcccgatgttcgccgtggggctcctgttccgccggctgaccagccgcgaggtgctgctcctgaccatcgggctgtccctcgtcgcgagcgtggagctgcccaactccctggaggagctcggcgacgggctggccatgggcatcatgatcctgaagctcctgacggacttccagagccaccagctgtgggccaccctcctgtccctgaccttcatcaagaccacgttcagcctccactacgcctggaagaccatggcgatggtcctgtccatcgtgagcctgttccccctctgcctgtccaccaccagccagaagacgacctggctgcccgtgctcctgggctccctggggtgcaagccgctcaccatgttcctgatcgccgagaacaagatctggggccgcaagagctggcccctgaacgaggggatcatggccgtcggcatcgtgagcatcctcctgtccagcctgctcaagaacgacgtgcccctggccgggcccctgatcgccggcggcatgctcatcgcgtgctacgtcatctccgggagctccgccgacctgagcctggagaaggccgccgaggtgtcctgggaggaggaggccgagcacagcggcgcgtcccacaacatcctcgtggaggtccaggacgacgggaccatgaagatcaaggacgaggagcgcgacgacaccctgacgatcctgctcaaggccaccctgctggccgtgagcggcgtgtacccgctctccatccccgccaccctgttcgtctggtacttctggcagaagaagaagcagcggagcggggtgctgtgggacacccccagcccgcccgaggtggagcgcgccgtcctcgacgacggcatctaccggatcatgcagcgcggcctgctggggcggagccaggtgggcgtgggggtcttccaggagaacgtgttccacacgatgtggcacgtgacccgcggcgcggtcctgatgtaccaggggaagcggctcgagccctcctgggccagcgtgaagaaggacctgatctcctacggcggcgggtggcgcctgcagggcagctggaacaccggggaggaggtgcaggtcatcgccgtggagcccggcaagaaccccaagaacgtgcagaccgcccccgggacgttcaagacctccgagggcgaggtcggcgccatcgcgctcgacttcaagcccgggaccagcggcagccccatcgtgaaccgggaggggaagatcgtgggcctgtacggcaacggggtcgtgaccacgtccggcacctacgtgagcgccatcgcccaggccaaggcgtcccaggaggggcccctgccggagatcgaggacgaggtcttccgcaagcggaacctcaccatcatggacctgcaccccggcagcgggaagacccgccggtacctgcccgccatcgtgcgcgaggccatcaagcggaagctccgcacgctgatcctggccccgacccgggtggtcgcctccgagatggcggaggccctcaagggcatgcccatccgctaccagaccaccgccgtgaagggcgagcacacggggaaggagatcgtggacctgatgtgccacgccaccttcaccatgcgcctgctcagccccgtccgggtgcccaactacaacatgatcatcatggacgaggcccacttcaccgacccgtccagcatcgcggcccgcggctacatctccacgcgggtggggatgggcgaggccgccgccatcttcatgaccgcgacgccgcccgggagcgtcgaggccttcccccagtccaacgccgtgatccaggacgaggagcgcgacatcccggagcggagctggaactccggctacgagtggatcaccgacttccccggcaagacggtgtggttcgtccccagcatcaagtccgggaacgacatcgccaactgcctgcgcaagaacggcaagcgggtgatccagctgagccgcaagaccttcgacaccgagtaccagaagaccaagaacaacgactgggactacgtggtcacgaccgacatctccgagatgggggcgaacttccgggccgaccgcgtgatcgacccccggcgctgcctcaagccggtgatcctgaaggacggccccgagcgggtcatcctggccgggcccatgcccgtgaccgtcgccagcgccgcgcagcgccggggccgcatcggccggaaccacaacaaggagggggaccagtacatctacatgggccagccgctcaacaacgacgaggaccacgcccactggaccgaggccaagatgctgctggacaacatcaacacgcccgaggggatcatccccgccctcttcgagcccgagcgcgagaagtccgccgcgatcgacggcgagtaccggctgcgcggggaggcccgcaagaccttcgtggagctgatgcggcgcggcgacctcccggtgtggctgagctacaaggtcgccagcgagggcttccagtactccgaccggcgctggtgcttcgacggggagcggaacaaccaggtgctggaggagaacatggacgtggagatctggaccaaggagggcgagcgcaagaagctccggccccgctggctggacgcccggacctacagcgaccccctggccctccgcgagttcaaggagttcgcggccgggcggcgctccgtcagcggcgacctgatcctggagatcggcaagctcccccagcacctgacgcagcgggcccagaacgccctggacaacctcgtgatgctgcacaactccgagcagggcgggcgcgcgtaccggcacgccatggaggagctgccggacaccatcgagaccctcatgctgctggccctcatcgccgtgctgaccgggggcgtcaccctgttcttcctcagcgggcgcggcctgggcaagacgtccatcgggctgctctgcgtgatggccagctccgcgctgctgtggatggccagcgtggagccccactggatcgccgcctccatcatcctcgagttcttcctgatggtcctgctcatccccgagcccgaccggcagcgcaccccgcaggacaaccagctggcctacgtggtgatcggcctcctcttcatgatcctgaccgtcgcggccaacgagatggggctgctcgagaccacgaagaaggacctgggcatcgggcacgtggccgtggagaaccaccaccacgccgccatgctggacgtcgacctccaccccgcgagcgcctggaccctgtacgccgtggccaccaccatcatcacgcccatgatgcggcacaccatcgagaacaccaccgccaacatctccctgacggcgatcgccaaccaggccgccatcctcatgggcctggacaagggctggccgatcagcaagatggacatcggggtgcccctgctcgcgctgggctgctactcccaggtcaaccccctgaccctcaccgccgccgtgctgatgctggtggcccactacgccatcatcgggcccggcctccaggcgaaggccacccgcgaggcccagaagcggacggccgccgggatcatgaagaacccgaccgtcgacggcatcgtggcgatcgacctggaccccgtggtctacgacgccaagttcgagaagcagctgggccagatcatgctcctggtgctgtgcaccagccagatcctcctgatgcgcaccacgtgggccctgtgcgagtccatcaccctcgccaccgggcccctgaccacgctgtgggagggcagccccgggaagttctggaacaccaccatcgccgtgtccatggcgaacatcttccgcggcagctacctcgccggcgccgggctggccttcagcctgatgaagtccctcggcgggggccggcgcgggaccggcgcgcagggcgagacgctgggggagaagtggaagcggcagctgaaccagctcagcaagtccgagttcaacacctacaagcgcagcggcatcatggaggtcgaccggtccgaggccaaggaggggctgaagcgcggcgagaccaccaagcacgccgtgagccgggggacggccaagctgcgctggttcgtggagcggaacctcgtcaagccggagggcaaggtgatcgacctgggctgcgggcgcggcgggtggtcctactactgcgccggcctgaagaaggtgaccgaggtcaaggggtacaccaagggcggccccgggcacgaggagcccatccccatggcgacctacggctggaacctggtgaagctccacagcgggaaggacgtgttcttcatcccgcccgagaagtgcgacacgctgctgtgcgacatcggcgagtccagccccaaccccaccatcgaggaggggcggaccctccgcgtcctgaagatggtggagccgtggctgcggggcaaccagttctgcatcaagatcctcaacccctacatgccctccgtggtcgagaccctggagcagatgcagcgcaagcacggcgggatgctggtgcggaaccccctcagccgcaactccacccacgagatgtactgggtgagctgcggcacggggaacatcgtctccgccgtgaacatgaccagccggatgctgctgaaccgcttcaccatggcccaccggaagccgacctacgagcgcgacgtggacctcggcgccggcacgcgccacgtcgccgtggagcccgaggtggcgaacctggacatcatcgggcagcggatcgagaacatcaagcacgagcacaagtccacctggcactacgacgaggacaacccctacaagacctgggcctaccacggcagctacgaggtcaagccctccgggagcgccagctccatggtgaacggcgtcgtgaagctgctcaccaagccgtgggacgtgatccccatggtcacgcagatcgccatgaccgacaccacccccttcgggcagcagcgcgtgttcaaggagaaggtggacacgcggacccccaaggccaagcgcggcaccgcgcagatcatggaggtcaccgccaagtggctgtggggcttcctgagccggaacaagaagccgcgcatctgcacgcgggaggagttcacccgcaaggtgcggtccaacgccgccatcggggcggtgttcgtcgacgagaaccagtggaacagcgccaaggaggccgtggaggacgagcgcttctgggacctcgtgcaccgggagcgcgagctgcacaagcagggcaagtgcgcgacctgcgtctacaacatgatggggaagcgggagaagaagctgggcgagttcgggaaggccaagggctcccgcgcgatctggtacatgtggctcggcgcccggttcctggagttcgaggccctggggttcatgaacgaggaccactggttcagccgcgagaactccctcagcggcgtggagggggagggcctgcacaagctggggtacatcctccgggacatctccaagatccccggcggcaacatgtacgccgacgacaccgccgggtgggacacgcgcatcaccgaggacgacctgcagaacgaggcgaagatcaccgacatcatggagcccgagcacgccctgctcgccaagagcatcttcaagctgacctaccagaacaaggtggtccgggtgcagcgcccggccaagaacggcacggtgatggacgtcatctcccggcgcgaccagcgcgggagcggccaggtgggcacctacgggctgaacaccttcaccaacatcgaggcccagctcatccggcagatggagtccgaggagatcttcagcccctccgagctggagacgcccaacctggcgggccgcgtgctcgactggctggagaagcacggggtcgagcggctgaagcgcatggccatcagcggcgacgactgcgtggtgaagcccatcgacgaccggttcgccaccgccctcaccgccctgaacgacatggggaaggtccgcaaggacatcccgcagtgggagccctccaagggctggaacgactggcagcaggtccccttctgcagccaccacttccaccagctgatcatgaaggacggccgggagatcgtggtcccctgccgcaaccaggacgagctcgtggggcgggcgcgcgtgagccagggcgccgggtggtccctgcgggagaccgcctgcctgggcaagagctacgcccagatgtggcagctcatgtacttccaccgccgggacctgcgcctggcggccaacgccatctgctccgccgtcccggtggactgggtgcccacgagccggaccacctggtccatccacgcccaccaccagtggatgaccacggaggacatgctcagcgtctggaaccgcgtgtggatcgaggagaacccctggatggaggacaagacccacatctccagctggggcgacgtgccctacctgggcaagcgggaggaccagtggtgcggctccctgatcgggctcaccgcgcgcgccacctgggccaccaacatccaggtcgccatcaaccaggtgcggcgcctgatcggcaacgagaactacctggactacatgacgagcatgaagcgcttcaagaacgagtccgacccggagggggccctctggtga

SEQ ID NO: 8499 - RNA, 9879 nt, synthetic construct
  misc_feature 1..9879: note = derived and/or modified CDS sequence (opt1) from DENV-1__GQ199790__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgcgggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtgacctacgggacctgcagccagaccggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgtgatcggcacctccatcacccagaaggggatcatcttcatcctcctgatgctggtcacgcccagcatggccatgcggtgcgtgggcatcggctcccgcgacttcgtggaggggctcagcggcgccacctgggtcgacgtggtgctggagcacgggtcctgcgtcaccaccatggccaaggacaagcccacgctggacatcgagctcctgaagaccgaggtgaccaaccccgccgtgctgcggaagctctgcatcgaggcgaagatcagcaacaccacgaccgactcccgctgccccacccagggcgaggccaccctgatggaggagcaggacgccaacttcgtctgccggcgcacgttcgtggaccggggctgggggaacggctgcgggctgttcggcaaggggagcctcatcacgtgcgccaagttcaagtgcgtgaccaagctggagggcaagatcgtccagtacgagaacctgaagtactccgtgatcgtgaccgtccacacgggcgaccagcaccaggtggggaacgagagcaccgagcacggcaccaccgccaccatcacgccccaggcgcccacctccgagatccagctcaccgactacggggccctgaccctggactgcagcccccgcacgggcctcgacttcaacgagatggtcctgctgaccatgaaggagaagtcctggctcgtgcacaagcagtggttcctggacctgccgctcccctggaccagcggggccagcacctcccaggagacgtggaaccggcaggacctgctggtgaccttcaagaccgcccacgccaagaagcaggaggtcgtggtgctcggcagccaggagggcgcgatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggccgagacgcagcacggcaccgtgctggtccagatcaagtacgagggcaccgacgcgccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccaccgcccgcggggcccggcgcatggccatcctgggcgacacggcgtgggacttcgggtccatcggcggcgtgttcaccagcgtcgggaagctggtgcaccagatcttcggcaccgcctacggggtcctgttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggccgactccgggtgcgtcatcaactggaagggccgggagctcaagtgcgggagcggcatcttcgtgacgaacgaggtgcacacctggaccgagcagtacaagttccaggccgacagcccgaagcgcctgtccgcggccatcggcaaggcctgggaggagggggtctgcggcatccggagcgccacccgcctggagaacatcatgtggaagcagatctccaacgagctcaaccacatcctgctggagaacgacatgaagttcaccgtggtggtcggggacgtggtgggcatcctcgcccaggggaagaagatgatccggccccagcccatggagcacaagtacagctggaagtcctggggcaaggcgaagatcatcggcgccgacgtccagaacacgaccttcatcatcgacgggcccaacaccccggagtgccccgacgaccagcgcgcctggaacatctgggaggtggaggactacggcttcgggatcttcaccacgaacatctggctgaagctgcgggacagccacacccaggtgtgcgaccaccgcctcatgtccgccgcgatcaaggacagcaaggccgtccacgccgacatgggctactggatcgagtccgagaagaacgagacctggaagctggcccgggccagcttcatcgaggtgaagacctgcatctggcccaagtcccacacgctgtggagcaacggcgtgctcgagtccgagatgatcatccccaagatctacgggggcccgatcagccagcacaactaccgccccgggtacttcacccagaccgcgggcccctggcacctggggaagctggagctcgacttcgacctgtgcgagggcaccacggtcgtggtggacgagcactgcggcaaccgggggccgtccctgcgcaccaccaccgtcacgggcaagatcatccacgagtggtgctgccggagctgcaccctgccgcccctccgcttcaagggggaggacggctgctggtacgggatggagatccggcccgtgaaggagaaggaggagaacctggtgaagtccatggtcagcgccggcagcggcgaggtggactccttcagcctcgggctgctgtgcatctccatcatgatcgaggaggtgatgcgcagccggtggtcccgcaagatgctcatgaccggcaccctggccgtcttcctgctcctgatcatggggcagctgacgtggaacgacctcatccggctgtgcatcatggtgggcgccaacgccagcgaccgcatggggatgggcaccacctacctggcgctcatggccaccttcaagatgcgcccgatgttcgccgtggggctgctgttccggcgcctcacgtcccgggaggtcctgctgctcaccatcgggctgagcctggtggcctccgtcgagctccccaacagcctggaggagctgggcgacgggctcgccatgggcatcatgatcctgaagctgctcaccgacttccagtcccaccagctgtgggcgaccctgctcagcctgacgttcatcaagaccaccctgtccctccactacgcctggaagaccatggccatggtgctgagcatcgtgtccctgttccccctctgcctgagcacgacctcccagaagaccacctggctgcccgtcctcctgggcagcctggggtgcaagccgctcgccatgttcctgatcgcggagaacaagatctggggccgcaagtcctggcccctgaacgaggggatcatggccgtgggcgtggtcagcatcctcctgagctccctgctcaagaacgacgtgcccctggccgggcccctgatcgccggcggcatgctcatcgcctgctacgtgatcagcgggtccagcgcggacctgtccctggagaaggccgccgaggtcagctgggaggaggaggccgagcactccggcgccagccacaacatcctcgtggaggtgcaggacgacgggacgatgaagatcaaggacgaggagcgggacgacaccctgaccatcctgctcaaggcgaccctgctggccgtctccggcgtgtacccgctcagcatccccgccaccctgttcgtgtggtacttctggcagaagaagaagcagcgctccggggtcctgtgggacacgcccagcccgcccgaggtggagcgggccgtgctggacgacggcatctaccgcatcatgcagcggggcctcctggggcgctcccaggtcggcgtgggggtgttccaggagaacgtcttccacaccatgtggcacgtgacccggggcgccgtgctgatgtaccaggggaagcgcctcgagcccagctgggcgtccgtcaagaaggacctgatcagctacggcggcgggtggcggctgcagggctcctggaacaccggggaggaggtccaggtgatcgccgtcgagcccggcaagaaccccaagaacgtgcagacggcccccgggaccttcaagacccccgagggcgaggtgggcgccatcgccctcgacttcaagcccgggaccagcggctcccccatcgtcaaccgcgaggggaagatcgtgggcctgtacggcaacggggtggtcacgaccagcggcacctacgtgagcgcgatcgcccaggccaaggcctcccaggaggggccgctgcccgagatcgaggacgaggtgttccggaagcgcaacctcaccatcatggacctgcaccccggcagcgggaagacgcggcgctacctgccggcgatcgtccgggaggccatcaagcgcaagctccggaccctgatcctggcccccacccgcgtggtggcctccgagatggccgaggcgctcaagggcatgcccatccgctaccagaccacggccgtcaagagcgagcacaccggcaaggagatcgtggacctgatgtgccacgccaccttcaccatgcggctgctctcccccgtgcgcgtcccgaactacaacatgatcatcatggacgaggcccacttcacggaccccagctccatcgccgcgcgggggtacatcagcacccgcgtgggcatgggggaggccgccgccatcttcatgaccgccacgccgcccggctccgtggaggcgttcccgcagagcaacgccgtcatccaggacgaggagcgggacatccccgagcgctcctggaacagcgggtacgagtggatcacggacttccccggcaagaccgtgtggttcgtgccctccatcaagagcggcaacgacatcgccaactgcctgcggaagaacgggaagcgcgtcatccagctgtcccggaagaccttcgacaccgagtaccagaagacgaagaacaacgactgggactacgtggtgaccaccgacatcagcgagatgggcgccaacttccgcgcggaccgggtcatcgacccgcgccggtgcctcaagcccgtgatcctgaaggacgggcccgagcgcgtcatcctggccggccccatgccggtgaccgtggcctccgccgcccagcggcgcgggcggatcggccgcaaccacaacaaggagggcgaccagtacatctacatggggcagcccctcaacaacgacgaggaccacgcgcactggacggaggccaagatgctgctggacaacatcaacacccccgagggcatcatccccgccctcttcgagccggagcgggagaagtccgccgccatcgacggggagtaccgcctgcgcggcgaggcgcggaagaccttcgtcgagctgatgcgccgcggggacctccccgtgtggctgtcctacaaggtggccagcgagggcttccagtacagcgaccgccggtggtgcttcgacggcgagcgcaacaaccaggtcctggaggagaacatggacgtggagatctggaccaaggagggggagcggaagaagctccgcccccggtggctggacgcccgcacgtactccgaccccctggccctccgggagttcaaggagttcgccgcgggccgccggagcgtgtccggggacctgatcctggagatcggcaagctcccgcagcacctgacccagcgcgcccagaacgccctggacaacctcgtcatgctgcacaacagcgagcagggcgggcgggcctaccgccacgcgatggaggagctgcccgacaccatcgagaccctcatgctgctggccctcatcgccgtgctgacgggcggggtgaccctgttcttcctctccggccgggggctgggcaagaccagcatcggcctgctctgcgtcatggcctccagcgtgctgctgtggatggcctccgtggagccccactggatcgcggccagcatcatcctcgagttcttcctgatggtcctgctcatccccgagccggaccgccagcggacgccccaggacaaccagctggcctacgtggtgatcgggctcctcttcatgatcctgaccgtcgccgccaacgagatgggcctgctcgagacgaccaagaaggacctggggatcggccacgtggcggtggagaaccaccaccacgccaccatgctggacgtcgacctccaccccgcctccgcctggaccctgtacgccgtggcgacgaccatcatcaccccgatgatgcgccacaccatcgagaacacgaccgccaacatcagcctgaccgccatcgccaaccaggccgcgatcctcatggggctggacaagggctggcccatctccaagatggacatcggcgtgcccctgctcgccctggggtgctacagccaggtcaaccccctgaccctcacggccgccgtgctgatgctggtggcgcactacgccatcatcggcccggggctccaggccaaggccacccgggaggcccagaagcgcaccgcggccggcatcatgaagaaccccaccgtcgacgggatcgtggccatcgacctggaccccgtggtctacgacgccaagttcgagaagcagctgggccagatcatgctcctgatcctgtgcacgtcccagatcctcctgatgcgcaccacctgggccctgtgcgagagcatcaccctcgcgacgggccccctgaccaccctgtgggaggggtccccgggcaagttctggaacaccacgatcgccgtgagcatggccaacatcttccgggggtcctacctcgccggcgccggcctggcgttcagcctgatgaagtccctcgggggcgggcgccggggcaccggggcccagggcgagaccctgggcgagaagtggaagcgccagctgaaccagctctccaagagcgagttcaacatctacaagcggtccgggatcatggaggtggaccgcagcgaggccaaggagggcctgaagcgcggggagaccacgcgccacgccgtctcccggggcaccgcgaagctgcgctggttcgtggagcggaacctggtgaagcccgaggggaaggtcatcgacctcggctgcggccgcgggggctggagctactactgcgccgggctgaagaaggtgaccgaggtgaagggctacaccaagggcgggcccggccacgaggagcccatcccgatggccacgtacgggtggaacctggtcaagctccactccggcaaggacgtgttcttcacgccgcccgagaagtgcgacaccctgctgtgcgacatcggggagagctcccccaacccgaccatcgaggagggccggacgctccgcgtgctgaagatggtcgagccctggctgcgggggaaccagttctgcatcaagatcctcaacccctacatgcccagcgtggtggagaccctggagcagatgcagcgcaagcacggcggcatgctggtccggaacccgctctcccgcaacagcacccacgagatgtactgggtgtcctgcgggaccggcaacatcgtgagcgccgtcaacatgacctcccggatgctgctgaaccgcttcacgatggcccaccgcaagcccacctacgagcgggacgtggacctcggggcgggcacccgccacgtggccgtcgagcccgaggtggccaacctggacatcatcggccagcggatcgagaacatcaagcacgagcacaagagcacctggcactacgacgaggacaacccctacaagacgtgggcctaccacgggtcctacgaggtcaagccgagcggctccgccagcagcatggtgaacggggtggtcaagctgctcaccaagccctgggacgtgatccccatggtgacccagatcgcgatgaccgacacgacccccttcggccagcagcgcgtcttcaaggagaaggtggacacccggaccccgaaggccaagcgcgggacggcccagatcatggaggtgaccgcccggtggctgtggggcttcctgtcccgcaacaagaagccccggatctgcacccgcgaggagttcacccggaaggtccgcagcaacgccgcgatcggcgccgtgttcgtggacgagaaccagtggaactccgccaaggaggccgtcgaggacgagcggttctgggacctcgtgcagaaggagcgcgagctgcacaagcaggggaagtgcgcgacgtgcgtgtacaacatgatgggcaagcgggagaagaagctgggggagttcggcaaggccaaggggagccgcgccatctggtacatgtggctcggcgcccggttcctggagttcgaggccctgggcttcatgaacgaggaccactggttctcccgcgagaacagcctctccggggtcgagggcgaggggctgcacaagctgggctacatcctccgggacatcagcaagatccccgggggcaacatgtacgcggacgacaccgccggctgggacacccgcatcaccgaggacgacctgcagaacgaggcccggatcacggacatcatggagccggagcacgccctgctcgccacctccatcttcaagctgacctaccagaacaaggtggtgcgcgtccagcgccccgcgaagaacgggaccgtgatggacgtgatcagccggcgcgaccagcggggctccgggcaggtcggcacgtacggcctgaacaccttcaccaacatggaggcccagctcatccgccagatggagagcgaggggatcttcctgccctccgagctggagacccagaacctcgccgagcgggtgctggactggctggagaagtacggcgtggagcgcctcaagcggatggccatcagcggggacgactgcgtcgtgaagcccatcgacgaccgcttcgccacggcgctgaccgccctgaacgacatgggcaaggtgcggaaggacatcccgcagtgggagccctccaaggggtggaacgactggcagcaggtccccttctgcagccaccacttccaccagctcatcatgaaggacggccgcgagatcgtggtgccctgccggaaccaggacgagctggtcggccgcgcccgggtgtcccagggggccggctggagcctgcgcgagaccgcctgcctcggcaagagctacgcgcagatgtggcagctgatgtacttccaccggcgcgacctgcggctcgccgccaacgccatctgctccgcggtgccggtcgactgggtgcccaccagccgcacgacctggtccatccacgcccaccaccagtggatgaccaccgaggacatgctgagcgtgtggaaccgggtctggatcgaggagaacccctggatggaggacaagacgcacgtgtccagctggggcgacgtgccctacctggggaagcgcgaggaccagtggtgcggctccctcatcggcctgaccgcccgcgccacctgggccagcaacatccaggtcgcgatcaaccaggtgcggcgcctgatcgggaacgagaactacctcgactacatgacctccatgaagcggttcaagaacgagggcgacccggagggggccctgtggtga

SEQ ID NO: 8500 - RNA, 9879 nt, synthetic construct
  misc_feature 1..9879: note = derived and/or modified CDS sequence (opt1) from DENV-1__GQ199791__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgcgggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtcacctacgggacctgctcccagacgggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcctgacccaggacgagaagggggtcacgcagaacggccggctgatcaccgccaacccgatcgtgaccgacaaggagaagcccgtgaacatcgaggccgagccgcccttcggggagagctacatcgtcatcggcgcgggcgagaaggccctcaagctgtcctggttcaagaaggggagctccatcggcaagatgttcgaggccaccgcccgcggggcccggcgcatggcgatcctgggcgacacggcctgggacttcgggagcatcggcggcgtgttcacctccgtggggaagctcgtccaccagatcttcggcaccgcctacggggtgctgttcagcggcgtgtcctggaccatgaagatcgggatcggcgtcctgctcacgtggctgggcctgaacagccgctccaccagcctctccatgacctgcatcgccgtggggctggtgaccctgtacctcggcgtcatggtgcaggccgacagcgggtgcgtgatcaactggaagggccgggagctgaagtgcgggtccggcatcttcgtcacgaacgaggtgcacacctggaccgagcagtacaagttccaggcggacagcccgaagcgcctgagcgccgccatcggcaaggcctgggaggagggggtgtgcggcatccggtccgccacccgcctcgagaacatcatgtggaagcagatcagcaacgagctgaaccacatcctgctcgagaacgacatgaagttcaccgtcgtggtgggggacgtcgtgggcatcctggcgcaggggaagaagatgatccggccccagcccatggagcacaagtactcctggaagtcctggggcaaggccaagatcatcggcgccgacgtgcagaacacgaccttcatcatcgacgggcccaacaccccggagtgccccgacgaccagcgcgcctggaacatctgggaggtcgaggactacggcttcgggatcttcaccacgaacatctggctgaagctccgggactcctacacccaggtgtgcgaccaccgcctgatgagcgcggccatcaaggactccaaggccgtgcacgccgacatgggctactggatcgagagcgagaagaacgagacctggaagctggcccgggcgtccttcatcgaggtcaagacctgcatctggcccaagagccacacgctctggtccaacggcgtgctggagagcgagatgatcatccccaagatctacgggggcccgatctcccagcacaactaccgccccgggtacttcacccagaccgccggcccctggcacctggggaagctcgagctggacttcgacctgtgcgagggcaccacggtggtcgtggacgagcactgcggcaaccgggggccgagcctccgcaccaccaccgtgacgggcaagatcatccacgagtggtgctgccggtcctgcaccctgccgcccctgcgcttcaagggggaggacggctgctggtacgggatggagatccggcccgtcaaggagaaggaggagaacctcgtcaagagcatggtgtccgccggcagcggcgaggtcgacagcttctccctggggctgctctgcatcagcatcatgatcgaggaggtgatgcgctcccggtggagccgcaagatgctgatgaccggcaccctggccgtgttcctcctgctgatcatggggcagctcacgtggaacgacctgatccggctgtgcatcatggtcggcgccaacgcgtccgaccgcatggggatgggcaccacctacctcgccctgatggccaccttcaagatgcgcccgatgttcgccgtggggctcctgttccggcgcctgacgagccgggaggtgctgctcctgaccatcgggctgtccctcgtcgccagcgtggagctgcccaactccctggaggagctcggcgacgggctggcgatgggcatcatgatcctgaagctcctgaccgacttccagagccaccagctgtgggccaccctcctgtccctgacgttcatcaagaccaccctcagcctgcactacgcctggaagaccatggccatggtcctgtccatcgtgagcctcttccccctgtgcctgtccacgaccagccagaagaccacctggctccccgtgctgctgggctccctcgggtgcaagccgctgacgatgttcctgatcgcggagaacaagatctggggccgcaagagctggcccctcaacgaggggatcatggccgtcggcgtggtgtccatcctgctgagcagcctcctgaagaacgacgtccccctggccgggcccctcatcgccggcggcatgctgatcgcctgctacgtgatctccgggagctccgcggacctgagcctcgagaaggccgccgaggtgtcctgggaggaggaggccgagcacagcggcgcctcccacaacatcctggtcgaggtgcaggacgacgggaccatgaagatcaaggacgaggagcgggacgacaccctgaccatcctcctgaaggcgaccctgctcgccgtgagcggcgtctacccgctgtccatccccgccacgctgttcgtgtggtacttctggcagaagaagaagcagcgcagcggggtgctgtgggacacccccagcccgcccgaggtcgagcgggccgtgctcgacgacggcatctaccgcatcatgcagcggggcctgctggggcgcagccaggtgggcgtcggggtgttccaggagaacgtgttccacaccatgtggcacgtcacccggggcgccgtgctcatgtaccaggggaagcgcctggagccctcctgggcgagcgtgaagaaggacctgatctcctacggcggcgggtggcggctccagggcagctggaacacgggggaggaggtccaggtgatcgccgtggagcccggcaagaaccccaagaacgtccagaccgcccccgggaccttcaagacccccgagggcgaggtgggcgccatcgccctggacttcaagcccgggacgtccggcagccccatcgtgaaccgcgaggggaagatcgtcggcctgtacggcaacggggtggtgaccacctccggcacctacgtcagcgcgatcgcccaggccaaggccagccaggaggggccgctccccgagatcgaggacgaggtgttccggaagcgcaacctgacgatcatggacctgcaccccggctccgggaagacccggcgctacctcccggcgatcgtgcgggaggccatcaagcgcaagctgcggaccctgatcctcgcccccacccgcgtcgtggccagcgagatggccgaggcgctgaagggcatgcccatccgctaccagacgaccgccgtgaagtccgagcacaccggcaaggagatcgtcgacctgatgtgccacgccaccttcacgatgcggctcctgagccccgtgcgcgtgccgaactacaacatgatcatcatggacgaggcccacttcaccgacccctccagcatcgccgcgcgggggtacatctccacccgcgtcggcatgggggaggccgccgccatcttcatgaccgccacgccgcccggcagcgtggaggcgttcccgcagtccaacgccgtgatccaggacgaggagcgggacatccccgagcgcagctggaactccgggtacgagtggatcaccgacttccccggcaagaccgtctggttcgtgcccagcatcaagtccggcaacgacatcgccaactgcctgcggaagaacgggaagcgcgtgatccagctcagccggaagaccttcgacacggagtaccagaagaccaagaacaacgactgggactacgtcgtgaccaccgacatctccgagatgggcgccaacttccgcgcggaccgggtgatcgacccgcgccggtgcctgaagcccgtcatcctgaaggacgggcccgagcgcgtgatcctcgccggccccatgccggtcacggtggccagcgccgcccagcggcgcgggcggatcggccgcaaccacaacaaggagggcgaccagtacatctacatggggcagcccctgaacaacgacgaggaccacgcgcactggaccgaggccaagatgctgctcgacaacatcaacacccccgagggcatcatccccgccctgttcgagccggagcgggagaagtccgccgccatcgacggggagtaccgcctgcgcggcgaggcgcggaagaccttcgtggagctcatgcgccgcggggacctgcccgtctggctgagctacaaggtggcctccgagggcttccagtacagcgaccgccggtggtgcttcgacggcgagcgcaacaaccaggtgctcgaggagaacatggacgtcgagatctggacgaaggagggggagcggaagaagctgcgcccccggtggctggacgcccgcacctacagcgaccccctcgccctgcgggagttcaaggagttcgccgcgggccgccggtccgtgagcggggacctgatcctcgagatcggcaagctgccgcagcacctgacccagcgcgcccagaacgccctcgacaacctggtgatgctgcacaactccgagcagggcgggcgggcctaccgccacgcgatggaggagctccccgacaccatcgagacgctgatgctgctcgccctgatcgccgtcctgaccggcggggtgaccctcttcttcctgagcggccgggggctgggcaagacctccatcggcgtgctctgcgtcatggccagctccgtgctgctgtggatggccagcgtggagccccactggatcgcggcctccatcatcctcgagttcttcctgatggtcctgctcatccccgagccggaccgccagcggacgccccaggacaaccagctggcctacgtggtgatcgggctcctgttcatgatcctgacggtcgccgccaacgagatgggcctgctcgagaccaccaagaaggacctggggatcggccacgtggcggtggagaaccaccaccacgccaccatgctggacgtcgacctccaccccgccagcgcctggacgctgtacgccgtggcgaccaccatcatcaccccgatgatgcgccacacgatcgagaacaccaccgccaacatctccctgaccgccatcgccaaccaggccgcgatcctcatggggctggacaagggctggcccatcagcaagatggacatcggcgtgcccctgctcgccctggggtgctactcccaggtcaaccccctgacgctcaccgccgccgtgctgatgctggtggcgcactacgccatcatcggcccggggctccaggccaaggccacccgggaggcccagaagcgcaccgcggccggcatcatgaagaaccccacggtcgacgggatcgtggccatcgacctggaccccgtggtctacgacgccaagttcgagaagcagctgggccagatcatgctcctgatcctgtgcaccagccagatcctcctgatgcgcaccacctgggccctgtgcgagtccatcacgctcgcgaccggccccctgaccaccctgtgggaggggagcccgggcaagttctggaacacgaccatcgccgtgtccatggccaacatcttccgggggagctacctcgccggcgccggcctggcgttctccctgatgaagtccctcgggggcgggcgccggggcaccggggcccagggcgagaccctgggcgagaagtggaagcgccagctgaaccagctcagcaagtccgagttcaacatctacaagcggagcgggatcatggaggtggaccgctccgaggccaaggagggcctgaagcgcggggagacgacccgccacgccgtcagccggggcaccgcgaagctgcgctggttcgtggagcggaacctggtgaagcccgaggggaaggtcatcgacctcggctgcggccgcgggggctggtcctactactgcgccgggctgaagaaggtgaccgaggtgaagggctacacgaagggcgggcccggccacgaggagcccatcccgatggccacctacgggtggaacctggtcaagctccacagcggcaaggacgtgttcttcacgccgcccgagaagtgcgacaccctgctgtgcgacatcggggagtccagccccaacccgacgatcgaggagggccggaccctccgcgtgctgaagatggtcgagccctggctgcgggggaaccagttctgcatcaagatcctcaacccctacatgccctccgtggtggagaccctggagcagatgcagcgcaagcacggcggcatgctggtccggaacccgctcagccgcaactccacccacgagatgtactgggtgagctgcgggaccggcaacatcgtgtccgccgtcaacatgacgagccggatgctgctgaaccgcttcaccatggcccaccgcaagcccacctacgagcgggacgtggacctcggggcgggcacccgccacgtggccgtcgagcccgaggtggccaacctggacatcatcggccagcggatcgagaacatcaagcacgagcacaagtccacgtggcactacgacgaggacaacccctacaagacctgggcctaccacgggagctacgaggtcaagccgtccggcagcgcctccagcatggtgaacggggtggtcaagctgctcaccaagccctgggacgtgatccccatggtgacccagatcgcgatgacggacaccacccccttcggccagcagcgcgtcttcaaggagaaggtggacacccggacgccgaaggccaagcgcgggaccgcccagatcatggaggtgaccgcccggtggctgtggggcttcctgagccgcaacaagaagccccggatctgcacccgcgaggagttcacgcggaaggtccgctccaacgccgcgatcggcgccgtgttcgtggacgagaaccagtggaacagcgccaaggaggccgtcgaggacgagcggttctgggacctcgtgcagaaggagcgcgagctgcacaagcaggggaagtgcgcgacctgcgtgtacaacatgatgggcaagcgggagaagaagctgggggagttcggcaaggccaaggggtcccgcgccatctggtacatgtggctcggcgcccggttcctggagttcgaggccctgggcttcatgaacgaggaccactggttcagccgcgagaactccctcagcggggtcgagggcgaggggctgcacaagctgggctacatcctccgggacatctccaagatccccgggggcaacatgtacgcggacgacaccgccggctgggacacccgcatcacggaggacgacctgcagaacgaggccaagatcaccgacatcatggagccggagcacgccctgctcgccaccagcatcttcaagctgacctaccagaacaaggtggtgcgggtccagcgccccgcgaagaacgggacggtgatggacgtgatctcccgccgggaccagcgcggcagcgggcaggtcggcacctacggcctgaacaccttcaccaacatggaggcccagctcatccggcagatggagtccgaggggatcttcctgcccagcgagctggagacgcccaacctcgccgagcgcgtgctggactggctggagaagtacggcgtggagcggctcaagcgcatggccatctccggggacgactgcgtcgtgaagccgatcgacgaccggttcgccaccgcgctgaccgccctgaacgacatgggcaaggtgcgcaaggacatcccccagtgggagcccagcaaggggtggaacgactggcagcaggtccccttctgctcccaccacttccaccagctcatcatgaaggacggccgggagatcgtggtgccgtgccgcaaccaggacgagctggtcggccgggcccgcgtgagccagggggccggctggtccctgcgggagaccgcctgcctcggcaagagctacgcgcagatgtggcagctgatgtacttccaccgccgggacctgcgcctcgccgccaacgccatctgcagcgcggtgcccgtcgactgggtgcccacgtcccggaccacctggagcatccacgcccaccaccagtggatgaccacggaggacatgctgtccgtgtggaaccgcgtctggatcgaggagaacccctggatggaggacaagacccacgtgagctcctggggcgacgtgccgtacctggggaagcgggaggaccagtggtgcggcagcctcatcggcctgaccgcccgcgccacctgggcctccaacatccaggtcgcgatcaaccaggtgcgccggctgatcgggaacgagaactacctcgactacatgaccagcatgaagcgcttcaagaacgagggcgaccccgagggggccttctggtga

SEQ ID NO: 8501 - RNA, 9879 nt, synthetic construct
  misc_feature 1..9879: note = derived and/or modified CDS sequence (opt1) from DENV-1__GQ199792__SS-prME
  source 1..9879: mol_type = other RNA
agcgtgaccatgctgctcatgctgatgcccaccgccctggccttccacctcaccacccgcggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgaggccgagcccgacgacgtggactgctggtgcaacgccaccgacgcctgggtgacctacgggacctgcagccagaccggcgagcaccggcgcgacaagcggtccgtggccctcgcgccccacgtgggcctggggctggagacccgcaccgagacctggatgagctccgagggcgcctggaagcagatccagcgggtcgagacctgggccctccgccaccccgggttcaccgtgatcgcgctgttcctggcccacgccatcggcacgagcatcacccagaaggggatcatcttcatcctcctgatgctggtgaccccctccatggccatgcggtgcgtcggcatcggcagccgcgacttcgtggaggggctctccggcgccacctgggtggacgtcgtgctggagcacgggagctgcgtgacgaccatggcgaaggacaagcccaccctggacatcgagctcctgaagaccgaggtcacgaaccccgccgtgctgcggaagctctgcatcgaggccaagatctccaacaccaccaccgacagccgctgcccgacgcagggcgaggccaccctggtggaggagcaggacgccaacttcgtctgccggcgcaccttcgtggaccggggctgggggaacggctgcgggctgttcggcaaggggtccctcatcacgtgcgcgaagttcaagtgcgtgacgaagctggagggcaagatcgtccagtacgagaacctgaagtacagcgtgatcgtgaccgtccacaccggcgaccagcaccaggtggggaacgagtccaccgagcacggcacgaccgccaccatcacgccccaggcccccaccacggagatccagctcaccgactacggggccctgaccctggactgcagcccccgcaccggcctcgacttcaacgagatggtcctgctgacgatgaaggagaagtcctggctcgtgcacaagcagtggttcctggacctgcccctcccctggaccagcggggccagcacctcccaggagacctggaaccggcaggacctgctggtgacgttcaagaccgcgcacgccaagaagcaggaggtcgtggtgctcggcagccaggagggcgccatgcacaccgccctgaccggggccacggagatccagacctccggcaccaccacgatcttcgcggggcacctgaagtgccgcctcaagatggacaagctgaccctgaagggcatgagctacgtcatgtgcaccgggtccttcaagctcgagaaggaggtggccgagacccagcacggcacggtgctggtccagatcaagtacgagggcaccgacgccccctgcaagatccccttcagcacccaggacgagaagggggtgacccagaacggccggctgatcacggccaacccgatcgtgaccgacaaggagaagcccgtcaacatcgaggcggagccgcccttcggggagtcctacatcgtgatcggcgccggcgagaaggccctgaagctcagctggttcaagaaggggtccagcatcggcaagatgttcgaggccaccgcccgcggggcgcggcgcatggccatcctgggcgacaccgcctgggacttcgggtccatcggcggcgtgttcacgagcgtcgggaagctggtgcaccagatcttcggcaccgcctacggggtcctcttctccggcgtcagctggaccatgaagatcgggatcggcgtgctgctgacctggctcggcctgaactcccgcagcacgtccctgagcatgacctgcatcgccgtggggctcgtcaccctgtacctgggcgtgatggtgcaggcggactccgggtgcgtcatcaactggaagggccgggagctcaagtgcgggagcggcatcttcgtgaccaacgaggtgcacacgtggaccgagcagtacaagttccaggccgacagcccgaagcgcctgtccgccgccatcggcaaggcctgggaggagggggtctgcggcatccggagcgcgacccgcctggagaacatcatgtggaagcagatctccaacgagctcaaccacatcctgctggagaacgacatgaagctcaccgtggtggtcggggacgtggccggcatcctggggcagggcaagaagatgatccggccccagcccatggagtacaagtacagctggaagtcctggggcaaggccaagatcatcggggccgacgcgcagaacaccacgttcatcatcgacggccccaacaccccggagtgccccgacgaccagcgcgcctggaacatctgggaggtggaggactacgggttcggcatcttcaccaccaacatctggctgaagctccgggacagctacacgcaggtctgcgaccaccgcctgatgtccgccgccatcaaggacagcaaggccgtgcacgcggacatgggctactggatcgagtccgagaagaacgagacctggaagctggcccgggccagcttcatcgaggtgaagacctgcatctggcccaagtcccacaccctctggagcaacggggtcctggagtccgagatgatcatccccaagatctacggcgggccgatcagccagcacaactaccgccccggctacttcacgcagaccgccgggccctggcacctgggcaagctcgagctggacttcgacctgtgcgagggcaccaccgtggtggtcgacgagcactgcgggaaccggggcccgtccctccgcacgaccaccgtgaccgggaagatcatccacgagtggtgctgccggagctgcacgctgccgcccctgcgcttccggggcgaggacgggtgctggtacggcatggagatccgccccgtgaaggagaaggaggagaacctcgtcaagtccatggtgagcgccggcagcggggaggtggactccttcagcctgggcctgctctgcatctccatcatgatcgaggaggtcatgcggagccgctggtcccggaagatgctgatgaccgggaccctggcggtgttcttcctcctgatcatgggccagctgacctggaacgacctcatccgcctgtgcatcatggtgggggccaacgccagcgaccgcatgggcatgggcacgacctacctggccctcatggccaccttcaagatgcggccgatgttcgcggtcgggctgctgttccgccggctcacctcccgcgaggtgctgctgctcacgatcggcctgagcctggtggcctccgtcgagctccccaacagcctggaggagctgggggacggcctcgccatgggcatcatgatcctgaagctgctcaccgacttccagtcccaccagctgtgggccaccctgctcagcctgaccttcatcaagacgaccttctccctgcactacgcgtggaagaccatggccatggtgctcagcatcgtctccctgttccccctgtgcctcagcaccacgtcccagaagaccacctggctgcccgtgctgctcgggagcctgggctgcaagccgctgaccatgttcctcatcgccgagaacaagatctgggggcggaagtcctggcccctgaacgagggcatcatggccgtggggatcgtcagcatcctgctcagctccctgctgaagaacgacgtgcccctcgccggccccctgatcgcgggcgggatgctgatcgcctgctacgtgatcagcggctccagcgccgacctctccctggagaaggccgccgaggtcagctgggaggaggaggcggagcactccggggccagccacaacatcctggtggaggtgcaggacgacggcacgatgaagatcaaggacgaggagcgcgacgacaccctcaccatcctgctgaaggccaccctcctggccgtctccggggtgtacccgctgagcatccccgccaccctcttcgtgtggtacttctggcagaagaagaagcagcggtccggcgtcctgtgggacacgcccagcccgcccgaggtggagcgcgcggtgctggacgacggcatctaccggatcatgcagcgcgggctgctcggccggtcccaggtcggggtgggcgtgttccaggagaacgtcttccacaccatgtggcacgtgacccgcggggccgtgctgatgtaccagggcaagcggctggagcccagctgggcctccgtcaagaaggacctcatcagctacggcgggggctggcgcctgcgggggtcctggaacatgggcgaggaggtccaggtgatcgccgtcgagcccgggaagaaccccaagaacgtgcagaccgcccccggcacgttcaagacccccgagggcgaggtgggggcgatcgccctggacttcaagcccggcaccagcgggtcccccatcgtcaaccgcgagggcaagatcgtgggcctctacgggaacggcgtggtcaccacgagcgggacctacgtgagcgccatcgcccaggcgaaggcctcccaggagggcccgctgcccgagatcgaggacgaggtgttccggaagcgcaacctgaccatcatggacctccaccccgggagcggcaagacccggcgctacctgccggccatcgtccgggaggccatcaagcgcaagctgcgcacgctcatcctggcccccacccgggtggtggcgtccgagatggccgaggccctgaagggcatgcccatccgctaccagaccaccgccgtcaagagcgagcacacggggaaggagatcgtggacctcatgtgccacgccaccttcaccatgcggctgctgtcccccgtgcgcgtcccgaactacaacatgatcatcatggacgaggcgcacttcaccgaccccagctccatcgccgcccggggctacatcagcacgcgcgtggggatgggcgaggccgccgcgatcttcatgaccgccacgccgcccgggtccgtggaggccttcccgcagagcaacgccgtcatccaggacgaggagcgggacatccccgagcgctcctggaacagcggctacgagtggatcaccgacttccccggcaagacggtgtggttcgtgccctccatcaagagcgggaacgacatcgcgaactgcctccggaagaacggcaagcgcgtcatccagctgtcccggaagaccttcgacaccgagtaccagaagaccaagaacaacgactgggactacgtggtgacgaccgacatcagcgagatgggggccaacttccgcgccgaccgggtcatcgacccgcgccggtgcctgaagcccgtgatcctcaaggacggccccgagcgcgtgatcctggccgggcccatgccggtcaccgtggcctccgcggcccagcggcgcggccggatcggccgcaaccacaacaaggagggggaccagtacatctacatgggccagcccctgaacaacgacgaggaccacgcccactggaccgaggccaagatgctcctggacaacatcaacacgcccgaggggatcatccccgccctgttcgagccggagcgcgagaagtccgcggccgtcgacggcgagtaccggctccgcggggaggcccggaagaccttcgtggagctgatgcgccggggcgacctgcccgtgtggctctcctacaaggtcgccagcgagggcttccagtacagcgaccgccggtggtgcttcgacggggagcgcaacaaccaggtgctggaggagaacatggacgtggagatctggaccaaggagggcgagcggaagaagctgcgcccccggtggctcgacgcccgcacctactccgaccccctggcgctgcgggagttcaaggagttcgccgccgggcgccggagcgtctccggcgacctcatcctggagatcggcaagctgccgcagcacctcacgcagcgcgcccagaacgcgctggacaacctggtgatgctccacaacagcgagcagggcgggcgggcctaccgccacgccatggaggagctgcccgacaccatcgagaccctgatgctcctggccctgatcgccgtgctcaccgggggcgtcacgctgttcttcctgtccgggcggggcctcggcaagaccagcatcgggctgctgtgcgtgatggcgtccagcgtgctcctgtggatggcctccgtcgagccccactggatcgccgccagcatcatcctggagttcttcctcatggtgctgctgatccccgagccggaccgccagcggacgccccaggacaaccagctcgcctacgtggtcatcggcctgctgttcatgatcctcaccgtggcggccaacgagatggggctgctggagaccacgaagaaggacctcggcatcgggcacgtggccgtcgagaaccaccaccacgccgccatgctggacgtggacctgcaccccgcgtccgcctggaccctctacgccgtggccaccaccatcatcacgccgatgatgcgccacaccatcgagaacaccaccgccaacatcagcctgacggcgatcgccaaccaggccgccatcctgatgggcctcgacaagggctggcccatctccaagatggacatcggggtccccctgctggcgctcggctgctacagccaggtgaaccccctgaccctgaccgccgccgtgctcatgctggtcgcccactacgccatcatcgggccgggcctgcaggcgaaggccacccgcgaggcccagaagcggacggccgccgggatcatgaagaaccccaccgtggacggcatcgtggcgatcgacctcgaccccgtcgtgtacgacgccaagttcgagaagcagctgggccagatcatgctgctcatcctgtgcacctcccagatcctgctcatgcgcaccacgtgggccctgtgcgagagcatcaccctggccaccgggcccctcaccacgctgtgggagggctccccggggaagttctggaacaccaccatcgccgtgagcatggcgaacatcttccggggctcctacctggccggcgccgggctcgccttcagcctgatgaagtccctgggcgggggccgccgggggaccggcgcgcagggcgagacgctcggggagaagtggaagcgccagctgaaccagctgtccaagagcgagttcaacacctacaagcggtccggcatcatggaggtcgaccgcagcgaggccaaggaggggctcaagcggggcgagaccaccaagcacgccgtgtcccgcgggacggccaagctgcggtggttcgtggagcgcaacctggtcaagcccgagggcaaggtgatcgacctgggctgcgggcggggcgggtggagctactactgcgccggcctcaagaaggtgaccgaggtcaaggggtacaccaagggcggccccgggcacgaggagcccatcccgatggcgacctacggctggaacctggtgaagctgcactccgggaaggacgtgttcttcatcccgcccgagaagtgcgacacgctcctgtgcgacatcggcgagagctcccccaacccgaccatcgaggaggggcgcaccctgcgggtcctcaagatggtggagccctggctgcgcggcaaccagttctgcatcaagatcctgaacccctacatgcccagcgtggtcgagaccctcgagcagatgcagcggaagcacggcgggatgctggtgcgcaacccgctgtcccggaacagcacgcacgagatgtactgggtgtcctgcggcaccgggaacatcgtcagcgccgtgaacatgacctcccgcatgctcctgaaccgcttcaccatggcccaccggaagcccacctacgagcgcgacgtggacctgggcacgggcacccggcacgtcgccgtggagcccgaggtggccaacctcgacatcatcgggcagcgcatcgagaacatcaagcacgagcacaagagcacctggcactacgacgaggacaacccctacaagacctgggcgtaccacggctcctacgaggtcaagccgagcgggtccgccagcagcatggtgaacggcgtcgtgaagctgctgacgaagccctgggacgtgatccccatggtcacccagatcgccatgaccgacaccacgcccttcgggcagcagcgggtgttcaaggagaaggtggacacccgcaccccgaaggccaagcggggcaccgcccagatcatggaggtcacggcgcgctggctctggggcttcctgtcccggaacaagaagccccgcatctgcacccgggaggagttcacccgcaaggtgcggagcaacgccgccatcggggccgtgttcgtcgacgagaaccagtggaactccgcgaaggaggccgtggaggacgagcgcttctgggacctggtgcaccgggagcgcgagctccacaagcagggcaagtgcgcgacctgcgtctacaacatgatggggaagcgggagaagaagctgggcgagttcgggaaggccaagggcagccgcgccatctggtacatgtggctgggcgcgcggttcctcgagttcgaggccctggggttcatgaacgaggaccactggttctcccgcgagaacagcctgtccggcgtggagggggagggcctccacaagctggggtacatcctgcgggacatcagcaagatccccggcggcaacatgtacgccgacgacacggccgggtgggacacccgcatcaccgaggacgacctccagaacgaggccaagatcaccgacatcatggagccggagcacgcgctgctggccaaggccatcttcaagctcacgtaccagaacaaggtggtccgcgtgcagcggcccgccaagaacggcaccgtgatggacgtcatctcccgccgggaccagcgcgggagcggccaggtgggcacctacgggctgaacaccttcacgaacatggaggcccagctgatccggcagatggagtccgagggcatcttcagcccctccgagctcgagacccccaacctggcggagcgcgccctggactggctcgagaagtacggggtggagcggctgaagcgcatggccatcagcggcgacgactgcgtcgtgaagccgatcgacgaccggttcgccaccgccctgaccgcgctcaacgacatggggaaggtgcgcaaggacatcccccagtgggagccctccaagggctggaacgactggcagcaggtccccttctgcagccaccacttccaccagctgatcatgaaggacggccgggagatcgtggtgccgtgccgcaaccaggacgagctggtcgggcgggcccgcgtgtcccagggcgccgggtggagcctccgggagacggcctgcctgggcaagagctacgcgcagatgtggcagctgatgtacttccaccgccgggacctccgcctggccgccaacgccatctgctccgccgtgcccggggactgggtccccaccagccggaccacctggtccatccacgcgcaccaccagtggatgacgaccgaggacatgctgagcgtgtggaaccgcgtgtggatcgaggagaacccctggatggaggacaagacccacatctccagctgggaggacgtcccgtacctcggcaagcgcgaggaccagtggtgcggctccctgatcgggctgaccgcccgggccacgtgggccaccaacatccaggtggccatcaaccaggtgcgccggctcatcggcaacgagaactacctggactacatgaccagcatgaagcgcttcaagaacgagtccgaccccgagggggcgctgtggtga

SEQ ID NO: 8502 - RNA, 9879 nt, synthetic construct
  misc_feature 1..9879: note = derived and/or modified CDS sequence (opt1) from DENV-1__GQ199793__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgcgggggtgaacatgtgcaccctcatcgccatggacctgggggagctgtgcgaggacaccatgacctacaagtgcccccggatcaccgaggccgagcccgacgacgtggactgctggtgcaacgccaccgacacctgggtgacctacgggacctgctcccagacgggggagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccaccacgagccaggagacctggaaccggcaggacctgctggtgaccttcaagaccgcccacgcgaagaagcaggaggtggtcgtgctcggctcccaggagggcgccatgcacacggccctgaccggggccaccgagatccagaccagcggcacgaccaccatcttcgccgggcacctgaagtgccgcctcaagatggacaagctgaccctgaagggcatgtcctacgtgatgtgcacggggagcttcaagctcgagaaggaggtcgcggagacccagcacggcaccgtgctggtgcagatcaagtacgagggcaccgacgccccctgcaagatccccttctccacgcaggacgagaagggggtcacccagaacggccggctgatcaccgccaacccgatcgtgaccgacaaggagaagcccgtgaacatcgaggccgagccgcccttcggggagagctacatcgtcatcggcgcgggcgagaaggccctgaagctctcctggttcaagaaggggagctccatcggcaagatgttcgaggccacggcccgcggggcccggcgcatggcgatcctgggcgacaccgcctgggacttcgggagcatcggcggcgtgttcacctccgtggggaagctggtccaccagatcttcggcaccgcctacggggtcctgttcagcggcgtgtcctggacgatgaagatcgggatcggcgtcctgctgacctggctcggcctgaacagccgctccaccagcctgtccatgacctgcatcgccgtggggctcgtgacgctgtacctgggcgtcatggtgcaggccgacagcgggtgcgtgatcaactggaagggccgggagctcaagtgcgggtccggcatcttcgtcaccaacgaggtgcacacctggaccgagcagtacaagttccaggcggacagcccgaagcgcctgagcgccgccatcggcaaggcctgggaggagggggtgtgcggcatccggtccgccacccgcctggagaacatcatgtggaagcagatcagcaacgagctcaaccacatcctgctggagaacgacatgaagttcacggtcgtggtgggggacgtcgtgggcatcctcgcgcaggggaagaagatgatccggccccagcccatggagcacaagtactcctggaagtcctggggcaaggccaagatcatcggcgccgacgtgcagaacaccaccttcatcatcgacgggcccaacaccccggagtgccccgacgaccagcgcgcctggaacatctgggaggtcgaggactacggcttcgggatcttcacgaccaacatctggctgaagctgcgggactcctacacccagatgtgcgaccaccgcctcatgagcgcggccatcaaggactccaaggccgtgcacgccgacatgggctactggatcgagagcgagaagaacgagacctggaagctggcccgggcgtccttcatcgaggtgaagacgtgcatctggcccaagagccacaccctgtggtccaacggcgtcctcgagagcgagatgatcatccccaagatctacgggggcccgatctcccagcacaactaccgccccgggtacttcacccagaccgccggcccctggcacctggggaagctggagctcgacttcgacctgtgcgagggcacgaccgtggtggtcgacgagcactgcggcaaccgggggccgagcctgcgcaccaccacggtgaccggcaagatcatccacgagtggtgctgccggtcctgcaccctgccgcccctccgcttcaagggggaggacggctgctggtacgggatggagatccggcccgtgaaggagaaggaggagaacctggtcaagagcatggtgtccgccggcagcggcgaggtggacagcttctccctcgggctgctgtgcatcagcatcatgatcgaggaggtcatgcgctcccggtggagccgcaagatgctcatgaccggcacgctggccgtgttcctgctcctgatcatggggcagctgacctggaacgacctcatccggctgtgcatcatggtgggcgccaacgcgtccgaccgcatggggatgggcaccacctacctggccctcatggccacgttcaagatgcgcccgatgttcgccgtcggcctgctgttccggcgcctcaccagccgggaggtgctgctgctcaccatcgggctgtccctggtggccagcgtcgagctccccaactccctggaggagctgggcgacgggctcgcgatgggcatcatgatcctgaagctgctcaccgacttccagagccaccagctgtgggccacgctgctctccctgaccttcatcaagaccaccctgagcctccactacgcctggaagacgatggccatggtgctgtccatcgtcagcctgttccccctctgcctgtccaccaccagccagaagaccacgtggctgcccgtgctcctgggctccctggggtgcaagccgctcaccatgttcctgatcaccgagaacaagatctggggccgcaagagctggcccctgaacgaggggatcatggcggtgggcgtcgtgtccatcctcctgagcagcctgctcaagaacgacgtgcccctggccgggcccctgatcgccggcggcatgctcatcgcctgctacgtcatctccgggagctccgccgacctgagcctggagaaggcggccgaggtgtcctgggaggaggaggccgagcacagcggcgcctcccacaacatcctcgtggaggtccaggacgacgggaccatgaagatcaaggacgaggagcgggacgacaccctgacgatcctgctcaaggccaccctgctggcggtgagcggcgtgtacccgctctccatccccgccaccctgttcgtctggtacttctggcagaagaagaagcagcgcagcggggtgctgtgggacacccccagcccgcccgaggtggagcgggccgtcctggacgacggcatctaccgcatcatgcagcggggcctcctggggcgcagccaggtgggcgtgggggtcttccaggagaacgtgttccacacgatgtggcacgtgacccggggcgccgtcctgatgtaccaggggaagcgcctcgagccctcctgggccagcgtgaagaaggacctgatctcctacggcggcgggtggcggctgcagggcagctggaacgcgggggaggaggtgcaggtcatcgccgtggagcccggcaagaaccccaagaacgtgcagaccgcccccgggaccttcaagacgcccgagggcgaggtcggcgccatcgccctcgacttcaagcccgggacctccggcagccccatcgtgaaccgcgaggggaagatcgtgggcctgtacggcaacggggtcgtgaccacctccggcacgtacgtgagcgcgatcgcccaggccaaggccagccaggaggggccgctgcccgagatcgaggacgaggtcttccggaagcgcaacctcaccatcatggacctgcaccccggctccgggaagacccggcgctacctgccggcgatcgtgcgggaggccatcaagcgcaagctccggaccctgatcctggcccccacgcgcgtggtcgccagcgagatggccgaggcgctcaagggcatgcccatccgctaccagaccaccgccgtgaagtccgagcacaccggcaaggagatcgtggacctgatgtgccacgccacgttcaccatgcggctgctcagccccgtccgcgtgccgaactacaacatgatcatcatggacgaggcccacttcaccgacccctccagcatcgccgcgcgggggtacatctccacccgcgtgggcatgggggaggccgccgccatcttcatgacggccacgccgcccggcagcgtcgaggcgttcccgcagtccaacgccgtgatccaggacgaggagcgggacatccccgagcgcagctggaactccgggcacgagtggatcaccgacttccccggcaagaccgtgtggttcgtccccagcatcaagtccggcaacgacatcgccaactgcctgcggaagaacgggaagcgcgtgatccagctgagccggaagacgttcgacaccgagtaccagaagaccaagaacaacgactgggactacgtggtcaccacggacatctccgagatgggcgccaacttccgcgcggaccgggtgatcgacccgcgccggtgcctcaagcccgtgatcctgaaggacgggcccgagcgcgtcatcctggccggccccatgccggtgaccgtcgccagcgccgcccagcggcgcgggcggatcggccgcaaccacaacaaggagggcgaccagtacatctacatggggcagcccctcaacaacgacgaggaccacgcgcactggaccgaggccaagatgctgctggacaacatcaacacccccgagggcatcatccccgccctcttcgagccggagcgggagaagtccgccgccatcgacggggagtaccgcctgcgcggcgaggcgcggaagacgttcgtggagctgatgcgccgcggggacctccccgtgtggctgagctacaaggtcgcctccgagggcttccagtacagcgaccgccggtggtgcttcgacggcgagcgcaacaaccaggtgctggaggagaacatggacgtggagatctggaccaaggagggggagcggaagaagctccgcccccggtggctggacgcccgcacctacagcgaccccctggccctccgggagttcaaggagttcgccgcgggccgccggtccgtcagcggggacctgatcctggagatcggcaagctcccgcagcacctgacccagcgcgcccagaacgccctggacaacctcgtgatgctgcacaactccgagcagggcgggcgggcctaccgccacgcgatggaggagctgcccgacacgatcgagaccctcatgctgctggccctcatcgccgtgctgaccggcggggtcaccctgttcttcctcagcggccgggggctgggcaagacctccatcggcctgctctgcgtgatggccagctccgtgctgctgtggatggccagcgtcgagccccactggatcgcggcctccatcatcctcgagttcttcctgatggtgctgctcatccccgagccggaccgccagcggacgccccaggacaaccagctggcctacgtggtcatcgggctcctcttcatgatcctgaccgtggccgccaacgagatgggcctgctcgagaccaccaagaaggacctggggatcggccacgtggcggtcgagaaccaccaccacgccacgatgctggacgtggacctccaccccgccagcgcctggaccctgtacgccgtggcgaccaccatcatcacgccgatgatgcgccacaccatcgagaacaccaccgccaacatctccctgacggccatcgccaaccaggccgcgatcctcatggggctggacaagggctggcccatcagcaagatggacatcggcgtccccctgctcgccctggggtgctactcccaggtgaaccccctgaccctcaccgccgccgtgctgatgctggtcgcgcactacgccatcatcggcccggggctccaggccaaggccacccgggaggcccagaagcgcacggcggccggcatcatgaagaaccccaccgtggacgggatcgtggccatcgacctggaccccgtcgtgtacgacgccaagttcgagaagcagctgggccagatcatgctcctgatcctgtgcaccagccagatcctcctgatgcgcaccacgtgggccctgtgcgagtccatcaccctcgcgaccggccccctgaccacgctgtgggaggggagcccgggcaagttctggaacaccaccatcgccgtgtccatggccaacatcttccgggggagctacctcgccggcgccggcctggcgttctccctgatgaagtccctcgggggcgggcgccggggcaccggggcccagggcgagacgctgggcgagaagtggaagcgccagctgaaccagctcagcaagtccgagttcaacatctacaagcggagcgggatcatggaggtcgaccgctccgaggccaaggagggcctgaagcgcggggagaccacccgccacgccgtgagccggggcaccgcgaagctgcgctggttcgtggagcggaacctggtcaagcccgaggggaaggtgatcgacctcggctgcggccgcgggggctggtcctactactgcgccgggctgaagaaggtgacggaggtcaagggctacaccaagggcgggcccggccacgaggagcccatcccgatggccacctacgggtggaacctggtgaagctccacagcggcaaggacgtgttcttcacgccgcccgagaagtgcgacacgctgctgtgcgacatcggggagtccagccccaacccgaccatcgaggagggccggaccctccgcgtcctgaagatggtggagccctggctgcgggggaaccagttctgcatcaagatcctcaacccctacatgccctccgtggtcgagaccctggagcagatgcagcgcaagtacggcggcatgctggtgcggaacccgctcagccgcaactccacccacgagatgtactgggtgagctgcgggacgggcaacatcgtctccgccgtgaacatgaccagccggatgctgctgaaccgcttcaccatggcccaccgcaagcccacctacgagcgggacgtggacctcggggcgggcacgcgccacgtcgccgtggagcccgaggtggccaacctggacatcatcggccagcggatcgagaacatcaagcacgagcacaagtccacctggcactacgacgaggacaacccctacaagacctgggcctaccacgggagctacgaggtcaagccgtccggcagcgcctccagcatggtgaacggggtcgtgaagctgctcaccaagccctgggacgtgatccccatggtcacgcagatcgcgatgaccgacaccacccccttcggccagcagcgcgtgttcaaggagaaggtggacacgcggaccccgaaggccaagcgcgggaccgcccagatcatggaggtcaccgcccggtggctgtggggcttcctgagccgcaacaagaagccccggatctgcacgcgcgaggagttcacccggaaggtgcgctccaacgccgcgatcggcgccgtgttcgtcgacgagaaccagtggaacagcgccaaggaggccgtggaggacgagcggttctgggacctcgtgcagaaggagcgcgagctgcacaagcaggggaagtgcgcgacctgcgtctacaacatgatgggcaagcgggagaagaagctgggggagttcggcaaggccaaggggtcccgcgccatctggtacatgtggctcggcgcccggttcctggagttcgaggccctgggcttcatgaacgaggaccactggttcagccgcgagaactccctcagcggggtggagggcgaggggctgcacaagctgggctacatcctccgggacatctccaagatccccgggggcaacatgtacgcggacgacaccgccggctgggacacgcgcatcaccgaggacgacctgcagaacgaggccaagatcaccgacatcatggagccggagcacgccctgctcgccaccagcatcttcaagctgacgtaccagaacaaggtggtccgggtgcagcgccccgcgaagaacgggaccgtgatggacgtcatctcccgccgggaccagcgcggcagcggccaggtgggcacctacggcctgaacaccttcacgaacatggaggcccagctcatccggcagatggagtccgaggggatcttcctgcccagcgagctggagacccccaacctcgccgagcgcgtgctggactggctggagaagtacggcgtcgagcggctcaagcgcatggccatctccggggacgactgcgtggtgaagccgatcgacgaccggttcgccaccgcgctgaccgccctgaacgacatgggcaaggtccgcaaggacatcccccagtgggagcccagcaaggggtggaacgactggcagcaggtccccttctgctcccaccacttccaccagctcatcatgaaggacggccgggagatcgtggtcccgtgccgcaaccaggacgagctggtgggccgggcccgcgtgagccagggggccggctggtccctgcgggagacggcctgcctcggcaagagctacgcgcagatgtggcagctgatgtacttccaccgccgggacctgcgcctcgccgccaacgccatctgcagcgcggtccccgtggactgggtgcccacctcccggaccacctggagcatccacgcccaccaccagtggatgacgaccgaggacatgctgtccgtctggaaccgcgtgtggatcgaggagaacccctggatggaggacaagacccacgtgagctcctggggcgacgtcccgtacctggggaagcgggaggaccagtggtgcggcagcctcatcggcctgaccgcccgcgccacctgggcctccaacatccaggtggcgatcaaccaggtgcgccggctgatcgggaacgagaactacctcgactacatgacgagcatgaagcgcttcaagaacgagggcgaccccgagggggccctgtggtga

SEQ ID NO: 8503 - RNA, 9879 nt, synthetic construct
  misc_feature 1..9879: note = derived and/or modified CDS sequence (opt1) from DENV-1__GQ199795__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgagaccgagcccgacgacgtggactgctggtgcaacgccacggacacctgggtgacctacgggacctgcagccagacgggcgagcaccggcgcgacaagcggtccgtggccctcgcgccccacgtgggcctggggctggagacccgcaccgagacctggatgagctccgagggcgcgtggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtcgggaagctggtgcaccagatcttcggcaccgcctacggggtgctgttctccggcgtcagctggacgatgaagatcgggatcggcgtgctgctgacctggctcggcctgaactcccgcagcacctccctgagcatgacctgcatcgccgtggggctcgtcacgctgtacctgggcgtgatggtgcaggccgactccgggtgcgtcatcaactggaagggccgggagctcaagtgcgggagcggcatcttcgtgaccaacgaggtgcacacctggaccgagcagtacaagttccaggccgacagcccgaagcgcctgtccgcggccatcggcaaggcctgggaggagggggtctgcggcatccggagcgccacccgcctggagaacatcatgtggaagcagatctccaacgagctcaaccacatcctgctggagaacgacatgaagttcacggtggtggtcggggacgtggccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtcgaggactacggcttcgggatcttcacgaccaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacgtgcatctggcccaagtcccacaccctgtggagcaacggcgtgctcgagtccgagatgatcatccccaagatctacgggggcccgatcagccagcacaactaccgccccgggtacttcacccaggccgccggcccctggcacctggggaagctggagctcgacttcgacctgtgcgagggcaccacggtggtcgtggacgagcactgcggcaaccgggggccgtccctgcgcaccaccaccgtgacgggcaagatcatccacgagtggtgctgccggagctgcaccctgccgcccctccgcttccgcggggaggacggctgctggtacgggatggagatccgccccgtcaaggagaaggaggagaacctggtgaagtccatggtgagcgccggcagcggcgaggtcgactccttcagcctcgggctgctgtgcatctccatcatgatcgaggaggtgatgcggagccgctggtcccggcgcatgctcatgaccggcaccctggccgtgttcttcctgctcatcatggggcagctgacgtggaacgacctgatccgcctctgcatcatggtcggcgcgaacgccagcgaccggatggggatgggcaccacctacctggccctgatggccaccttcaagatgcgcccgatgttcgccgtgggcctcctgttccggcgcctgacgtcccgggaggtgctcctgctgaccatcgggctcagcctggtcgcgtccgtggagctgcccaacagcctcgaggagctgggcgacgggctggccatgggcatcatgatcctcaagctgctgaccgacttccagtcccaccagctctgggccaccctgctgagcctcacgttcatcaagaccaccttctccctgcactacgcctggaagaccatggcgatggtcctgagcatcgtgtccctcttccccctgtgcctgagcacgacctcccagaagaccacctggctccccgtgctgctgggcagcctcgggtgcaagccgctgacgatgttcctgatcgccgagaacaagatctggggccgccggtcctggcccctcaacgaggggatcatggccgtcggcatcgtgagcatcctgctgagctccctcctgaagaacgacgtgcccctggccgggcccctcatcgccggcggcatgctgatcgcgtgctacgtcatcagcgggtccagcgccgacctgtccctcgagaaggccgccgaggtgagctgggaggaggaggccgagcactccggcgcgagccacaacatcctggtggaggtccaggacgacgggaccatgaagatcaaggacgaggagcgcgacgacaccctgaccatcctcctgaaggccaccctgctcgccgtgtccggcgtgtacccgctgagcatccccgccacgctgttcgtctggtacttctggcagaagaagaagcagcggtccggggtgctctgggacacccccagcccgcccgaggtggagcgcgccgtcctggacgacggcatctaccggatcatgcagcgcggcctgctggggcggtcccaggtgggcgtgggggtcttccaggagaacgtgttccacaccatgtggcacgtgacccgcggcgcggtcctcatgtaccaggggaagcggctggagcccagctgggcctccgtgaagaaggacctgatcagctacggcggcgggtggcgcctccagggctcctggaacacgggggaggaggtgcaggtcatcgccgtggagcccggcaagaaccccaagaacgtgcagaccgcccccgggaccttcaagacccccgagggcgaggtcggcgccatcgcgctggacttcaagcccgggacgagcggctcccccatcgtgaaccgggaggggaagatcgtgggcctgtacggcaacggggtcgtgaccaccagcggcacctacgtgagcgccatcgcccaggccaaggcgtcccaggaggggccgctccccgagatcgaggacgaggtcttccgcaagcggaacctgacgatcatggacctgcaccccggcagcgggaagacccgccggtacctcccggccatcgtgcgcgaggccatcaagcgcaagctgcggaccctgatcctcgcccccacccgcgtggtcgcctccgagatggcggaggccctgaagggcatgcccatccggtaccagacgaccgccgtcaagagcgagcacaccggcaaggagatcgtggacctgatgtgccacgccaccttcacgatgcgcctcctgtcccccgtccgggtgccgaactacaacatgatcatcatggacgaggcccacttcaccgaccccagctccatcgcggcccgcgggtacatcagcacccgggtgggcatgggggaggccgccgccatcttcatgaccgcgacgccgcccggctccgtcgaggccttcccgcagagcaacgccgtgatccaggacgaggagcgcgacatccccgagcggtcctggaacagcgggtacgagtggatcaccgacttccccggcaagaccgtgtggttcgtcccctccatcaagagcggcaacgacatcgccaactgcctgcgcaagaacgggaagcgggtgatccagctctcccgcaagaccttcgacacggagtaccagaagaccaagaacaacgactgggactacgtggtcaccaccgacatcagcgagatgggcgcgaacttccgggccgaccgcgtgatcgacccgcggcgctgcctgaagcccgtgatcctgaaggacgggcccgagcgggtcatcctcgccggccccatgccggtgacggtcgcctccgccgcgcagcgccgggggcgcatcggccgcaaccacaacaaggagggcgaccagtacatctacatggggcagcccctgaacaacgacgaggaccacgcccactggaccgaggccaagatgctgctcgacaacatcaacacccccgagggcatcatccccgccctgttcgagccggagcgggagaagtccgccgcgatcgacggggagtaccgcctgcggggcgaggcccgcaagaccttcgtggagctcatgcggcgcggggacctgcccgtgtggctgtcctacaaggtcgccagcgagggcttccagtacagcgaccggcgctggtgcttcgacggcgagcggaacaaccaggtgctcgaggagaacatggacgtggagatctggacgaaggagggggagcgcaagaagctgcggccccgctggctggacgcccggacctactccgaccccctcgccctgcgcgagttcaaggagttcgcggccggccggcgcagcgtctccggggacctgatcctcgagatcggcaagctgccgcagcacctgacccagcgggcccagaacgccctcgacaacctggtgatgctgcacaacagcgagcagggcgggcgcgcgtaccggcacgccatggaggagctccccgacaccatcgagacgctgatgctgctcgccctgatcgccgtgctgaccggcggggtcaccctcttcttcctgtccggccgcgggctgggcaagaccagcatcggcctcctgtgcgtgatggcctccagcgtgctgctctggatggcgtccgtcgagccccactggatcgccgccagcatcatcctggagttcttcctgatggtgctcctgatccccgagccggaccggcagcgcacgccccaggacaaccagctggcctacgtggtcatcgggctcctgttcatgatcctgacggtggccgcgaacgagatgggcctcctggagaccaccaagaaggacctggggatcggccacgtggccgtcgagaaccaccaccacgccgccatgctcgacgtggacctgcaccccgcctccgcgtggaccctgtacgccgtggccacgaccatcatcaccccgatgatgcgccacaccatcgagaacacgaccgccaacatcagcctcaccgccatcgcgaaccaggccgccatcctgatggggctggacaagggctggcccatctccaagatggacatcggcgtccccctcctggccctggggtgctacagccaggtgaaccccctcaccctgacggcggccgtgctgatgctcgtcgcccactacgccatcatcggcccggggctgcaggccaaggcgacccgggaggcccagaagcgcaccgccgccggcatcatgaagaaccccaccgtggacgggatcgtggccatcgacctggaccccgtcgtgtacgacgcgaagttcgagaagcagctcggccagatcatgctgctgatcctctgcacgtcccagatcctgctgatgcggaccacctgggccctctgcgagagcatcaccctggccacgggccccctgaccaccctctgggaggggtccccgggcaagttctggaacaccacgatcgccgtgagcatggccaacatcttccgcgggtcctacctggcgggcgccggcctggccttcagcctcatgaagtccctcgggggcgggcggcgcgggaccggggcccagggcgagaccctgggcgagaagtggaagcggcagctcaaccagctgtccaagagcgagttcaacacctacaagcgctccgggatcatggaggtcgaccggagcgaggcgaaggagggcctgaagcgcggggagacgaccaagcacgccgtgtcccggggcaccgccaagctccgctggttcgtggagcggaacctggtcaagcccgaggggaaggtgatcgacctgggctgcggccgcgggggctggagctactactgcgccgggctgaagaaggtgaccgaggtcaagggctacacgaagggcggccccggccacgaggaccccatcccgatggccacctacgggtggaacctcgtgaagctgcactccggcaaggacgtgttcttcatcccgcccgagaagtgcgacaccctgctctgcgacatcggggagagctcccccaacccgaccatcgaggagggccggacgctgcgcgtcctgaagatggtggagccctggctccgggggaaccagttctgcatcaagatcctgaacccctacatgcccagcgtggtcgagaccctggagcagatgcagcgcaagcacggcggcatgctcgtgcggaacccgctgtcccgcaacagcacccacgagatgtactgggtgtcctgcgggaccggcaacatcgtcagcgcggtgaacatgacctcccgcatgctgctcaaccggttcacgatggcccaccgcaagcccacctacgagcgggacgtggacctgggggccggcacccgccacgtcgccgtggagcccgaggtggccaacctggacatcatcggccagcggatcgagaacatcaagcacgagcacaagagcacctggcactacgacgaggacaacccctacaagacgtgggcgtaccacgggtcctacgaggtcaagccgagcggctccgccagcagcatggtgaacggggtcgtgaagctcctgaccaagccctgggacgtgatccccatggtcacccagatcgccatgaccgacacgacccccttcggccagcagcgcgtgttcaaggagaaggtggacacccggaccccgaaggccaagcgcgggacggcccagatcatggaggtcaccgcgaagtggctgtggggcttcctctcccggaacaagaagccccgcatctgcacccgggaggagttcacccgcaaggtgcggagcaacgccgccatcggcgccgtgttcgtcgacgagaaccagtggaactccgcgaaggaggccgtggaggacgagcgcttctgggacctggtgcaccgggagcgcgagctgcacaagcaggggaagtgcgccacgtgcgtctacaacatgatgggcaagcgggagaagaagctcggggagttcggcaaggccaaggggagccgcgccatctggtacatgtggctgggcgcgcggttcctggagttcgaggccctcggcttcatgaacgaggaccactggttctcccgcgagaacagcctgtccggggtggagggcgaggggctgcacaagctcggctacatcctgcgggacatcagcaagatccccgggggcaacatgtacgccgacgacaccgccggctgggacacccgcatcaccgaggacgacctgcagaacgaggcccgcatcacggacatcatggagccggagcacgcgctcctggccaagtccatcttcaagctgacctaccagaacaaggtggtccgggtgcagcgccccgccaagaacgggaccgtgatggacgtcatcagccggcgcgaccagcggggctccggccaggtggggacctacggcctcaacacgttcaccaacatggaggcccagctgatccgccagatggagagcgaggggatcttctcccccagcgagctggagacccccaacctcgccgagcgggtgctggactggctggagaagtacggcgtcgagcgcctcaagcggatggcgatctccggggacgactgcgtggtgaagccgatcgacgaccgcttcgccaccgccctgacggccctgaacgacatgggcaaggtccggaaggacatcccccagtgggagcccagcaaggggtggaacgactggcagcaggtccccttctgctcccaccacttccaccagctcatcatgaaggacggccgcgagatcgtggtcccgtgccggaaccaggacgagctggtgggccgcgcccgggtgagccagggggcgggctggagcctgcgcgagaccgcctgcctcgggaagtcctacgcccagatgtggcagctgatgtacttccaccggcgcgacctgcggctcgccgcgaacgccatctgcagcgccgtccccgtggactggatccccacctcccgcaccacgtggagcatccacgcccaccaccagtggatgaccaccgaggacatgctgtccgtgtggaaccgcgtctggatcgaggagaacccctggatggaggacaagacccacatcagctcctggggcgacgtgccgtacctggggaagcgggaggaccagtggtgcggcagcctcatcggcctgacggcccgcgcgacctgggccaccaacatccaggtggccatcaaccaggtccggcgcctgatcgggaacgagaactacctcgactacatgacctccatgaagcggttcaagaacgagagcgaccccgagggcgccctgtggtga

SEQ ID NO: 8504 - RNA, 9873 nt, synthetic construct
  misc_feature 1..9873: note = derived and/or modified CDS sequence (opt1) from DENV-1__FJ882547__SS-prME
  source 1..9873: mol_type = other RNA
agcgtgaccatgctgctcatgctgatgcccaccgccctggccttccacctcaccacccgcggcggggagccccacatgatcgtgagcaagcaggagcggggcaagagcctgctgttcaagaccagcgcgggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtgctgttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggccgactccgggtgcgtcatcaactggaagggccgggagctcaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctggagaacatcatgtggaagcagatctccaacgagctcaaccacatcctgctggagaacgacatgaagctcaccgtggtggtcggggacgtggcgggcatcctggggcagggcaagaagatgatccggccccagcccatggagtacaagtacagctggaagtcctggggcaaggccaagatcatcggggccgacgcccagaacacgaccttcatcatcgacggccccaacaccccggagtgccccgacgaccagcgcgcgtggaacatctgggaggtggaggactacgggttcggcatcttcaccacgaacatctggctgaagctccgggacagctacacccaggtctgcgaccaccgcctgatgtccgccgccatcaaggacagcaaggccgtgcacgccgacatgggctactggatcgagtccgagaagaacgagacctggaagctggcgcgggccagcttcatcgaggtgaagacctgcatctggcccaagtcccacacgctctggagcaacggggtcctggagtccgagatgatcatccccaagatctacggcgggccgatcagccagcacaactaccgccccggctacttcacccagaccgccgggccctggcacctgggcaagctcgagctggacttcgacctgtgcgagggcaccacggtggtggtcgacgagcactgcgggaaccggggcccgtccctccgcaccaccaccgtgacggggaagatcatccacgagtggtgctgccggagctgcaccctgccgcccctgcgcttccggggcgaggacgggtgctggtacggcatggagatccgccccgtgaaggagaaggaggagaacctcgtcaagtccatggtgagcgccggcagcggggaggtggactccttcagcctgggcctgctctgcatctccatcatgatcgaggaggtcatgcggagccgctggtcccggaagatgctgatgaccgggaccctggccgtgttcttcctcctgatcatgggccagctgacgtggaacgacctcatccgcctgtgcatcatggtgggggcgaacgccagcgaccgcatgggcatcggcaccacctacctggccctcatggccaccttcaagatgcggccgatgttcgccgtcgggctgctgttccgccggctcacgtcccgcgaggtgctgctgctcaccatcggcctgagcctggtggcgtccgtcgagctccccaacagcctggaggagctgggggacggcctcgccatgggcatcatgatgctgaagctgctcaccgacttccagtcccaccagctgtgggccaccctgctcagcctgacgttcatcaagaccaccttctccctgcactacgcctggaagaccatggcgatggtgctcagcatcgtctccctgttccccctgtgcctcagcacgacctcccagaagaccacctggctgcccgtgctgctcgggagcctgggctgcaagccgctgacgatgttcctcatcgccgagaacaagatctgggggcggaagtcctggcccctgaacgagggcatcatggccgtggggatcgtcagcatcctgctcagctccctgctgaagaacgacgtgcccctcgccggccccctgatcgccggcgggatgctgatcgcgtgctacgtgatcagcggctccagcgccgacctctccctggagaaggccgccgaggtcagctgggaggaggaggccgagcactccggggcgagccacaacatcctggtggaggtgcaggacgacggcaccatgaagatcaaggacgaggagcgcgacgacaccctcaccatcctgctgaaggccaccctcctggccgtctccggggtgtacccgctgagcatccccgccaccctcttcgtgtggtacttctggcagaagaagaagcagcggtccggcgtcctgtgggacacccccagcccgcccgaggtggagcgcgccgtgctggacgacggcatctaccggatcatgcagcgcgggctgctcggccggtcccaggtcggggtgggcgtgttccaggagaacgtcttccacaccatgtggcacgtgacccgcggggcggtgctgatgtaccagggcaagcggctggagcccagctgggcctccgtcaagaaggacctcatcagctacggcgggggctggcgcctgcgggggtcctggaacacgggcgaggaggtccaggtgatcgccgtcgagcccgggaagaaccccaagaacgtgcagaccgcccccggcaccttcaagacccccgagggcgaggtgggggccatcgcgctggacttcaagcccggcacgagcgggtcccccatcgtcaaccgcgagggcaagatcgtgggcctctacgggaacggcgtggtcaccaccagcgggacctacgtgagcgccatcgcccaggccaaggcgtcccaggagggcccgctgcccgagatcgaggacgaggtgttccggaagcgcaacctgacgatcatggacctccaccccgggagcggcaagacccggcgctacctgccggccatcgtccgggaggccatcaagcgcaagctgcgcaccctcatcctggcccccacccgggtggtggcctccgagatggcggaggccctgaagggcatgcccatccgctaccagacgaccgccgtcaagagcgagcacaccgggaaggagatcgtggacctcatgtgccacgccaccttcacgatgcggctgctgtcccccgtgcgcgtcccgaactacaacatgatcatcatggacgaggcccacttcaccgaccccagctccatcgcggcccggggctacatcagcacccgcgtggggatgggcgaggccgccgccatcttcatgaccgcgacgccgcccgggtccgtggaggccttcccgcagagcaacgccgtcatccaggacgaggagcgggacatccccgagcgctcctggaacagcggctacgagtggatcaccgacttccccggcaagaccgtgtggttcgtgccctccatcaagagcgggaacgacatcgccaactgcctccggaagaacggcaagcgcgtcatccagctgtcccggaagaccttcgacacggagtaccagaagaccaagaacaacgactgggactacgtggtgaccaccgacatcagcgagatgggggcgaacttccgcgccgaccgggtcatcgacccgcgccggtgcctgaagcccgtgatcctcaaggacggccccgagcgcgtgatcctggccgggcccatgccggtcacggtggcctccgccgcgcagcggcgcggccggatcggccgcaaccacaacaaggagggggaccagtacatctacatgggccagcccctgaacaacgacgaggaccacgcccactggaccgaggccaagatgctcctggacaacatcaacacccccgaggggatcatccccgccctgttcgagccggagcgcgagaagtccgccgcggtcgacggcgagtaccggctccgcggggaggcccggaagaccttcgtggagctgatgcgccggggcgacctgcccgtgtggctctcctacaaggtcgccagcgagggcttccagtacagcgaccgccggtggtgcttcgacggggagcgcaacaaccaggtgctggaggagaacatggacgtggagatctggacgaaggagggcgaggggaagaagctgcggccccgctggctcgacgcccggacctactccgaccccctggccctgcgcgagttcaaggagttcgcggccggccggcgcagcgtctccggcgacctcatcctggagatcgggaagctgccgcagcacctcacccagcgggcccagaacgccctggacaacctggtgatgctccacaacagcgagcagggcgggcgcgcgtaccggcacgccatggaggagctgcccgacaccatcgagacgctgatgctcctggccctgatcgccgtgctcaccggcggggtcaccctgttcttcctgtccggccgcggcctcgggaagaccagcatcggcctgctgtgcgtgatggcctccagcgtgctcctgtggatggcgtccgtcgagccccactggatcgccgccagcatcatcctggagttcttcctcatggtgctgctgatccccgagccggaccggcagcgcacgccccaggacaaccagctcgcctacgtggtcatcgggctgctgttcatgatcctcacggtggccgcgaacgagatgggcctgctggagaccaccaagaaggacctcgggatcggccacgtggccgtcgagaaccaccaccacgccgccatgctggacgtggacctgcaccccgcctccgcgtggaccctctacgccgtggccacgaccatcatcaccccgatgatgcggcacaccatcgagaacacgaccgccaacatcagcctgaccgccatcgcgaaccaggccgccatcctgatgggcctcgacaaggggtggcccatctccaagatggacatcggcgtccccctgctggccctcgggtgctacagccaggtgaaccccctgaccctgacggcggccgtgctcatgctggtcgcccactacgccatcatcggcccggggctgcaggccaaggcgacccgcgaggcccagaagcgcaccgccgccggcatcatgaagaaccccaccgtggacggcatcgtggccatcgacctcgaccccgtcgtgtacgacgcgaagttcgagaagcagctggggcagatcatgctgctcatcctgtgcacgtcccagatcctgctcatgcggaccacctgggccctgtgcgagagcatcaccctggccacgggccccctcaccaccctgtgggaggggtccccgggcaagttctggaacaccacgatcgccgtgagcatggccaacatcttccgcggctcctacctggcgggggccggcctcgccttcagcctgatgaagtccctcgggggcgggcggcgcggcaccggcgcccagggggagaccctcggcgagaagtggaagcggcagctgaaccagctgtccaagagcgagttcaacacctacaagcgctccgggatcatggaggtcgaccggagcgaggcgaaggagggcctcaagcgcggggagacgaccaagcacgccgtgtcccggggcaccgccaagctgcgctggttcgtggagcggaacctggtcaagcccgagggcaaggtgatcgacctggggtgcggccgcgggggctggagctactactgcgccgggctcaagaaggtgaccgaggtcaagggctacacgaagggcgggcccggccacgaggagcccatcccgatggccacctacgggtggaacctggtgaagctgcactccggcaaggacgtgttcttcatcccgcccgagaagtgcgacaccctcctgtgcgacatcggggagagctcccccaacccgaccatcgaggagggccggacgctgcgcgtcctcaagatggtggagccctggctgcggggcaaccagttctgcatcaagatcctgaacccctacatgcccagcgtggtcgagaccctcgagcagatgcagcgcaagcacgggggcatgctggtgcggaacccgctgtcccgcaacagcacccacgagatgtactgggtgtcctgcgggaccggcaacatcgtcagcgcggtgaacatgacctcccggatgctcctgaaccgcttcacgatggcccaccgcaagcccacctacgagcgggacgtggacctgggcaccgggacccgccacgtcgccgtggagcccgaggtggccaacctcgacatcatcggccagcggatcgagaacatcaagcacgagcacaagagcacgtggcactacgacgaggacaacccctacaagacctgggcctaccacgggtcctacgaggtcaagccgagcggctccgcgagcagcatggtgaacggggtcgtgaagctgctgaccaagccctgggacgtgatccccatgtcccccatcgccatgaccgacacgaccccgctcgcccagcgcgtcttcaaggagaaggtggacacccggacccccaaggccaagcgcggcacggcccagatcatggaggtgaccgcgcggtggctgtggggcttcctgagccgcaacaagaagccccggatctgcacccgcgaggagttcacccggaaggtccgctccaacgccgccatcggggccgtgttcgtggacgagaaccagtggaacagcgcgaaggaggccgtcgaggacgagcggttctgggacctcgtgcaccgcgagcgggagctgcacaagcagggcaagtgcgccacgtgcgtgtacaacatgatggggaagcgcgagaagaagctgggcgagttcgggaaggccaagggctcccgggccatctggtacatgtggctcggcgcgcgcttcctggagttcgaggccctggggttcatgaacgaggaccactggttcagccgggagaactccctcagcggcgtcgagggggagggcctgcacaagctggggtacatcctccgcgacatctccaagatcccgggcggcaacatgtacgccgacgacaccgccgggtgggacacccggatcaccgaggacgacctgcagaacgaggccaagatcacggacatcatggagcccgagcacgcgctgctcgccaaggccatcttcaagctgacctaccagaacaaggtggtgcgcgtccagcgccccgccaagaacggcaccgtgatggacgtgatcagccggcgcgaccagcgggggtccggccaggtcggcacctacgggctgaacacgttcaccaacatggaggcccagctcatccgccagatggagagcgaggagatcttctcccccagcgagctggagaccccgaacctggcggagcgggccctcgactggctggagaagtacggcgtggagcgcctgaagcggatggccatctccggggacgactgcgtggtcaagcccatcgacgaccgcttcgccaccgccctcacggcgctgaacgacatgggcaaggtgcggaaggacatcccccagtgggagcccagcaaggggtggaacgactggcagcaggtcccgttctgctcccaccacttccaccagctgatcatgaaggacggccgcgagatcgtcgtgccctgccggaaccaggacgagctcgtgggccgcgcccgggtcagccagggggccggctggagcctgcgcgagaccgcctgcctggggaagtcctacgcgcagatgtggcagctcatgtacttccaccggcgcgacctgcggctggccgccaacgccatctgcagcgccgtgcccgtggactgggtccccacctcccgcaccacgtggagcatccacgcgcaccaccagtggatgaccaccgaggacatgctctccgtgtggaaccgggtgtggatcgaggagaacccgtggatggaggacaagacccacatcagctcctgggaggacgtcccctacctgggcaagcgcgaggaccagtggtgcgggagcctgatcggcctcacggcccgcgccacctgggccaccaacatccaggtggccatcaaccaggtgcggcgcctgatcggcaacgagaactacctggactacatgacctccatgaagcggttcaagaacgagagcgaccccgagggggcgctctggtga

SEQ ID NO: 8505 - RNA, 9879 nt, synthetic construct
  misc_feature 1..9879: note = derived and/or modified CDS sequence (opt1) from DENV-1__GQ199797__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagaccagcgcgggggtgaacatgtgcaccctcatcgccatggacctgggcgagttctgcgaggacacgatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagaccgtccagtacgagaacctgaagtacagcgtgatcgtgaccgtccacacgggcgaccagcaccaggtggggaacgagtccaccgagcacggcaccaccgcgaccatcacgccccaggcccccagcaccgagatccagctgaccgactacggggccctcaccctggactgcagcccccggacgggcctggacttcaacgagatggtcctcctgaccatgaaggagaagtcctggctggtgcacaagcagtggttcctcgacctgccgctgccctggaccagcggggcctccaccagccaggagacgtggaaccggaaggacctcctggtgaccttcaagaccgcccacgcgaagaagcaggaggtcgtggtgctgggctcccaggagggcgccatgcacaccgccctcacgggggccaccgagatccagaccagcggcaccacgaccatcttcgccgggcacctgaagtgccgcctgaagatggacaagctcaccctgaagggcatgtcctacgtcatgtgcaccgggagcttcaagctggagaaggaggtggcggagacgcagcacggcaccgtgctcgtccagatcaagtacgagggcaccgacgccccctgcaagatccccttctccacccaggacgagaagggggtgacgcagaacggccggctgatcaccgccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacacggcctgggacttcgggagcatcggcggcgtgttcacctccgtcgggaagctggtgcaccagatcttcggcaccgcctacggggtgctgttcagcggcgtctcctggaccatgaagatcgggatcggcgtgctcctgacgtggctgggcctcaacagccgctccaccagcctgtccatgacctgcatcgccgtggggctggtcaccctctacctgggcgtgatggtgcaggccgacagcgggtgcgtcatcaactggaagggccgggagctgaagtgcgggagcggcatcttcgtgacgaacgaggtgcacacctggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagttcaccgtggtggtcggggacgtggcgggcatcctggcccaggggaagaagatgatccggccccagcccatggagtacaagtactcctggaagtcctggggcaaggccaagatcatcggcgccgacgtgcagaacacgaccttcatcatcgacgggcccaacaccccggagtgccccgacgaccagcgcgcgtggaacatctgggaggtcgaggactacggcttcgggatcttcaccacgaacatctggctcaagctgcgggactcctacacccaggtgtgcgaccaccgcctgatgagcgccgccatcaaggactccaaggccgtgcacgccgacatgggctactggatcgagagcgagaagaacgagacctggaagctcgcgcgggcctccttcatcgaggtcaagacctgcatctggcccaagagccacacgctgtggtccaacggcgtgctggagagcgagatgatcatccccaagatctacgggggcccgatctcccagcacaactaccgccccgggtacttcacccagaccgccggcccctggcacctcgggaagctggagctggacttcgacctctgcgagggcaccacggtggtcgtggacgagcactgcggcaaccgggggccgagcctgcgcaccaccaccgtgacgggcaagatcatccacgagtggtgctgccggtcctgcaccctgccgcccctgcgcttcaagggggaggacggctgctggtacgggatggagatccggcccgtcaaggagaaggaggagaacctggtcaagagcatggtgagcgccggctccggcgaggtcgacagcttctccctggggctcctgtgcatcagcatcatgatcgaggaggtgatgcgctcccggtggagccgcaagatgctgatgaccggcaccctcgccgtgttcttcctgctgatcatggggcagctcacgtggaacgacctgatccggctgtgcatcatggtcggcgcgaacgcctccgaccgcatggggatgggcaccacctacctcgccctgatggccaccttcaagatgcgcccgatgttcgccgtgggcctcctgttccggcgcctgacgagccgggaggtgctgctcctgaccatcgggctgtccctcgtcgcgagcgtggagctgcccaactccctggaggagctcggcgacgggctggccatgggcatcatgatcctgaagctcctgaccgacttccagagccaccagctgtgggccaccctcctgtccctgacgttcatcaagaccaccttcagcctccactacgcctggaagaccatggcgatggtcctgtccatcgtgagcctgttccccctctgcctgtccacgaccagccagaagaccacctggctgcccgtgctcctgggctccctggggtgcaagccgctcacgatgttcctgatcgccgagaacaagatctggggccgcaagagctggcccctgaacgaggggatcatggccgtcggcatcgtgagcatcctcctgtccagcctgctcaagaacgacgtgcccctggccgggcccctgatcgccggcggcatgctcatcgcgtgctacgtcatctccgggagctccgccgacctgagcctggagaaggccgccgaggtgtcctgggaggaggaggccgagcacagcggcgcgtcccacaacatcctcgtggaggtccaggacgacgggaccatgaagatcaaggacgaggagcgggacgacaccctgaccatcctgctcaaggccaccctgctggccgtgagcggcgtgtacccgctctccatccccgccacgctgttcgtctggtacttctggcagaagaagaagcagcgcagcggggtgctgtgggacacccccagcccgcccgaggtggagcgggccgtcctcgacgacggcatctaccgcatcatgcagcggggcctgctggggcgcagccaggtgggcgtgggggtcttccaggagaacgtgttccacaccatgtggcacgtgacccggggcgcggtcctgatgtaccaggggaagcgcctcgagccctcctgggccagcgtgaagaaggacctgatctcctacggcggcgggtggcggctgcagggcagctggaacacgggggaggaggtgcaggtcatcgccgtggagcccggcaagaaccccaagaacgtgcagaccgcccccgggaccttcaagacctccgagggcgaggtcggcgccatcgcgctcgacttcaagcccgggacgagcggcagccccatcgtgaaccgcgaggggaagatcgtgggcctgtacggcaacggggtcgtgaccacctccggcacctacgtgagcgccatcgcccaggccaaggcgtcccaggaggggcccctgccggagatcgaggacgaggtcttccggaagcgcaacctcacgatcatggacctgcaccccggcagcgggaagacccggcgctacctgcccgccatcgtgcgggaggccatcaagcgcaagctccggaccctgatcctggccccgacccgcgtggtcgcctccgagatggcggaggccctcaagggcatgcccatccgctaccagacgaccgccgtcaagagcgagcacaccggcaaggagatcgtggacctgatgtgccacgccaccttcacgatgcggctgctctcccccgtccgcgtgcccaactacaacatgatcatcatggacgaggcccacttcaccgacccgagctccatcgcggcccgggggtacatcagcacccgcgtgggcatgggggaggccgccgccatcttcatgaccgcgacgccgcccggctccgtcgaggccttcccccagagcaacgccgtgatccaggacgaggagcgggacatcccggagcgctcctggaacagcgggtacgagtggatcaccgacttccccggcaagaccgtgtggttcgtcccctccatcaagagcggcaacgacatcgccaactgcctgcggaagaacgggaagcgcgtgatccagctgtcccggaagaccttcgacacggagtaccagaagaccaagaacaacgactgggactacgtggtcaccaccgacatcagcgagatgggcgcgaacttccgcgccgaccgggtgatcgacccccgccggtgcctcaagccggtgatcctgaaggacgggcccgagcgcgtcatcctggccggccccatgcccgtgacggtcgcctccgccgcgcagcggcgcgggcggatcggccgcaaccacaacaaggagggcgaccagtacatctacatggggcagccgctcaacaacgacgaggaccacgcccactggaccgaggccaagatgctgctggacaacatcaacacccccgagggcatcatccccgccctcttcgagcccgagcgggagaagtccgccgcgatcgacggggagtaccgcctgcgcggcgaggcccggaagaccttcgtggagctgatgcgccgcggggacctcccggtgtggctgagctacaaggtcgcctccgagggcttccagtacagcgaccgccggtggtgcttcgacggcgagcgcaacaaccaggtgctggaggagaacatggacgtggagatctggacgaaggagggggagcggaagaagctccgcccccggtggctggacgcccgcacctactccgaccccctggccctccgggagttcaaggagttcgcggccggccgccggagcgtctccggggacctgatcctggagatcggcaagctcccccagcacctgacccagcgcgcccagaacgccctggacaacctcgtgatgctgcacaacagcgagcagggcgggcgggcgtaccgccacgccatggaggagctgccggacaccatcgagacgatgatgctcctggccctgatcgccgtgctcaccggcggggtcaccctgttcttcctgtccggccgggggctcggcaagaccagcatcggcctgctgtgcgtgatggcctccagcgtgctcctgtggatggcgtccgtcgagccccactggatcgccgccagcatcatcctggagttcttcctcatggtgctgctgatccccgagcccgaccgccagcggaccccgcaggacaaccagctcgcctacgtggtcatcgggctgctgttcatgatcctcacggtggccgcgaacgagatgggcctgctggagaccaccaagaaggacctcgggatcggccacgtggccgtcgagaaccaccaccacgccgccatgctggacgtggacctgcaccccgcctccgcgtggaccctctacgccgtggccacgaccatcatcacccccatgatgcgccacaccatcgagaacacgaccgccaacatcagcctgaccgccatcgcgaaccaggccgccatcctgatggggctcgacaagggctggccgatctccaagatggacatcggcgtccccctgctggccctcgggtgctacagccaggtgaaccccctgaccctgacggcggccgtgctcatgctggtcgcccactacgccatcatcggccccgggctgcaggccaaggcgacccgggaggcccagaagcgcaccgccgccggcatcatgaagaacccgaccgtggacgggatcgtggccatcgacctcgaccccgtcgtgtacgacgcgaagttcgagaagcagctgggccagatcatgctgctcatcctgtgcacgtcccagatcctgctcatgcgcaccacctgggccctgtgcgagagcatcaccctggccacgggccccctcaccaccctgtgggaggggtcccccggcaagttctggaacaccacgatcgccgtgagcatggccaacatcttccgggggagctacctggcgggcgccggcctcgccttctccctgatgaagtccctcgggggcgggcgccgggggaccggggcccagggcgagaccctcggcgagaagtggaagcgccagctgaaccagctgtccaagagcgagttcaacacctacaagcggtccgggatcatggaggtcgaccgcagcgaggcgaaggagggcctcaagcgcggggagacgaccaagcacgccgtgtcccgcggcaccgccaagctgcggtggttcgtggagcgcaacctggtcaagccggaggggaaggtgatcgacctcggctgcggccgcggcgggtggagctactactgcgccgggctgaagaaggtgaccgaggtcaaggggtacacgaagggcggccccggccacgaggagcccatccccatggccacctacgggtggaacctggtgaagctgcactccggcaaggacgtgttcttcatcccgcccgagaagtgcgacaccctcctgtgcgacatcggggagagctcccccaaccccaccatcgaggagggccgcacgctgcgggtcctcaagatggtggagccgtggctgcgcgggaaccagttctgcatcaagatcctgaacccctacatgcccagcgtggtcgagaccctcgagcagatgcagcggaagcacggcggcatgctggtgcgcaaccccctgtcccggaacagcacccacgagatgtactgggtgtcctgcgggaccggcaacatcgtcagcgcggtgaacatgacctcccgcatgctcctgaaccggttcacgatggcccaccgcaagccgacctacgagcgcgacgtggacctgggggccggcacccggcacgtcgccgtggagcccgaggtggccaacctcgacatcatcggccagcgcatcgagaacatcaagcacgagcacaagagcacctggcactacgacgaggacaacccctacaagacgtgggcgtaccacgggtcctacgaggtcaagcccagcggcagcgcctccagcatggtgaacggggtcgtgaagctgctgaccaagccgtgggacgtgatccccatggtcacccagatcgccatgaccgacacgacccccttcggccagcagcgggtgttcaaggagaaggtggacacccgcacccccaaggccaagcgggggacggcccagatcatggaggtcaccgcgaagtggctctggggcttcctgtcccgcaacaagaagccgcggatctgcacccgcgaggagttcacccggaaggtgcgcagcaacgccgccatcggcgccgtgttcgtcgacgagaaccagtggaactccgcgaaggaggccgtggaggacgagcggttctgggacctggtgcaccgcgagcgggagctccacaagcaggggaagtgcgccacgtgcgtctacaacatgatgggcaagcgcgagaagaagctgggggagttcggcaaggccaaggggagccgggccatctggtacatgtggctgggcgcgcgcttcctcgagttcgaggccctgggcttcatgaacgaggaccactggttctcccgggagaacagcctgtccggggtggagggcgaggggctccacaagctgggctacatcctgcgcgacatcagcaagatccccgggggcaacatgtacgccgacgacaccgccggctgggacacccggatcaccgaggacgacctccagaacgaggccaagatcacggacatcatggagcccgagcacgcgctgctggccaagtccatcttcaagctcacctaccagaacaaggtggtccgcgtgcagcggccggccaagaacgggaccgtgatggacgtcatcagccgccgcgaccagcggggctccggccaggtgggcacctacggcctgaacacgttcaccaacatggaggcccagctgatccgccagatggagagcgaggggatcttctcccccagcgagctcgagacccccaacctggcccggcgcgtgctggactggctcgagaagcacggcgtcgagcggctgaagcgcatggcgatctccggggacgactgcgtggtgaagcccatcgacgaccggttcgccaccgccctgacggccctcaacgacatgggcaaggtccgcaaggacatcccgcagtgggagcccagcaaggggtggaacgactggcagcaggtccccttctgcagccaccacttccaccagctgatcatgaaggacggccgggagatcgtggtcccctgccgcaaccaggacgagctggtgggccgggcccgcgtgtcccagggggcgggctggagcctccgggagaccgcctgcctggggaagtcctacgcccagatgtggcagctgatgtacttccaccgccgggacctccgcctggccgcgaacgccatctgcagcgccgtcccggtggactgggtgcccacctcccggaccacgtggagcatccacgcccaccaccagtggatgaccaccgaggacatgctgtccgtctggaaccgcgtgtggatcgaggagaacccctggatggaggacaagacccacatcagctcctggggcgacgtgccctacctcgggaagcgggaggaccagtggtgcggcagcctgatcggcctgacggcccgcgcgacctgggccaccaacatccaggtcgccatcaaccaggtgcgccggctcatcgggaacgagaactacctggactacatgacctccatgaagcgcttcaagaacgagagcgacccggagggcgccctgtggtga

SEQ ID NO: 8506 - RNA, 9879 nt, synthetic construct
  misc_feature 1..9879: note = derived and/or modified CDS sequence (opt1) from DENV-1__GQ199799__SS-prME
  source 1..9879: mol_type = other RNA
agcgtgaccatgctgctgatgctgatgcccaccgccctggccttccacctcaccacccggggcggggagccccacatgatcgtgagcaagcaggagcggggcaagagcctgctgttcaagacctccgccggggtgaacatgtgcaccctcatcgccatggacctgggcgagttctgcgaggacaccatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtcgagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgccccacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggaccagcggggcctccaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctcgtccagatcaagtacgagggcaccgacgccccctgcaagatccccttctccacccaggacgagaagggggtgacccagaacggccggctgatcacggccaaccccatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacaccgcctgggacttcgggagcatcggcggcgtgttcacgtccgtcgggaagctggtgcaccagatcttcggcaccgcctacggggtgctgttcagcggcgtctcctggaccatgaagatcgggatcggcgtgctcctgacctggctgggcctcaacagccgctccacgagcctgtccatgacctgcatcgccgtggggctggtcaccctctacctgggcgtgatggtgcaggccgacagcgggtgcgtcatcaactggaagggccgggagctgaagtgcgggagcggcatcttcgtgaccaacgaggtgcacacgtggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagctgaccgtggtggtcggggacgtggcgggcatcctcgcccaggggaagaagatgatccggccccagcccatggagtacaagtactcctggaagtcctggggcaaggccaagatcatcggcgccgacgtgcagaacaccacgttcatcatcgacgggcccaacaccccggagtgccccgacgaccagcgcgcgtggaacatctgggaggtcgaggactacggcttcgggatcttcaccaccaacatctggctgaagctgcgggactcctacacccaggtgtgcgaccaccgcctcatgagcgccgccatcaaggactccaaggccgtgcacgccgacatgggctactggatcgagagcgagaagaacgagacctggaagctggcgcgggcctccttcatcgaggtcaagacctgcatctggcccaagagccacaccctgtggtccaacggcgtgctcgagagcgagatgatcatccccaagatctacgggggcccgatctcccagcacaactaccgccccgggtacttcacgcagaccgccggcccctggcacctggggaagctggagctcgacttcgacctgtgcgagggcaccaccgtggtcgtggacgagcactgcggcaaccgggggccgagcctgcgcacgaccaccgtgaccggcaagatcatccacgagtggtgctgccggtcctgcacgctgccgcccctccgcttcaagggggaggacggctgctggtacgggatggagatccggcccgtcaaggagaaggaggagaacctggtcaagagcatggtgagcgccggctccggcgaggtcgacagcttctccctcgggctgctgtgcatcagcatcatgatcgaggaggtgatgcgctcccggtggagccgcaagatgctcatgaccggcaccctggccgtgttcttcctgctcatcatggggcagctgacctggaacgacctgatccggctctgcatcatggtcggcgcgaacgcctccgaccgcatggggatgggcacgacctacctggccctgatggccaccttcaagatgcgcccgatgttcgccgtgggcctcctgttccggcgcctgaccagccgggaggtgctcctgctgacgatcgggctctccctggtcgcgagcgtggagctgcccaactccctcgaggagctgggcgacgggctggccatgggcatcatgatcctcaagctgctgaccgacttccagccccaccagctctgggccaccctgctgagcctcaccttcatccgcacgaccttctccctgcactacgcctggaagaccatggcgatggtcctgagcatcgtgtccctcttccccctgtgcctgagcaccacgtcccagaagaccacctggctcccggtgctgctgggcagcctcgggtgcaagcccctgaccatgttcctgatcgccgagaacaagatctggggccggaagtcctggcccctcaacgaggggatcatggccgtcggcatcgtgagcatcctgctgagctccctcctgaagaacgacgtgcccctggccgggccgctcatcgccggcggcatgctgatcgcgtgctacgtcatcagcgggtccagcgccgacctgtccctcgagaaggccgccgaggtgagctgggaggaggaggccgagcactccggcgcgagccacaacatcctggtggaggtccaggacgacgggacgatgaagatcaaggacgaggagcgcgacgacaccctgaccatcctcctgaaggccaccctgctcgccgtgtccggcgtgtaccccctgagcatccccgccaccctgttcgtctggtacttctggcagaagaagaagcagcggtccggggtgctctgggacacgcccagcccgcccgaggtggagcgcgccgtcctggacgacggcatctaccggatcatgcagcgcggcctgctggggcggtcccaggtgggcgtgggggtcttccaggagaacgtgttccacaccatgtggcacgtgacccgcggcgcggtcctcatgtaccaggggaagcggctggagcccagctgggcctccgtgaagaaggacctgatcagctacggcggcgggtggcgcctccagggctcctggaacaccggggaggaggtgcaggtcatcgccgtggagcccggcaagaacccgaagaacgtgcagacggcccccgggaccttcaagaccagcgagggcgaggtcggcgccatcgcgctggacttcaagcccgggacctccggcagccccatcgtgaaccgggaggggaagatcgtgggcctgtacggcaacggggtcgtgacgaccagcggcacctacgtgtccgccatcgcccaggccaaggcgagccaggaggggccgctccccgagatcgaggacgaggtcttccgcaagcggaacctgaccatcatggacctgcaccccggctccgggaagacgcgccggtacctcccggccatcgtgcgcgaggccatcaagcggcgcctgcgcaccctgatcctcgcccccacccgggtggtcgccagcgagatggcggaggccctgaagggcatgcccatccgctaccagaccacggccgtgaagtccgagcacaccggcaaggagatcgtggacctgatgtgccacgccaccttcaccatgcggctcctgagccccgtccgcgtgccgaactacaacatgatcatcatggacgaggcccacttcacggacccctccagcatcgcggcccgggggtacatctccacccgcgtgggcatgggggaggccgccgccatcttcatgaccgcgacgccgcccggcagcgtcgaggccttcccgcagtccaacgccgtgatccaggacgaggagcgggacatccccgagcgcagctggaactccgggtacgagtggatcacggacttccccggcaagaccgtgtggttcgtccccagcatcaagtccggcaacgacatcgccaactgcctgcggaagaacgggaagcgcgtgatccagctcagccggaagaccttcgacaccgagtaccagaagacgaagaacaacgactgggactacgtggtcaccaccgacatctccgagatgggcgcgaacttccgcgccgaccgggtgatcgacccgcgccggtgcctgaagcccgtgatcctgaaggacgggcccgagcgcgtcatcctcgccggccccatgccggtgaccgtcgccagcgccgcgcagcggcgcgggcggatcggccgcaaccacaacaaggagggcgaccagtacatctacatggggcagcccctgaacaacgacgaggaccacgcccactggacggaggccaagatgctgctcgacaacatcaacacccccgagggcatcatccccgccctgttcgagccggagcgcgagaagtccgccgcgatcgacggggagtaccggctgcgcggcgaggcccggaagaccttcgtggagctcatgcgccgcggggacctgcccgtgtggctgagctacaaggtcgccagcgagggcttccagtactccgaccgccggtggtgcttcgacggcgagcgcaacaaccaggtgctcgaggagaacatggacgtggagatctggaccaaggagggggagcggaagaagctgcgcccccggtggctggacgcccgcacgtacagcgaccccctcgccctgcgggagttcaaggagttcgcggccggccgccggtccgtcagcggggacctgatcctcgagatcggcaagctgccgcagcacctgacccagcgcgcccagaacgccctcgacaacctggtgatgctgcacaactccgagcagggcgggcgggcgtaccgccacgccatggaggagctccccgacaccatcgagaccctgatgctgctcgccctgatcgccgtgctgacgggcggggtcaccctcttcttcctgagcggccgggggctgggcaagacctccatcggcctcctgtgcgtgatggccagctccgtgctgctctggatggcgagcgtcgagccccactggatcgccgcctccatcatcctggagttcttcctgatggtgctcctgatccccgagccggaccgccagcggacgccccaggacaaccagctggcctacgtggtcatcgggctcctgttcatgatcctgaccgtggccgcgaacgagatgggcctcctggagacgaccaagaaggacctggggatcggccacgtggccgtcgagaaccaccaccacgccgccatgctcgacgtggacctgcaccccgccagcgcgtggaccctgtacgccgtggccaccacgatcatcaccccgatgatgcgccacaccatcgagaacaccacggccaacatctccctcaccgccatcgcgaaccaggccgccatcctgatggggctggacaagggctggcccatcagcaagatggacatcggcgtccccctcctggccctggggtgctactcccaggtgaaccccctcaccctgaccgcggccgtgctgatgctcgtcgcccactacgccatcatcggcccggggctgcaggccaaggcgacgcgcgaggcccagaagcggaccgccgccggcatcatgaagaaccccaccgtggacgggatcgtggccatcgacctggaccccgtcgtgtacgacgcgaagttcgagaagcagctcggccagatcatgctgctgatcctctgcaccagccagatcctgctgatgcgcacgacctgggccctctgcgagtccatcaccctggccaccggccccctgacgaccctctgggaggggagcccgggcaagttctggaacaccaccatcgccgtgtccatggccaacatcttccgggggagctacctggcgggcgccggcctggccttcagcctcatgaagtccctcgggggcgggcgccgggggacgggggcccagggcgagaccctgggcgagaagtggaagcgccagctcaaccagctgagcaagtccgagttcaacacctacaagcggagcgggatcatggaggtcgaccgctccgaggcgaaggagggcctgaagcgcggggagaccacgaagcacgccgtgagccgcggcaccgccaagctccggtggttcgtggagcgcaacctggtcaagcccgaggggaaggtgatcgacctgggctgcggccgcggcgggtggtcctactactgcgccgggctgaagaaggtgaccgaggtcaaggggtacaccaagggcgggcccggccacgaggagcccatcccgatggccacgtacgggtggaacctcgtgaagctgcacagcggcaaggacgtgttcttcatcccgcccgagaagtgcgacaccctgctctgcgacatcggggagtccagccccaacccgaccatcgaggagggccgcaccctgcgggtcctgaagatggtggagccctggctccgcgggaaccagttctgcatcaagatcctgaacccctacatgccctccgtggtcgagacgctggagcagatgcagcggaagcacggcggcatgctcgtgcgcaacccgctgagccggaactccacccacgagatgtactgggtgagctgcgggaccggcaacatcgtctccgcggtgaacatgaccagccgcatgctgctcaaccgcttcaccatggcccaccggaagcccacgtacgagcgcgacgtggacctgggggccggcacccggcacgtcgccgtggagcccgaggtggccaacctggacatcatcggccagcgcatcgagaacatcaagcacgagcacaagtccacctggcactacgacgaggacaacccctacaagacctgggcgtaccacgggagctacgaggtcaagccgtccggcagcgccagctccatggtgaacggggtcgtgaagctcctgacgaagccctgggacgtgatccccatggtcacccagatcgccatgaccgacaccacgcccttcggccagcagcgggtgttcaaggagaaggtggacacccgcaccccgaaggccaagcgggggaccgcccagatcatggaggtcacggcgaagtggctgtggggcttcctcagccgcaacaagaagccccggatctgcacccgcgaggagttcacccggaaggtgcgctccaacgccgccatcggcgccgtgttcgtcgacgagaaccagtggaacagcgcgaaggaggccgtggaggacgagcggttctgggacctggtgcaccgcgagcgggagctgcacaagcaggggaagtgcgcgacctgcgtctacaacatgatgggcaagcgcgagaagaagctcggggagttcggcaaggccaaggggtcccgggccatctggtacatgtggctgggcgcgcgcttcctggagttcgaggccctcggcttcatgaacgaggaccactggttcagccgggagaactccctgagcggggtggagggcgaggggctgcacaagctcggctacatcctgcgcgacatctccaagatccccgggggcaacatgtacgccgacgacacggccggctgggacacccggatcaccgaggacgacctgcagaacgaggccaagatcaccgacatcatggagccggagcacgcgctcctggccaagagcatcttcaagctgacgtaccagaacaaggtggtccgcgtgcagcgccccgccaagaacgggaccgtgatggacgtcatctcccggcgcgaccagcggggcagcggccaggtgggcacctacggcctcaacaccttcacgaacatggaggcccagctgatccgccagatggagtccgaggggatcttcagcccctccgagctggagacccccaacctcgccggccgggtgctggactggctggagaagcacggggtcgagcgcctcaagcggatggcgatcagcggcgacgactgcgtggtgaagccgatcgacgaccgcttcgccaccgccctgaccgccctgaacgacatggggaaggtccggaaggacatcccccagtgggagccctccaagggctggaacgactggcagcaggtccccttctgcagccaccacttccaccagctcatcatgaaggacggccgcgagatcgtggtcccgtgccggaaccaggacgagctggtggggcgcgcccgggtgagccagggcgcggggtggtccctgcgcgagacggcctgcctcggcaagagctacgcccagatgtggcagctgatgtacttccaccggcgcgacctgcggctcgccgcgaacgccatctgctccgccgtccccgtggactgggtgcccaccagccgcaccacctggtccatccacgcccaccaccagtggatgacgaccgaggacatgctgagcgtctggaaccgggtgtggatcgaggagaacccctggatggaggacaagacccacgtgtccagctggggcgacgtcccgtacctgggcaagcgcgaggaccagtggtgcggctccctcatcgggctgaccgcccgcgcgacgtgggccaccaacatccaggtggccatcaaccaggtgcggcgcctgctcggcaacgagaactacctggactacatgaccagcatgaagcggttcaagaacgagtccgaccccgagggggccctgtggtga

SEQ ID NO: 8507 - RNA, 9879 nt, synthetic construct
  misc_feature 1..9879: note = derived and/or modified CDS sequence (opt1) from DENV-1__GQ199800__SS-prME
  source 1..9879: mol_type = other RNA
agcgtgaccatgctgctcatgctgatgcccaccgccctggccttccacctcacgacccggggcggggagccccacatgatcgtgtccaagcaggagcggggcaagagcctgctgttcaagacctccgccggggtgaacatgtgcaccctcatcgccatggacctgggcgagttctgcgaggacaccatgacctacaagtgcccccgcatcaccgaggccgagcccgacgacgtggactgctggtgcaacgccaccgacacgtgggtcacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtcgagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggaccagcggggcctccaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctcgtccagatcaagtacgagggcaccgacgccccctgcaagatccccttcctgacccaggacgagaagggggtgacccagaacggccggctgatcacggccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacaccgcctgggacttcgggtccatcggcggcgtgttcacgagcgtcgggaagctggtgcaccagatcttcggcaccgcctacggggtgctgttctccggcgtcagctggaccatgaagatcgggatcggcgtgctgctgacctggctcggcctgaactcccgcagcacgtccctgagcatgacctgcatcgccgtggggctcgtcaccctgtacctgggcgtgatggtgcaggccgactccgggtgcgtcatcaactggaagggccgggagctcaagtgcgggagcggcatcttcgtgaccaacgaggtgcacacgtggaccgagcagtacaagttccaggcggacagcccgaagcgcctgtccgccgccatcggcaaggcctgggaggagggggtctgcggcatccggagcgccacccgcctggagaacatcatgtggaagcagatctccaacgagctcaaccacatcctgctggagaacgacatgaagttcaccgtggtggtcggggacgtggcgggcatcctcgcccaggggaagaagatgatccggccccagcccatggagtacaagtacagctggaagtcctggggcaaggccaagatcatcggcgccgacgtgcagaacaccacgttcatcatcgacgggcccaacaccccggagtgccccgacgaccagcgcgcgtggaacatctgggaggtcgaggactacggcttcgggatcttcaccaccaacatctggctgaagctgcgggacagctacacccaggtgtgcgaccaccgcctcatgtccgccgccatcaaggacagcaaggccgtgcacgccgacatgggctactggatcgagtccgagaagaacgagacctggaagctggcgcgggccagcttcatcgaggtcaagacctgcatctggcccaagtcccacaccctgtggagcaacggcgtgctcgagtccgagatgatcatccccaagatctacgggggcccgatcagccagcacaactaccgccccgggtacttcacgcagaccgccggcccctggcacctggggaagctggagctcgacttcgacctgtgcgagggcaccaccgtggtcgtggacgagcactgcggcaaccgggggccgtccctgcgcacgaccaccgtgaccggcaagatcatccacgagtggtgctgccggagctgcacgctgccgcccctccgcttcaagggggaggacggctgctggtacgggatggagatccggcccgtcaaggagaaggaggagaacctggtgaagtccatggtgagcgccggcagcggcgaggtcgactccttcagcctcgggctgctgtgcatctccatcatgatcgaggaggtgatgcgcagccggtggtcccgcaagatgctcatgaccggcaccctggccgtgttcttcctgctcatcatggggcagctgacctggaacgacctgatccggctctgcatcatggtcggcgcgaacgccagcgaccgcatggggatgggcacgacctacctggccctgatggccaccttcaagatgcgcccgatgttcgccgtgggcctcctgttccggcgcctgacctcccgggaggtgctcctgctgacgatcgggctcagcctggtcgcgtccgtggagctgcccaacagcctcgaggagctgggcgacgggctggccatgggcatcatgatcctcaagctgctgaccgacttccagtcccaccagctctgggccaccctgctgagcctcaccttcatcaagacgaccttctccctgcactacgcctggaagaccatggcgatggtcctgagcatcgtgtccctcttccccctgtgcctgagcaccacgtcccagaagaccacctggctccccgtgctgctgggcagcctcgggtgcaagccgctgaccatgttcctgatcgccgagaacaagatctggggccgcaagtcctggcccctcaacgaggggatcatggccgtcggcatcgtgagcatcctgctgagctccctcctgaagaacgacgtgcccctggccgggcccctcatcgccggcggcatgctgatcgcgtgctacgtcatcagcgggtccagcgccgacctgtccctcgagaaggccgccgaggtgagctgggaggaggaggccgagcactccggcgcgagccacaacatcctggtggaggtccaggacgacgggacgatgaagatcaaggacgaggagcgggacgacaccctgaccatcctcctgaaggccaccctgctcgccgtgtccggcgtgtacccgctgagcatccccgccaccctgttcgtctggtacttctggcagaagaagaagcagcgctccggggtgctctgggacacgcccagcccgcccgaggtggagcgggccgtcctggacgacggcatctaccgcatcatgcagcggggcctgctggggcgctcccaggtgggcgtgggggtcttccaggagaacgtgttccacaccatgtggcacgtgacccggggcgcggtcctcatgtaccaggggaagcgcctggagcccagctgggcctccgtgaagaaggacctgatcagctacggcggcgggtggcggctccagggctcctggaacaccggggaggaggtgcaggtcatcgccgtggagcccggcaagaaccccaagaacgtgcagacggcccccgggaccttcaagaccagcgagggcgaggtcggcgccatcgcgctggacttcaagcccgggacctccggcagccccatcgtgaaccgcgaggggaagatcgtgggcctgtacggcaacggggtcgtgacgaccagcggcacctacgtgtccgccatcgcccaggccaaggcgagccaggaggggcccctcccggagatcgaggacgaggtcttccggaagcgcaacctgaccatcatggacctgcaccccggctccgggaagacgcggcgctacctccccgccatcgtgcgggaggccatcaagcgcaagctgcggaccctgatcctcgccccgacccgcgtggtcgccagcgagatggcggaggccctgaagggcatgcccatccgctaccagaccacggccgtgaagtccgagcacaccggcaaggagatcgtggacctgatgtgccacgccaccttcaccatgcggctcctgagccccgtccgcgtgcccaactacaacatgatcatcatggacgaggcccacttcacggacccgtccagcatcgcggcccgggggtacatctccacccgcgtgggcatgggggaggccgccgccatcttcatgaccgcgacgccgcccggcagcgtcgaggccttcccccagtccaacgccgtgatccaggacgaggagcgggacatcccggagcgcagctggaactccgggtacgagtggatcacggacttccccggcaagaccgtgtggttcgtccccagcatcaagtccggcaacgacatcgccaactgcctgcggaagaacgggaagcgcgtgatccagctcagccggaagaccttcgacaccgagtaccagaagacgaagaacaacgactgggactacgtggtcaccaccgacatctccgagatgggcgcgaacttccgcgccgaccgggtgatcgacccccgccggtgcctgaagccggtgatcctgaaggacgggcccgagcgcgtcatcctcgccggccccatgcccgtgaccgtcgccagcgccgcgcagcggcgcgggcggatcggccgcaaccacaacaaggagggcgaccagtacatctacatggggcagccgctgaacaacgacgaggaccacgcccactggacggaggccaagatgctgctcgacaacatcaacacccccgagggcatcatccccgccctgttcgagcccgagcgggagaagtccgccgcgatcgacggggagtaccgcctgcgcggcgaggcccggaagaccttcgtggagctcatgcgccgcggggacctgccggtgtggctgagctacaaggtcgccagcgagggcttccagtactccgaccgccggtggtgcttcgacggcgagcgcaacaaccaggtgctcgaggagaacatggacgtggagatctggaccaaggagggggagcggaagaagctgcgcccccggtggctggacgcccgcacgtacagcgaccccctcgccctgcgggagttcaaggagttcgcggccggccgccggtccgtcagcggggacctgatcctcgagatcggcaagctgccccagcacctgacccagcgcgcccagaacgccctcgacaacctggtgatgctgcacaactccgagcagggcgggcgggcgtaccgccacgccatggaggagctcccggacaccatcgagaccctgatgctgctcgccctgatcgccgtgctgacgggcggggtcaccctcttcttcctgagcggccgggggctgggcaagacctccatcggcctcctgtgcgtgatggccagctccgtgctgctctggatggcgagcgtcgagccccactggatcgccgcctccatcatcctggagttcttcctgatggtgctcctgatccccgagcccgaccgccagcggaccccgcaggacaaccagctggcctacgtggtcatcgggctcctgttcatgatcctgaccgtggccgcgaacgagatgggcctcctggagacgaccaagaaggacctggggatcggccacgtggccgtcgagaaccaccaccacgccgccatgctcgacgtggacctgcaccccgccagcgcgtggaccctgtacgccgtggccaccacgatcatcacccccatgatgcgccacaccatcgagaacaccacggccaacatctccctcaccgccatcgcgaaccaggccgccatcctgatggggctggacaagggctggccgatcagcaagatggacatcggcgtccccctcctggccctggggtgctactcccaggtgaaccccctcaccctgaccgcggccgtgctgatgctcgtcgcccactacgccatcatcggccccgggctgcaggccaaggcgacgcgggaggcccagaagcgcaccgccgccggcatcatgaagaacccgaccgtggacgggatcgtggccatcgacctggaccccgtcgtgtacgacgcgaagttcgagaagcagctcggccagatcatgctgctgatcctctgcaccagccagatcctgctgatgcgcacgacctgggccctctgcgagtccatcaccctggccaccggccccctgacgaccctctgggaggggagccccggcaagttctggaacaccaccatcgccgtgtccatggccaacatcttccgggggagctacctggcgggcgccggcctggccttcagcctcatgaagtccctcgggggcgggcgccgggggacgggggcccagggcgagaccctgggcgagaagtggaagcgccagctcaaccagctgagcaagtccgagttcaacacctacaagcggagcgggatcatggaggtcgaccgctccgaggcgaaggagggcctgaagcgcggggagaccacgaagcacgccgtgagccgcggcaccgccaagctccggtggttcgtggagcgcaacctggtcaagccggaggggaaggtgatcgacctgggctgcggccgcggcgggtggtcctactactgcgccgggctgaagaaggtgaccgaggtcaaggggtacaccaagggcgggcccggccacgaggagcccatccccatggccacgtacgggtggaacctcgtgaagctgcacagcggcaaggacgtgttcttcatcccgcccgagaagtgcgacaccctgctctgcgacatcggggagtccagccccaaccccaccatcgaggagggccgcaccctgcgggtcctgaagatggtggagccgtggctccgcgggaaccagttctgcatcaagatcctgaacccctacatgccctccgtggtcgagacgctggagcagatgcagcggaagcacggcggcatgctcgtgcgcaaccccctgagccggaactccacccacgagatgtactgggtgagctgcgggaccggcaacatcgtctccgcggtgaacatgaccagccgcatgctgctcaaccggttcaccatggcccaccgcaagccgacgtacgagcgcgacgtggacctgggggccggcacccggcacgtcgccgtggagcccgaggtggccaacctggacatcatcggccagcgcatcgagaacatcaagcacgagcacaagtccacctggcactacgacgaggacaacccctacaagacctgggcgtaccacgggagctacgaggtcaagccctccggcagcgccagctccatggtgaacggggtcgtgaagctcctgacgaagccgtgggacgtgatccccatggtcacccagatcgccatgaccgacaccacgcccttcggccagcagcgggtgttcaaggagaaggtggacacccgcacccccaaggccaagcgggggaccgcccagatcatggaggtcacggcgaagtggctgtggggcttcctcagccgcaacaagaagccgcggatctgcacccgcgaggagttcacccggaaggtgcgctccaacgccgccatcggcgccgtgttcgtcgacgagaaccagtggaacagcgcgaaggaggccgtggaggacgagcggttctgggacctggtgcaccgcgagcgggagctgcacaagcaggggaagtgcgcgacctgcgtctacaacatgatgggcaagcgcgagaagaagctcggggagttcggcaaggccaaggggtcccgggccatctggtacatgtggctgggcgcgcgcttcctggagttcgaggccctcggcttcatgaacgaggaccactggttcagccgggagaactccctgagcggggtggagggcgaggggctgcacaagctcggctacatcctgcgcgacatctccaagatccccgggggcaacatgtacgccgacgacacggccggctgggacacccggatcaccgaggacgacctgcagaacgaggccaagatcaccgacatcatggagcccgagcacgcgctcctggccaagagcatcttcaagctgacgtaccagaacaaggtggtccgcgtgcagcggccggccaagaacgggaccgtgatggacgtcatctcccgccgcgaccagcggggcagcggccaggtgggcacctacggcctcaacaccttcacgaacatggaggcccagctgatccgccagatggagtccgaggggatcttcagcccctccgagctggagacccccaacctcgccggccgggtgctggactggctggagaagcacggggtcgagcgcctcaagcggatggcgatcagcggcgacgactgcgtggtgaagcccatcgacgaccgcttcgccaccgccctgaccgccctgaacgacatggggaaggtccggaaggacatcccgcagtgggagccctccaagggctggaacgactggcagcaggtccccttctgcagccaccacttccaccagctcatcatgaaggacggccgcgagatcgtggtcccctgccggaaccaggacgagctggtggggcgcgcccgggtgagccagggcgcggggtggtccctgcgcgagacggcctgcctcggcaagagctacgcccagatgtggcagctgatgtacttccaccggcgcgacctgcggctcgccgcgaacgccatctgctccgccgtcccggtggactgggtgcccaccagccgcaccacctggtccatccacgcccaccaccagtggatgacgaccgaggacatgctgagcgtctggaaccgggtgtggatcgaggagaacccctggatggaggacaagacccacatctccagctggggcgacgtgccctacctgggcaagcgcgaggaccagtggtgcggctccctcatcgggctgaccgcccgggcgacgtgggccaccaacatccaggtcgccatcaaccaggtgcgccgcctgatcggcaacgagaactacctcgactacatgaccagcatgaagcggttcaagaacgagtccgacccggagggggccctgtggtga

SEQ ID NO: 8508 - RNA, 9879 nt, synthetic construct
  misc_feature 1..9879: note = derived and/or modified CDS sequence (opt1) from DENV-1__FJ882548__SS-prME
  source 1..9879: mol_type = other RNA
agcgtgaccatgctgctcatgctgatgcccaccgccctggccttccacctcaccacccgcggcggggagccccacatgatcgtgagcaagcaggagcggggcaagagcctgctgttcaagacctccgccggggtgaacatgtgcaccctcatcgccatggacctgggcgagctgtgcgaggacaccatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctgatccaccagatcttcggcaccgcctacggggtcctgttctccggcgtgagctggaccatgaagatcgggatcggcgtcctgctgacgtggctcggcctgaactcccgcagcacctccctgagcatgacctgcatcgccgtggggctcgtgaccctgtacctgggcgtcatggtgcaggccgactccgggtgcgtgatcaactggaagggccgggagctcaagtgcgggagcggcatcttcgtcacgaacgaggtgcacacctggaccgagcagtacaagttccaggcggacagcccgaagcgcctgtccgccgccatcggcaaggcctgggaggagggggtgtgcggcatccggagcgccacccgcctggagaacatcatgtggaagcagatctccaacgagctcaaccacatcctgctggagaacgacatgaagctcaccgtcgtggtgggggacgtcgcgggcatcctggggcagggcaagaagatgatccggccccagcccatggagtacaagtacagctggaagtcctggggcaaggccaagatcatcggggccgacgcccagaacacgaccttcatcatcgacggccccaacaccccggagtgccccgacgaccagcgcgcgtggaacatctgggaggtggaggactacgggttcggcatcttcaccacgaacatctggctgaagctccgggacagctacacccaggtgtgcgaccaccgcctgatgtccgccgccatcaaggacagcaaggccgtccacgccgacatgggctactggatcgagtccgagaagaacgagacctggaagctggcgcgggccagcttcatcgaggtgaagacctgcatctggcccaagtcccacacgctctggagcaacggggtgctggagtccgagatgatcatccccaagatctacggcgggccgatcagccagcacaactaccgccccggctacttcacccagaccgccgggccctggcacctgggcaagctcgagctggacttcgacctgtgcgagggcaccacggtcgtggtggacgagcactgcgggaaccggggcccgtccctccgcaccaccaccgtcacggggaagatcatccacgagtggtgctgccggagctgcaccctgccgcccctgcgcttccggggcgaggacgggtgctggtacggcatggagatccgccccgtgaaggagaaggaggagaacctcgtgaagtccatggtcagcgccggcagcggggaggtggactccttcagcctgggcctgctctgcatctccatcatgatcgaggaggtgatgcggagccgctggtcccggaagatgctgatgaccgggaccctggccgtcttcttcctcctgatcatgggccagctgacgtggaacgacctcatccgcctgtgcatcatggtgggggcgaacgccttcgaccgcatgggcatgggcaccacctacctggccctcatggccaccttcaagatgcggccgatgttcgccgtggggctgctgttccgccggctcacgagccgcgaggtcctgctgctcaccatcggcctgtccctggtggcgagcgtggagctccccaactccctggaggagctgggggacggcctcgccatgggcatcatgatcctgaagctgctcaccgacttccagagccaccagctgtgggccaccctgctctccctgacgttcatcaagaccaccttcagcctgcactacgcctggaagaccatggcgatggtcctctccatcgtgagcctgctgcccctctgcctgtccacgaccagccagaagaccacctggctgcccgtcctcctggggtccctgggctgcaagccgctcacgatgttcctgatcgccgagaacaagatctgggggcggaagtcctggcccctgaacgagggcatcatggccgtggggatcgtgtccatcctcctgagcagcctgctcaagaacgacgtccccctggccggccccctgatcgccggcgggatgctcatcgcgtgctacgtgatctccggcagctccgccgacctgagcctggagaaggccgccgaggtgtcctgggaggaggaggccgagcacagcggggcgtcccacaacatcctcgtcgaggtgcaggacgacggcaccatgaagatcaaggacgaggagcgcgacgacaccctgaccatcctgctcaaggccaccctgctggccgtgagcggggtctacccgctctccatccccgccacgctgttcgtgtggtacttctggcagaagaagaagcagcggagcggcgtgctgtgggacacccccagcccgcccgaggtcgagcgcgccgtgctggacgacggcatctaccggatcatgcagcgcgggctcctgggccggagccaggtgggggtcggcgtgttccaggagaacgtgttccacaccatgtggcacgtcacccgcggggcggtgctgatgtaccagggcaagcggctcgagccctcctgggccagcgtgaagaaggacctgatctcctacggcgggggctggcgcctgcgggggagctggaacacgggcgaggaggtccaggtgatcgccgtggagcccgggaagaaccccaagaacgtccagaccgcccccggcaccttcaagacccccgagggcgaggtgggggccatcgcgctcgacttcaagcccggcacgtccgggagccccatcgtgaaccgcgagggcaagatcgtcggcctgtacgggaacggcgtggtgaccacctccgggacctacgtcagcgccatcgcccaggccaaggcgagccaggagggcccgctgcccgagatcgaggacgaggtgttccggaagcgcaacctcacgatcatggacctgcaccccgggtccggcaagacccggcgctacctgccggccatcgtgcgggaggccatcaagcgcaagctccgcaccctgatcctggcccccacccgggtcgtggccagcgagatggcggaggccctcaagggcatgcccatccgctaccagacgaccgccgtgaagtccgagcacaccgggaaggagatcgtcgacctgatgtgccacgccaccttcacgatgcggctgctcagccccgtgcgcgtgccgaactacaacatgatcatcatggacgaggcccacttcaccgacccctccagcatcgcggcccggggctacatctccacccgcgtcgggatgggcgaggccgccgccatcttcatgaccgcgacgccgcccgggagcgtggaggccttcccgcagtccaacgccgtgatccaggacgaggagcgggacatccccgagcgcagctggaactccggccacgagtggatcaccgacttccccggcaagaccgtctggttcgtgcccagcatcaagtccgggaacgacatcgccaactgcctgcggaagaacggcaagcgcgtgatccagctgagccggaagaccttcgacacggagtaccagaagaccaagaacaacgactgggactacgtcgtgaccaccgacatctccgagatgggggcgaacttccgcgccgaccgggtgatcgacccgcgccggtgcctcaagcccgtcatcctgaaggacggccccgagcgcgtgatcctggccgggcccatgccggtgacggtcgccagcgccgcgcagcggcgcggccggatcggccgcaaccacaacaaggagggggaccagtacatctacatgggccagcccctcaacaacgacgaggaccacgcccactggaccgaggccaagatgctgctggacaacatcaacacccccgaggggatcatccccgccctcttcgagccggagcgcgagaagtccgccgcggtggacggcgagtaccggctgcgcggggaggcccggaagaccttcgtcgagctgatgcgccggggcgacctccccgtgtggctgagctacaaggtggcctccgagggcttccagtacagcgaccgccggtggtgcttcgacggggagcgcaacaaccaggtcctggaggagaacatggacgtggagatctggacgaaggagggcgagcggaagaagctccgcccccggtggctggacgcccgcacctacagcgaccccctggccctccgggagttcaaggagttcgcggccgggcgccggtccgtgagcggcgacctgatcctggagatcggcaagctcccgcagcacctgacccagcgcgcccagaacgccctggacaacctcgtcatgctgcacaactccgagcagggcgggcgggcgtaccgccacgccatggaggagctgcccgacaccatcgagacgctcatgctgctggccctcatcgccgtgctgaccgggggcgtgaccctgttcttcctcagcgggcggggcctgggcaagacctccatcgggctgctctgcgtcatggccagctccgtgctgctgtggatggcgagcgtggagccccactggatcgccgcctccatcatcctcgagttcttcctgatggtcctgctcatccccgagccggaccgccagcggacgccccaggacaaccagctggcctacgtggtgatcggcctcctcttcatgatcctgacggtcgccgcgaacgagatggggctgctcgagaccaccaagaaggacctgggcatcgggcacgtggccgtggagaaccaccaccacgccgccatgctggacgtcgacctccaccccgccagcgcgtggaccctgtacgccgtggccacgaccatcatcaccccgatgatgcgccacaccatcgagaacacgaccgccaacatctccctgaccgccatcgcgaaccaggccgccatcctcatgggcctggacaagggctggcccatcagcaagatggacatcggggtgcccctgctcgccctgggctgctactcccaggtcaaccccctgaccctcacggcggccgtgctgatgctggtggcccactacgccatcatcgggccgggcctccaggccaaggcgacccgcgaggcccagaagcggaccgccgccgggatcatgaagaaccccaccgtcgacggcatcgtggccatcgacctggaccccgtggtctacgacgcgaagttcgagaagcagctgggccagatcatgctcctgatcctgtgcacgagccagatcctcctgatgcgcaccacctgggccctgtgcgagtccatcaccctcgccacggggcccctgaccaccctgtgggagggcagcccggggaagttctggaacaccacgatcgccgtgtccatggccaacatcttccggggcagctacctcgcgggcgccgggctggccttctccctgatgaagtccctcggcgggggccgccgggggaccggcgcccagggcgagaccctgggggagaagtggaagcgccagctgaaccagctcagcaagtccgagttcaacacctacaagcggagcggcatcatggaggtggaccgctccgaggcgaaggaggggctgaagcggggcgagacgaccaagcacgccgtcagccgcgggaccgccaagctgcggtggttcgtggagcgcaacctggtgaagcccgagggcaaggtcatcgacctcggctgcgggcggggcgggtggtcctactactgcgccggcctgaagaaggtgaccgaggtgaaggggtacacgaagggcggccccgggcacgaggagcccatcccgatggccacctacggctggaacctggtcaagctccacagcgggaaggacgtgttcttcatcccgcccgagaagtgcgacaccctgctgtgcgacatcggcgagtccagccccaacccgaccatcgaggaggggcgcacgctccgggtgctgaagatggtcgagccctggctgcgcggcaaccagttctgcatcaagatcctcaacccctacatgccctccgtggtggagaccctggagcagatgcagcggaagcacggcgggatgctggtccgcaacccgctcagccggaactccacccacgagatgtactgggtgagctgcggcaccgggaacatcgtgtccgcggtcaacatgaccagccgcatgctgctgaaccgcttcacgatggcccaccggaagcccacctacgagcgcgacgtggacctcggcaccggcacccggcacgtggccgtcgagcccgaggtggccaacctggacatcatcgggcagcgcatcgagaacatcaagcacgagcacaagtccacgtggcactacgacgaggacaacccctacaagacctgggcctaccacggcagctacgaggtgaagccgtccgggagcgcgtccagcatggtcaacggcgtggtcaagctgctcaccaagccctgggacgtgatccccatggtgacccagatcgccatgacggacaccacccccttcgggcagcagcgggtcttcaaggagaaggtggacacccgcacgccgaaggccaagcggggcaccgcccagatcatggaggtgaccgcccgctggctgtggggcttcctgagccggaacaagaagccccgcatctgcacccgggaggagttcacgcgcaaggtccggtccaacgcggccatcggggccgtgttcgtggacgagaaccagtggaacagcgccaaggaggcggtcgaggacgagcgcttctgggacctcgtgcaccgggagcgcgagctgcacaagcagggcaagtgcgcgacctgcgtgtacaacatgatggggaagcgggagaagaagctgggcgagttcgggaaggccaagggctcccgcgccatctggtacatgtggctcggcgcccggttcctggagttcgaggcgctggggttcatgaacgaggaccactggttcagccgcgagaactccctcagcggcgtcgagggggagggcctgcacaagctggggtacatcctccgggacatctccaagatccccggcggcaacatgtacgccgacgacaccgccgggtgggacacccgcatcacggaggacgacctgcagaacgaggccaagatcaccgacatcatggagccggagcacgccctgctcgcgaaggccatcttcaagctgacctaccagaacaaggtggtgcgcgtccagcggcccgccaagaacggcaccgtgatggacgtgatcagccgccgggaccagcgcgggtccggccaggtcggcacgtacgggctgaacaccttcaccaacatggaggcccagctcatccggcagatggagagcgagggcatcttctcccccagcgagctggagacccccaacctggccgagcgcgcgctcgactggctggagaagtacggggtggagcggctgaagcgcatggccatctccggcgacgactgcgtggtcaagccgatcgacgaccggttcgccacggccctcaccgccctgaacgacatggggaaggtgcgcaaggacatcccccagtgggagcccagcaagggctggaacgactggcagcaggtccccttctgctcccaccacttccaccagctgatcatgaaggacggccgggagatcgtcgtgccgtgccgcaaccaggacgagctcgtggggcgggcgcgcgtcagccagggcgccgggtggtccctgcgggagaccgcctgcctgggcaagagctacgcccagatgtggcagctcatgtacttccaccgccgggacctgcgcctggcggccaacgccatctgcagcgccgtgcccgtggactgggtccccacctcccggacgacctggagcatccacgcccaccaccagtggatgaccaccgaggacatgctctccgtgtggaaccgcgtgtggatcgaggagaacccctggatggaggacaagacgcacatcagctcctgggaggacgtcccgtacctggggaagcgcgaggaccagtggtgcggcagcctgatcggcctcaccgcgcgggccacctgggccaccaacatccaggtggccatcaaccaggtgcgccggctgatcgggaacgagaactacctggactacatgacctccatgaagcgcttcaagaacgagagcgaccccgagggcgccctctggtga

SEQ ID NO: 8509 - RNA, 9879 nt, synthetic construct
  misc_feature 1..9879: note = derived and/or modified CDS sequence (opt1) from DENV-1__GQ199801__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgaggccgagcccgacgacgtggactgctggtgcaacgccaccgacacgtgggtgacctacgggacctgcagccagaccggcgagcaccggcgggacaagcggtccgtggccctcgcgccccacgtgggcctggggctggagacgcgcaccgagacctggatgagctccgagggcgcctggaagcagatccagcgggtggagacctgggccctccggcaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgacccgcctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctcaccgactacggggccctgaccctggactgcagcccccggaccggcctcgacttcaacgagatggtcctgctgacgatgaaggagaagtcctggctcgtgcacaagcagtggttcctggacctgccgctcccctggaccagcggggcctccaccagccaggagacctggaaccgccaggacctgctggtgacgttcaagaccgcccacgcgaagaagcaggaggtcgtggtgctcggctcccaggagggcgccatgcacaccgccctgaccggggccacggagatccagaccagcggcaccaccacgatcttcgccgggcacctgaagtgccggctcaagatggacaagctgaccctgaagggcatgtcctacgtcatgtgcaccgggagcttcaagctcgagaaggaggtggcggagacccagcacggcacggtgctggtccagatcaagtacgagggcaccgacgccccctgcaagatccccttctccacccaggacgagaagggggtgacccagaacggccgcctgatcacggccaacccgatcgtgaccgacaaggagaagcccgtcaacatcgaggccgagccgcccttcggggagagctacatcgtgatcggcgcgggcgagaaggccctgaagctctcctggttcaagaaggggagctccatcggcaagatgttcgaggccaccgcccgcggggcccgccgcatggcgatcctgggcgacaccgcctgggacttcgggagcatcggcggcgtgttcacgtccgtcgggaagctggtgcaccagatcttcggcaccgcctacggggtgctgttcagcggcgtctcctggaccatgaagatcgggatcggcgtgctgctgacctggctcggcctgaacagccggtccacgagcctgtccatgacctgcatcgccgtggggctcgtcaccctgtacctgggcgtgatggtgcaggccgacagcgggtgcgtcatcaactggaagggccgcgagctcaagtgcgggagcggcatcttcgtgaccaacgaggtgcacacgtggaccgagcagtacaagttccaggcggactccccgaagcggctgagcgccgccatcggcaaggcctgggaggagggggtctgcggcatccgctccgccacccggctggagaacatcatgtggaagcagatcagcaacgagctcaaccacatcctgctggagaacgacatgaagttcaccgtggtggtcggggacgtggcgggcatcctcgcccaggggaagaagatgatccgcccccagcccatggagtacaagtactcctggaagtcctggggcaaggccaagatcatcggcgccgacgtgcagaacaccacgttcatcatcgacgggcccaacaccccggagtgccccgacgaccagcgggcgtggaacatctgggaggtcgaggactacggcttcgggatcttcaccaccaacatctggctgaagctgcgcgactcctacacccaggtgtgcgaccaccggctcatgagcgccgccatcaaggactccaaggccgtgcacgccgacatgggctactggatcgagagcgagaagaacgagacctggaagctggcgcgcgcctccttcatcgaggtcaagacctgcatctggcccaagagccacaccctgtggtccaacggcgtgctcgagagcgagatgatcatccccaagatctacgggggcccgatctcccagcacaactaccggcccgggtacttcacgcagaccgccggcccctggcacctggggaagctggagctcgacttcaacctgtgcgagggcaccaccgtggtcgtggacgagcactgcggcaaccgcgggccgagcctgcggacgaccaccgtgaccggcaagatcatccacgagtggtgctgccgctcctgcacgctgccgcccctccggttcaagggggaggacggctgctggtacgggatggagatccgccccgtcaaggagaaggaggagaacctggtcaagagcatggtgagcgccggctccggcgaggtcgacagcttctccctcgggctgctgtgcatcagcatcatgatcgaggaggtgatgcggtcccgctggagcaagaagatgctcatgaccggcaccctggccgtgttcttcctgctcatcatggggcagctgacctggaacgacctgatccggctctgcatcatggtcggcgcgaacgcctccgaccgcatggggatgggcacgacctacctggccctgatggccaccttcaagatgcgcccgatgctcgccgtgggcctgctgttccggcgcctcaccagccgggaggtgctgctgctcacgatcgggctgtccctggtcgcgagcgtggagctccccaactccctggaggagctgggcgacgggctcgccatgggcatcatgatcctgaagctgctcaccgacttccagagccaccagctgtgggccaccctgctctccctgaccttcatcaagacgacctacagcctgcactacgcctggaagaccatggcgatggtcctctccatcgtgagcctgttccccctgtgcctctccaccacgagccagaagaccacctggctgcccgtgctgctcggctccctggggtgcaagccgctgaccatgttcctcatcgccgagaacaagatctggggccgcaagagctggcccctgaacgaggggatcatggccgtcggcatcgtgagcatcctgctctccagcctgctgaagaacgacgtgcccctcgccgggcccctgatcgccggcggcatgctgatcgcgtgctacgtcatctccgggagctccgccgacctcagcctggagaaggccgccgaggtgtcctgggaggaggaggccgagcacagcggcgcgtcccacaacatcctggtggaggtccaggacgacgggacgatgaagatcaaggacgaggagcgggacgacaccctcaccatcctgctgaaggccaccctcctggccgtgagcggcgtgtacccgctgtccatccccgccaccctcttcgtctggtacttctggcagaagaagaagcagcgcagcggggtgctgtgggacacgcccagcccgcccgaggtggagcgggccgtcctggacgacggcatctaccgcatcatgcagcggggcctgctcgggcgcagccaggtgggcgtgggggtcttccaggagaacgtgttccacaccatgtggcacgtgacccggggcgcggtcctgatgtaccaggggaagcgcctggagccctcctgggccagcgtgaagaaggacctcatctcctacggcggcgggtggcggctgcagggcagctggaacaccggggaggaggtgcaggtcatcgccgtggagcccggcaagaaccccaagaacgtgcagacggcccccgggaccttcaagacctccgagggcgaggtcggcgccatcgcgctggacttcaagcccgggaccagcggcagccccatcgtgaaccgcgaggggaagatcgtgggcctctacggcaacggggtcgtgacgacctccggcacctacgtgagcgccatcgcccaggccaaggcgtcccaggaggggcccctgccggagatcgagaacgaggtcttccggaagcgcaacctgaccatcatggacctccaccccggcagcgggaagacgcggcgctacctgcccgccatcgtgcgggaggccatcaagcgcaagctgcggaccctcatcctggccccgacccgcgtggtcgcctccgagatggcggaggccctgaagggcatccccatccgctaccagaccacggccgtcaagagcgagcacaccggcaaggagatcgtggacctcatgtgccacgccaccttcaccatgcggctgctgtcccccgtccgcgtgcccaactacaacatgatcatcatggacgaggcccacttcacggacccgagctccatcgcggcccgggggtacatcagcacccgcgtgggcatgggggaggccgccgccatcttcatgaccgcgacgccgcccggctccgtcgaggccttcccccagagcaacgccgtgatccaggacgaggagcgggacatcccggagcgctcctggaacagcgggtacgagtggatcacggacttccccggcaagaccgtgtggttcgtcccctccatcaagagcggcaacgacatcgccaactgcctccggaagaacgggaagcgcgtgatccagctgtcccggaagaccttcgacaccgagtaccagaagacgaagaacaacgactgggactacgtggtcaccaccgacatcagcgagatgggcgcgaacttccgcgccgaccgggtgatcgacccccgccggtgcctgaagccggtgatcctcaaggacgggcccgagcgcgtcatcctggccggccccatgcccgtgaccgtcgcctccgccgcgcagcggcgcgggcggatcggccgcaaccacaacaaggagggcgaccagtacatctacatggggcagccgctgaacaacgacgaggaccacgcccactggacggaggccaagatgctcctggacaacatcaacacccccgagggcatcatccccgccctgttcgagcccgagcgggagaagtccgccgcgatcgacggggagtaccgcctccgcggcgaggcccggaagaccttcgtggagctgatgcgccgcggggacctgccggtgtggctcagctacaaggtcgcctccgagggcttccagtacagcgaccgccggtggtgcttcgacggcgagcgcaacaaccaggtgctggaggagaacatggacgtggagatctggaccaaggagggggagcggaagaagctgcgcccccggtggctcgacgcccgcacgtactccgaccccctggccctgcgggagttcaaggagttcgcggccggccgccggagcgtctccggggacctcatcctggagatcggcaagctgccccagcacctcacccagcgcgcccagaacgccctggacaacctggtgatgctccacaacagcgagcagggcgggcgggcgtaccgccacgccatggaggagctgccggacaccatcgagaccctgatgctcctggccctgatcgccgtgctcacgggcggggtcaccctgttcttcctgtccggccgggggctcggcaagaccagcatcggcctgctgtgcgtgatggcctccagcgtgctcctgtggatggcgtccgtcgagccccactggatcgccgccagcatcatcctggagttcttcctcatggtgctgctgatccccgagcccgaccgccagcggaccccgcaggacaaccagctcgcctacgtggtcatcgggctgctgttcatgatcctcaccgtggccgcgaacgagatgggcctgctggagacgaccaagaaggacctcgggatcggccacgtggccgtcgagaaccaccaccacgccgccatgctggacgtggacctgcaccccgcctccgcgtggaccctctacgccgtggccaccacgatcatcacccccatgatgcgccacaccatcgagaacaccacggccaacatcagcctgaccgccatcgcgaaccaggccgccatcctgatggggctcgacaagggctggccgatctccaagatggacatcggcgtccccctgctggccctcgggtgctacagccaggtgaaccccctgaccctgaccgcggccgtgctcatgctggtcgcccactacgccatcatcggccccgggctgcaggccaaggcgacgcgggaggcccagaagcgcaccgccgccggcatcatgaagaacccgaccgtggacgggatcgtggccatcgacctcgaccccgtcgtgtacgacgcgaagttcgagaagcagctgggccagatcatgctgctcatcctgtgcacctcccagatcctgctcatgcgcacgacctgggccctgtgcgagagcatcaccctggccaccggccccctcacgaccctgtgggaggggtcccccggcaagttctggaacaccaccatcgccgtgagcatggccaacatcttccgggggagctacctggcgggcgccggcctcgccttctccctgatgaagtccctcgggggcgggcgccgggggacgggggcccagggcgagaccctcggcgagaagtggaagcgccagctgaaccagctgtccaagagcgagttcaacacctacaagcggtccgggatcatggaggtcgaccgcagcgaggcgaaggagggcctcaagcgcggggagaccacgaagcacgccgtgtcccgcggcaccgccaagctgcggtggttcgtggagcgcaacctggtcaagccggaggggaaggtgatcgacctgggctgcggccgcggcgggtggagctactactgcgccgggctcaagaaggtgaccgaggtcaaggggtacaccaagggcgggcccggccacgaggagcccatccccatggccacgtacgggtggaacctggtgaagctgcactccggcaaggacgtgttcttcatcccgcccgagaagtgcgacaccctcctgtgcgacatcggggagagctcccccaaccccaccatcgaggagggccgcaccctgcgggtcctcaagatggtggagccgtggctgcgcgggaaccagttctgcatcaagatcctgaacccctacatgcccagcgtggtcgagacgctcgagcagatgcagcggaagcacggcggcatgctggtgcgcaaccccctgtcccggaacagcacccacgagatgtactgggtgtcctgcgggaccggcaacatcgtcagcgcggtgaacatgacctcccgcatgctcctgaaccggttcaccatggcccaccgcaagccgacgtacgagcgcgacgtggacctgggggccggcacccggcacgtcgccgtggagcccgaggtggccaacctcgacatcatcggccagcgcatcgagaacatcaagcacgagcacaagagcacctggcactacgacgaggacaacccctacaagacctgggcgtaccacgggtcctacgaggtcaagcccagcggcagcgcctccagcatggtgaacggggtcgtgaagctgctgacgaagccgtgggacgtgatccccatggtcacccagatcgccatgaccgacaccacgcccttcggccagcagcgggtgttcaaggagaaggtggacacccgcacccccaaggccaagcgggggaccgcccagatcatggaggtcacggcgaagtggctctggggcttcctgtcccgcaacaagaagccgcggatctgcacccgcgaggagttcacccggaaggtgcgcagcaacgccgccatcggcgccgtgttcgtcgacgagaaccagtggaactccgcgaaggaggccgtggaggacgagcggttctgggacctggtgcaccgcgagcgggagctccacaagcaggggaagtgcgcgacctgcgtctacaacatgatgggcaagcgcgagaagaagctgggggagttcggcaaggccaaggggagccgggccatctggtacatgtggctgggcgcgcgcttcctcgagttcgaggccctgggcttcatgaacgaggaccactggttctcccgggagaacagcctgtccggggtggagggcgaggggctccacaagctgggctacatcctgcgcgacatcagcaagatccccgggggcaacatgtacgccgacgacacggccggctgggacacccggatcaccgaggacgacctccagaacgaggccaagatcaccgacatcatggagcccgagcacgcgctgctggccaagtccatcttcaagctcacgtaccagaacaaggtggtccgcgtgcagcggccggccaagaacgggaccgtgatggacgtcatcagccgccgcgaccagcggggctccggccaggtgggcacctacggcctgaacaccttcacgaacatggaggcccagctgatccgccagatggagagcgaggggatcttctcccccagcgagctcgagacccccaacctggccggccgggtgctggactggctcgagaagcacggggtcgagcgcctgaagcggatggcgatctccggcgacgactgcgtggtgaagcccatcgacgaccgcttcgccaccgccctgaccgccctcaacgacatggggaaggtccggaaggacatcccgcagtgggagcccagcaagggctggaacgactggcagcaggtccccttctgcagccaccacttccaccagctgatcatgaaggacggccgcgagatcgtggtcccctgccggaaccaggacgagctggtggggcgcgcccgggtgtcccagggcgcggggtggagcctccgcgagacggcctgcctgggcaagtcctacgcccagatgtggcagctgatgtacttccaccggcgcgacctccggctggccgcgaacgccatctgcagcgccgtcccggtggactgggtgcccacctcccgcaccacctggagcatccacgcccaccaccagtggatgacgaccgaggacatgctgtccgtctggaaccgggtgtggatcgaggagaacccctggatggaggacaagacccacatcagctcctggggcgacgtgccctacctcggcaagcgcgaggaccagtggtgcggcagcctgatcgggctgaccgcccgggcgacgtgggccaccaacatccaggtcgccatcaaccaggtgcgccgcctcatcggcaacgagaactacctggactacatgacctccatgaagcggttcaagaacgagagcgacccggagggggccctgtggtga

SEQ ID NO: 8510 - RNA, 9879 nt, synthetic construct
  misc_feature 1..9879: note = derived and/or modified CDS sequence (opt1) from DENV-1__GQ199802__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgcgacaagcggtccgtggccctcgcgccccacgtgggcctggggctggagacccggaccgagacctggatgagctccgagggcgcgtggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtcgggaagctggtgcaccagatcttcggcaccgcctacggggtgctgttctccggcgtcagctggacgatgaagatcgggatcggcgtgctgctgacctggctcggcctgaactcccgcagcacctccctgagcatgacctgcatcgccgtggggctcgtcacgctgtacctgggcgtgatggtgcaggccgactccgggtgcgtcatcaactggaagggccgggagctcaagtgcgggagcggcatcttcgtgaccaacgaggtgcacacctggaccgagcagtacaagttccaggccgacagcccgaagcgcctgtccgcggccatcggcaaggcctgggaggagggggtctgcggcatccggagcgccacccgcctggagaacatcatgtggaagcagatctccaacgagctcaaccacatcctgctggagaacgacatgaagttcacggtggtggtcggggacgtggccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtcgaggactacggcttcgggatcttcacgaccaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacgtgcatctggcccaagtcccacaccctgtggagcaacggcgtgctcgagtccgagatgatcatccccaagatctacgggggcccgatcagccagcacaactaccgccccgggtacttcacccaggccgccggcccctggcacctggggaagctggagctcgacttcgacctgtgcgagggcaccacggtggtcgtggacgagcactgcggcaaccgggggccgtccctgcgcaccaccaccgtgacgggcaagatcatccacgagtggtgctgccggagctgcaccctgccgcccctccgcttcaagggggaggacggctgctggtacgggatggagatccggcccgtcaaggagaaggaggagaacctggtgaagtccatggtgagcgccggcagcggcgaggtcgactccttcagcctcgggctgctgtgcatctccatcatgatcgaggaggtgatgcgcagccggtggtcccgccggatgctcatgaccggcaccctggccgtgttcttcctgctcatcatggggcagctgacgtggaacgacctgatccgcctctgcatcatggtcggcgcgaacgccagcgaccgcatggggatgggcaccacctacctggccctgatggccaccttcaagatgcggccgatgttcgccgtgggcctcctgttccgccggctgacgtcccgcgaggtgctcctgctgaccatcgggctcagcctggtcgcgtccgtggagctgcccaacagcctcgaggagctgggcgacgggctggccatgggcatcatgatcctcaagctgctgaccgacttccagtcccaccagctctgggccaccctgctgagcctcacgttcatcaagaccaccttctccctgcactacgcctggaagaccatggcgatggtcctgagcatcgtgtccctcttccccctgtgcctgagcacgacctcccagaagaccacctggctccccgtgctgctgggcagcctcgggtgcaagccgctgacgatgttcctgatcgccgagaacaagatctggggccggcgctcctggcccctcaacgaggggatcatggccgtcggcatcgtgagcatcctgctgagctccctcctgaagaacgacgtgcccctggccgggcccctcatcgccggcggcatgctgatcgcgtgctacgtcatcagcgggtccagcgccgacctgtccctcgagaaggccgccgaggtgagctgggaggaggaggccgagcactccggcgcgagccacaacatcctggtggaggtccaggacgacgggaccatgaagatcaaggacgaggagcgggacgacaccctgaccatcctcctgaaggccaccctgctcgccgtgtccggcgtgtacccgctgagcatccccgccacgctgttcgtctggtacttctggcagaagaagaagcagcgctccggggtgctctgggacacccccagcccgcccgaggtggagcgggccgtcctggacgacggcatctaccgcatcatgcagcggggcctgctggggcgctcccaggtgggcgtgggggtcttccaggagaacgtgttccacaccatgtggcacgtgacccggggcgcggtcctcatgtaccaggggaagcgcctggagcccagctgggcctccgtgaagaaggacctgatcagctacggcggcgggtggcggctccagggctcctggaacacgggggaggaggtgcaggtcatcgccgtggagcccggcaagaaccccaagaacgtgcagaccgcccccgggaccttcaagacccccgagggcgaggtcggcgccatcgcgctggacttcaagcccgggacgagcggctcccccatcgtgaaccgcgaggggaagatcgtgggcctgtacggcaacggggtcgtgaccaccagcggcacctacgtgagcgccatcgcccaggccaaggcgtcccaggaggggccgctccccgagatcgaggacgaggtcttccggaagcgcaacctgacgatcatggacctgcaccccggcagcgggaagacccggcgctacctcccggccatcgtgcgggaggccatcaagcgcaagctgcgcaccctgatcctcgcccccacccgggtggtcgcctccgagatggcggaggccctgaagggcatgcccatccgctaccagacgaccgccgtcaagagcgagcacaccggcaaggagatcgtggacctgatgtgccacgccaccttcacgatgcggctcctgtcccccgtccgcgtgccgaactacaacatgatcatcatggacgaggcccacttcaccgaccccagctccatcgcggcccgggggtacatcagcacccgcgtgggcatgggggaggccgccgccatcttcatgaccgcgacgccgcccggctccgtcgaggccttcccgcagagcaacgccgtgatccaggacgaggagcgggacatccccgagcgctcctggaacagcgggtacgagtggatcaccgacttccccggcaagaccgtgtggttcgtcccctccatcaagagcggcaacgacatcgccaactgcctgcggaagaacgggaagcgcgtgatccagctctcccggaagaccttcgacacggagtaccagaagaccaagaacaacgactgggactacgtggtcaccaccgacatcagcgagatgggcgcgaacttccgcgccgaccgggtgatcgacccgcgccggtgcctgaagcccgtgatcctgaaggacgggcccgagcgcgtcatcctcgccggccccatgccggtgacggtcgcctccgccgcgcagcggcgcgggcggatcggccgcaaccacaacaaggagggcgaccagtacatctacatggggcagcccctgaacaacgacgaggaccacgcccactggaccgaggccaagatgctgctcgacaacatcaacacccccgagggcatcatccccgccctgttcgagccggagcgcgagaagtccgccgcgatcgacggggagtaccggctgcgcggcgaggcccggaagaccttcgtggagctcatgcgccgcggggacctgcccgtgtggctgtcctacaaggtcgccagcgagggcttccagtacagcgaccgccggtggtgcttcgacggcgagcgcaacaaccaggtgctcgaggagaacatggacgtggagatctggacgaaggagggggagcggaagaagctgcgcccccggtggctggacgcccgcacctactccgaccccctcgccctgcgggagttcaaggagttcgcggccggccgccggagcgtctccggggacctgatcctcgagatcggcaagctgccgcagcacctgacccagcgcgcccagaacgccctcgacaacctggtgatgctgcacaacagcgagcagggcgggcgggcgtaccgccacgccatggaggagctccccgacaccatcgagacgctgatgctgctcgccctgatcgccgtgctgaccggcggggtcaccctcttcttcctgtccggccgggggctgggcaagaccagcatcggcctcctgtgcgtgatggcctccagcgtgctgctctggatggcgtccgtcgagccccactggatcgccgccagcatcatcctggagttcttcctgatggtgctcctgatccccgagccggaccgccagcggacgccccaggacaaccagctggcctacgtggtcatcgggctcctgttcatgatcctgacggtggccgcgaacgagatgggcctcctggagaccaccaagaaggacctggggatcggccacgtggccgtcgagaaccaccaccacgccgccatgctcgacgtggacctgcaccccgcctccgcgtggaccctgtacgccgtggccacgaccatcatcaccccgatgatgcgccacaccatcgagaacacgaccgccaacatcagcctcaccgccatcgcgaaccaggccgccatcctgatggggctggacaagggctggcccatctccaagatggacatcggcgtccccctcctggccctggggtgctacagccaggtgaaccccctcaccctgacggcggccgtgctgatgctcgtcgcccactacgccatcatcggcccggggctgcaggccaaggcgacccgcgaggcccagaagcggaccgccgccggcatcatgaagaaccccaccgtggacgggatcgtggccatcgacctggaccccgtcgtgtacgacgcgaagttcgagaagcagctcggccagatcatgctgctgatcctctgcacgtcccagatcctgctgatgcgcaccacctgggccctctgcgagagcatcaccctggccacgggccccctgaccaccctctgggaggggtccccgggcaagttctggaacaccacgatcgccgtgagcatggccaacatcttccgggggtcctacctggcgggcgccggcctggccttcagcctcatgaagtccctcgggggcgggcgccgggggaccggggcccagggcgagaccctgggcgagaagtggaagcgccagctcaaccagctgtccaagagcgagttcaacacctacaagcggtccgggatcatggaggtcgaccgcagcgaggcgaaggagggcctgaagcgcggggagacgaccaagcacgccgtgtcccgcggcaccgccaagctccggtggttcgtggagcgcaacctggtcaagcccgaggggaaggtgatcgacctgggctgcggccgcggcgggtggagctactactgcgccgggctgaagaaggtgaccgaggtcaaggggtacacgaagggcggccccggccacgaggagcccatcccgatggccacctacgggtggaacctcgtgaagctgcactccggcaaggacgtgttcttcatcccgcccgagaagtgcgacaccctgctctgcgacatcggggagagctcccccaacccgaccatcgaggagggccgcacgctgcgggtcctgaagatggtggagccctggctccgcgggaaccagttctgcatcaagatcctgaacccctacatgcccagcgtggtcgagaccctggagcagatgcagcggaagcacggcggcatgctcgtgcgcaacccgctgtcccggaacagcacccacgagatgtactgggtgtcctgcgggaccggcaacatcgtcagcgcggtgaacatgacctcccgcatgctgctcaaccgcttcacgatggcccaccggaagcccacctacgagcgcgacgtggacctgggggccggcacccggcacgtcgccgtggagcccgaggtggccaacctggacatcatcggccagcgcatcgagaacatcaagcacgagcacaagagcacctggcactacgacgaggacaacccctacaagacgtgggcgtaccacgggtcctacgaggtcaagccgagcggctccgccagcagcatggtgaacggggtcgtgaagctcctgaccaagccctgggacgtgatccccatggtcacccagatcgccatgaccgacacgacccccttcggccagcagcgggtgttcaaggagaaggtggacacccgcaccccgaaggccaagcgggggacggcccagatcatggaggtcaccgcgaagtggctgtgggtgttcctctcccgcaacaagaagccccggatctgcacccgcgaggagttcacccggaaggtgcgcagcaacgccgccatcggcgccgtcttcgtggacgagaaccagtggaactccgcgaaggaggccgtggaggacgagcggttctgggacctggtccaccgcgagcgggagctgcacaagcagggcaagtgcgccacgtgcgtgtacaacatgatggggaagcgcgagaagaagctcggcgagttcgggaaggccaagggcagccgggccatctggtacatgtggctgggggcgcgcttcctggagttcgaggccctcggcttcatgaacgaggaccactggttctcccgggagaacagcctgtccggcgtggagggggagggcctgcacaagctcgggtacatcctgcgcgacatcagcaagatccccggcgggaacatgtacgccgacgacaccgccggctgggacacccggatcaccgaggacgacctgcagaacgaggcccgcatcacggacatcatggagccggagcacgcgctcctggccaagtccatcttcaagctgacctaccagaacaaggtcgtgcgcgtgcagcggcccgccaagaacggcaccgtcatggacgtgatcagccgccgggaccagcgcgggtccggccaggtggggacctacggcctcaacacgttcaccaacatggaggcccagctgatccggcagatggagagcgagggcatcttctcccccagcgagctggagacccccaacctcgccgagcgcgtcctggactggctggagaagtacggggtggagcggctcaagcgcatggcgatctccggcgacgactgcgtggtcaagccgatcgacgaccggttcgccaccgccctgacggccctgaacgacatggggaaggtgcgcaaggacatcccccagtgggagcccagcaagggctggaacgactggcagcaggtccccttctgctcccaccacttccaccagctcatcatgaaggacgggcgggagatcgtcgtgccgtgccgcaaccaggacgagctggtgggccgggcccgcgtcagccagggcgcggggtggagcctgcgggagaccgcctgcctcggcaagtcctacgcccagatgtggcagctgatgtacttccaccgccgggacctgcgcctcgccgcgaacgccatctgcagcgccgtgcccgtggactggatccccacctcccggaccacgtggagcatccacgcccaccaccagtggatgaccaccgaggacatgctgtccgtctggaaccgcgtgtggatcgaggagaacccctggatggaggacaagacccacatcagctcctggggcgacgtgccgtacctgggcaagcgcgaggaccagtggtgcgggagcctcatcggcctgacggcccgggcgacctgggccaccaacatccaggtcgccatcaaccaggtgcgccggctgatcggcaacgagaactacctcgactacatgacctccatgaagcgcttcaagaacgagagcgaccccgagggggccctgtggtga

SEQ ID NO: 8511 - RNA, 9879 nt, synthetic construct
  misc_feature 1..9879: note = derived and/or modified CDS sequence (opt1) from DENV-1__JF937597__SS-prME
  source 1..9879: mol_type = other RNA
agcgtgaccatgctgctcatgctgatgcccaccgccctggccttccacctcaccacccgcggcggggagccccacatgatcgtgagcaagcaggagcggggcaagagcctgctgttcaagaccagcgccggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtggagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtcctcttctccggcgtcagctggaccatgaagatcgggatcggcgtgctgctgacgtggctcggcctgaactcccgcagcacctccctgagcatgacctgcatcgccgtggggctcgtcaccctgtacctgggcgccatggtgcaggcggactccgggtgcgtgatcaactggaagggccgggagctcaagtgcgggagcggcatcttcgtcacgaacgaggtgcacacctggaccgagcagtacaagttccaggccgacagcccgaagcgcctgtccgccgccatcggcaaggcctgggaggagggggtgtgcggcatccggagcgcgacccgcctggagaacatcatgtggaagcagatctccaacgagctcaaccacatcctgctggagaacgacatgaagctcaccgtcgtggtgggggacgtcgccggcatcctggggcagggcaagaagatgatccggccccagcccatggagtacaagtacagctggaagtcctggggcaaggccaagatcatcggggccgacgcgcagaacacgaccttcatcatcgacggccccaacaccccggagtgccccgacgaccagcgcgcctggaacatctgggaggtggaggactacgggttcggcatcttcaccacgaacatctggctgaagctccgggacagctacacccaggtgtgcgaccaccgcctgatgtccgccgccatcaaggacagcaaggccgtccacgcggacatgggctactggatcgagtccgagaagaacgagacctggaagctggcccgggccagcttcatcgaggtgaagacctgcatctggcccaagtcccacacgctctggagcaacggggtgctggagtccgagatgatcatccccaagatctacggcgggccgatcagccagcacaactaccgccccggctacttcacccagaccgccgggccctggcacctgggcaagctcgagctggacttcgacctgtgcgagggcaccacggtcgtggtggacgagcactgcgggaaccggggcccgtccctccgcaccaccaccgtcacggggaagatcatccacgagtggtgctgccggagctgcaccctgccgcccctgcgcttccggggcgaggacgggtgctggtacggcatggagatccgccccgtgaaggagaaggaggagaacctcgtgaagtccatggtcagcgccggcagcggggaggtggactccttcagcctgggcctgctctgcatctccatcatgatcgaggaggtgatgcggagccgctggtcccggaagatgctgatgaccgggaccctggcggtcttcttcctcctgatcatgggccagctgacgtggaacgacctcatccgcctgtgcatcatggtgggggccaacgccagcgaccgcatgggcatgggcaccacctacctggccctcatggccaccttcaagatgcggccgatgttcgcggtggggctgctgttccgccggctcacgtcccgcgaggtcctgctgctcaccatcggcctgagcctggtggcctccgtggagctccccaacagcctggaggagctgggggacggcctcgccatgggcatcatgatcctgaagctgctcaccgacttccagtcccaccagctgtgggccaccctgctcagcctgacgttcatcaagaccaccttctccctgcactacgcgtggaagaccatggccatggtcctcagcatcgtgtccctgttccccctgtgcctcagcacgacctcccagaagaccacctggctgcccgtcctgctcgggagcctgggctgcaagccgctgacgatgttcctcatcgccgagaacaagatctgggggcggaagtcctggcccctgaacgagggcatcatggccgtggggatcgtgagcatcctgctcagctccctgctgaagaacgacgtccccctcgccggccccctgatcgcgggcgggatgctgatcgcctgctacgtgatcagcggctccagcgccgacctctccctggagaaggccgccgaggtgagctgggaggaggaggcggagcactccggggccagccacaacatcctggtcgaggtgcaggacgacggcaccatgaagatcaaggacgaggagcgcgacgacaccctcaccatcctgctgaaggccaccctcctggccgtgtccggggtctacccgctgagcatccccgccaccctcttcgtgtggtacttctggcagaagaagaagcagcggtccggcgtgctgtgggacacccccagcccgcccgaggtcgagcgcgcggtgctggacgacggcatctaccggatcatgcagcgcgggctgctcggccggtcccaggtgggggtcggcgtgttccaggagaacgtgttccacaccatgtggcacgtcacccgcggggccgtgctgatgtaccagggcaagcggctggagcccagctgggcctccgtgaagaaggacctcatcagctacggcgggggctggcgcctgcgggggtcctggaacacgggcgaggaggtccaggtgatcgccgtggagcccgggaagaaccccaagaacgtccagaccgcccccggcaccttcaagacccccgagggcgaggtgggggcgatcgccctggacttcaagcccggcacgagcgggtcccccatcgtgaaccgcgagggcaagatcgtcggcctctacgggaacggcgtggtgaccaccagcgggacctacgtcagcgccatcgcccaggcgaaggcctcccaggagggcccgctgcccgagatcgaggacgaggtgttccggaagcgcaacctgacgatcatggacctccaccccgggagcggcaagacccggcgctacctgccggccatcgtgcgggaggccatcaagcgcaagctgcgcaccctcatcctggcccccacccgggtcgtggcgtccgagatggccgaggccctgaagggcatgcccatccgctaccagacgaccgccgtcaagagcgagcacaccgggaaggagatcgtcgacctcatgtgccacgccaccttcacgatgcggctgctgtcccccgtgcgcgtgccgaactacaacatgatcatcatggacgaggcgcacttcaccgaccccagctccatcgccgcccggggctacatcagcacccgcgtcgggatgggcgaggccgccgcgatcttcatgaccgccacgccgcccgggtccgtggaggccttcccgcagagcaacgccgtgatccaggacgaggagcgggacatccccgagcgctcctggaacagcggctacgagtggatcaccgacttccccggcaagaccgtctggttcgtgccctccatcaagagcgggaacgacatcgcgaactgcctccggaagaacggcaagcgcgtgatccagctgtcccggaagaccttcgacacggagtaccagaagaccaagaacaacgactgggactacgtcgtgaccaccgacatcagcgagatgggggccaacttccgcgccgaccgggtgatcgacccgcgccggtgcctgaagcccgtcatcctcaaggacggccccgagcgcgtgatcctggccgggcccatgccggtgacggtcgcctccgcggcccagcggcgcggccggatcggccgcaaccacaacaaggagggggaccagtacatctacatgggccagcccctgaacaacgacgaggaccacgcccactggaccgaggccaagatgctcctggacaacatcaacacccccgaggggatcatccccgccctgttcgagccggagcgcgagaagtccgcggccgtggacggcgagtaccggctccgcggggaggcccggaagaccttcgtcgagctgatgcgccggggcgacctgcccgtgtggctctcctacaaggtggccagcgagggcttccagtacagcgaccgccggtggtgcttcgacggggagcgcaacaaccaggtcctggaggagaacatggacgtggagatctggacgaaggagggcgagcggaagaagctgcgcccccggtggctcgacgcccgcacctactccgaccccctggcgctgcgggagttcaaggagttcgccgccgggcgccggagcgtgtccggcgacctcatcctggagatcggcaagctgccgcagcacctcacccagcgcgcccagaacgcgctggacaacctggtcatgctccacaacagcgagcagggcgggcgggcctaccgccacgccatggaggagctgcccgacaccatcgagacgctgatgctcctggccctgatcgccgtgctcaccgggggcgtgaccctgttcttcctgtccgggcggggcctcggcaagaccagcatcgggctgctgtgcgtcatggcgtccagcgtgctcctgtggatggcctccgtggagccccactggatcgccgccagcatcatcctggagttcttcctcatggtcctgctgatccccgagccggaccgccagcggacgccccaggacaaccagctcgcctacgtggtgatcggcctgctgttcatgatcctcacggtcgcggccaacgagatggggctgctggagaccaccaagaaggacctcggcatcgggcacgtggccgtggagaaccaccaccacgccgccatgctggacgtcgacctgcaccccgcgtccgcctggaccctctacgccgtggccacgaccatcatcaccccgatgatgcgccacaccatcgagaacacgaccgccaacatcagcctgaccgcgatcgccaaccaggccgccatcctgatgggcctcgacaagggctggcccatctccaagatggacatcggggtgcccctgctggcgctcggctgctacagccaggtcaaccccctgaccctgacggccgccgtgctcatgctggtggcccactacgccatcatcgggccgggcctgcaggcgaaggccacccgcgaggcccagaagcggaccgccgccgggatcatgaagaaccccaccgtcgacggcatcgtggcgatcgacctcgaccccgtggtctacgacgccaagttcgagaagcagctgggccagatcatgctgctcatcctgtgcacgtcccagatcctgctcatgcgcaccacctgggccctgtgcgagagcatcaccctggccacggggcccctcaccaccctgtgggagggctccccggggaagttctggaacaccacgatcgccgtgagcatggcgaacatcttccggggctcctacctggccggcgccgggctcgccttcagcctgatgaagtccctgggcgggggccgccgggggaccggcgcgcagggcgagaccctcggggagaagtggaagcgccagctgaaccagctgtccaagagcgagttcaacacctacaagcggtccggcatcatggaggtggaccgcagcgaggccaaggaggggctcaagcggggcgagacgaccaagcacgccgtctcccgcgggaccgccaagctgcggtggttcgtggagcgcaacctggtgaagcccgagggcaaggtcatcgacctgggctgcgggcggggcgggtggagctactactgcgccggcctcaagaaggtgaccgaggtgaaggggtacacgaagggcggccccgggcacgaggagcccatcccgatggcgacctacggctggaacctggtcaagctgcactccgggaaggacgtgttcttcatcccgcccgagaagtgcgacaccctcctgtgcgacatcggcgagagctcccccaacccgaccatcgaggaggggcgcacgctgcgggtgctcaagatggtcgagccctggctgcgcggcaaccagttctgcatcaagatcctgaacccctacatgcccagcgtggtggagaccctcgagcagatgcagcggaagcacggcgggatgctggtccgcaacccgctgtcccggaacagcacccacgagatgtactgggtgtcctgcggcaccgggaacatcgtgagcgccgtcaacatgacctcccgcatgctcctgaaccgcttcacgatggcccaccggaagcccacctacgagcgcgacgtggacctgggcaccggcacccggcacgtggccgtcgagcccgaggtggccaacctcgacatcatcgggcagcgcatcgagaacatcaagcacgagcacaagagcacgtggcactacgacgaggacaacccctacaagacctgggcgtaccacggctcctacgaggtgaagccgagcgggtccgccagcagcatggtcaacggcgtggtcaagctgctgaccaagccctgggacgtgatccccatggtgacccagatcgccatgacggacaccacccccttcgggcagcagcgggtcttcaaggagaaggtggacacccgcacgccgaaggccaagcggggcaccgcccagatcatggaggtgaccgcgcgctggctctggggcttcctgtcccggaacaagaagccccgcatctgcacccgggaggagttcacgcgcaaggtccggagcaacgccgccatcggggccgtgttcgtggacgagaaccagtggaactccgcgaaggaggccgtcgaggacgagcgcttctgggacctggtgcaccgggagcgcgagctccacaagcagggcaagtgcgcgacctgcgtgtacaacatgatggggaagcgggagaagaagctgggcgagttcgggaaggccaagggcagccgcgccatctggtacatgtggctgggcgcgcggttcctcgagttcgaggccctggggttcatgaacgaggaccactggttctcccgcgagaacagcctgtccggcgtcgagggggagggcctccacaagctggggtacatcctgcgggacatcagcaagatccccggcggcaacatgtacgccgacgacaccgccgggtgggacacccgcatcacggaggacgacctccagaacgaggccaagatcaccgacatcatggagccggagcacgcgctgctggccaaggccatcttcaagctcacctaccagaacaaggtggtgcgcgtccagcggcccgccaagaacggcaccgtgatggacgtgatctcccgccgggaccagcgcgggagcggccaggtcggcacgtacgggctgaacaccttcaccaacatggaggcccagctgatccggcagatggagtccgagggcatcttcagcccctccgagctcgagacccccaacctggcggagcgcgccctgaactggctcgagaagtacggggtggagcggctgaagcgcatggccatcagcggcgacgactgcgtggtcaagccgatcgacgaccggttcgccacggccctgaccgcgctcaacgacatggggaaggtgcgcaaggacatcccccagtgggagccctccaagggctggaacgactggcagcaggtccccttctgcagccaccacttccaccagctgatcatgaaggacggccgggagatcgtcgtgccgtgccgcaaccaggacgagctggtggggcgggcccgcgtctcccagggcgccgggtggagcctccgggagaccgcctgcctgggcaagagctacgcgcagatgtggcagctgatgtacttccaccgccgggacctccgcctggccgccaacgccatctgctccgccgtgcccgtggactgggtccccaccagccggacgacctggtccatccacgcgcaccaccagtggatgaccaccgaggacatgctgagcgtgtggaaccgcgtgtggatcgaggagaacccctggatggaggacaagacgcacatctccagctgggaggacgtcccgtacctcgggaagcgcgaggaccagtggtgcggctccctgatcggcctgaccgcccgggccacctgggccaccaacatccaggtggccatcaaccaggtgcgccggctcatcgggaacgagaactacctggactacatgaccagcatgaagcgcttcaagaacgagtccgaccccgagggcgcgctgtggtga

SEQ ID NO: 8512 - RNA, 9879 nt, synthetic construct
  misc_feature 1..9879: note = derived and/or modified CDS sequence (opt1) from DENV-1__GQ868609__SS-prME
  source 1..9879: mol_type = other RNA
agcgtgaccatgctgctcatgctgatgcccaccgccctggccttccacctcaccacccgcggcggggagccccacatgatcgtgaccaagcaggagcggggcaagagcctgctgttcaagaccagcgccggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtgacctacgggacctgcagccagacgggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccgtgggcggcgtgttcaccagcgtcgggaagctggtgcaccagatcttcggcaccgcctacggggtcctgttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggccgactccgggtgcgtcatcaactggaagggccgggagctcaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctggagaacatcatgtggaagcagatctccaacgagctcaaccacatcctgctggagaacgacatgaagttcaccgtggtggtcggggacgtggtgggcatcctcgcgcaggggaagaagatgatccggccccagcccatggagcacaagtacagctggaagtcctggggcaaggccaagatcatcggcgccgacgtccagaacacgaccttcatcatcgacgggcccaacaccccggagtgccccgacgaccagcgcgcctggaacatctgggaggtggaggactacggcttcgggatcttcaccacgaacatctggctgcggctgcgcgacagctacacccaggtgtgcgaccaccggctcatgtccgcggccatcaaggacagcaaggccgtccacgccgacatgggctactggatcgagtccgagaagaacgagacctggaagctggcccgcgcgagcttcatcgaggtgaagacctgcatctggcccaagtcccacacgctgtggagcaacggcgtgctcgagtccgagatgatcatccccaagatctacgggggcccgatcagccagcacaactaccggcccgggtacttcacccagaccgccggcccctggcacctggggaagctggagctcgacttcgacctgtgcgagggcaccacggtcgtggtggacgagcactgcggcaaccgcgggccgtccctgcggaccaccaccgtcacgggcaagatcatccacgagtggtgctgccgcagctgcaccctgccgcccctccggttcaagggggaggacggctgctggtacgggatggagatccgccccgtgaaggagaaggaggagaacctggtgaagtccatggtcagcgccggcagcggcgaggtggactccttcagcctcgggctgctgtgcatctccatcatgatcgaggaggtgatgcggagccgctggtcccggaagatgctcatgaccggcaccctggccgtcttcctgctcctgatcatggggcagctgacgtggaacgacctcatccgcctgtgcatcatggtgggcgccaacgcgagcgaccgcatggggatgggcaccacctacctggccctcatggccaccttcaagatgcggccgatgttcgccgtgggcctgctgttccgccggctcacgtcccgcgaggtcctgctgctcaccatcgggctgagcctggtggcctccgtcgagctccccaacagcctggaggagctgggcgacgggctcgcgatgggcatcatgatcctgaagctgctcaccgacttccagtcccaccagctgtgggccaccctgctcagcctgacgttcatcaagaccaccctgtccctccactacgcctggaagaccatggccatggtgctgagcatcgtgtccctgttccccctctgcctgagcacgacctcccagaagaccacctggctgcccgtcctcctgggcagcctggggtgcaagccgctcacgatgttcctgatcaccgagaacaagatctggggccggaagtcctggcccctgaacgaggggatcatggcggtgggcgtggtcagcatcctcctgagctccctgctcaagaacgacgtgcccctggccgggcccctgatcgccggcggcatgctcatcgcctgctacgtgatcagcgggtccagcgccgacctgtccctggagaaggcggccgaggtcagctgggaggaggaggccgagcactccggcgccagccacaacatcctcgtggaggtgcaggacgacgggaccatgaagatcaaggacgaggagcgcgacgacaccctgaccatcctgctcaaggccacgctgctggcggtctccggcgtgtacccgctcagcatccccgccaccctgttcgtgtggtacttctggcagaagaagaagcagcggtccggggtcctgtgggacacccccagcccgcccgaggtggagcgcgccgtgctggacgacggcatctaccggatcatgcagcgcggcctcctggggcggtcccaggtcggcgtgggggtgttccaggagaacgtcttccacaccatgtggcacgtgacgcgcggcgccgtgctgatgtaccaggggaagcggctcgagcccagctgggcctccgtcaagaaggacctgatcagctacggcggcgggtggcgcctgcagggctcctggaacaccggggaggaggtccaggtgatcgcggtcgagcccggcaagaaccccaagaacgtgcagaccgcccccgggaccttcaagacgcccgagggcgaggtgggcgccatcgccctcgacttcaagcccgggaccagcggctcccccatcgtcaaccgggaggggaagatcgtgggcctgtacggcaacggggtggtcaccaccagcggcacgtacgtgagcgccatcgcgcaggccaaggcctcccaggaggggccgctgcccgagatcgaggacgaggtgttccgcaagcggaacctcaccatcatggacctgcaccccggcagcgggaagacccgccggtacctgccggccatcgtccgcgaggcgatcaagcggaagctccgcaccctgatcctggcccccacgcgcgtggtggcctccgagatggccgaggccctcaagggcatgcccatccggtaccagaccaccgcggtcaagagcgagcacaccggcaaggagatcgtggacctgatgtgccacgccacgttcaccatgcgcctgctctcccccgtgcgggtcccgaactacaacatgatcatcatggacgaggcccacttcaccgaccccagctccatcgccgcccgcgggtacatcagcacccgggtgggcatgggggaggcggccgccatcttcatgacggccacgccgcccggctccgtggaggccttcccgcagagcaacgcggtcatccaggacgaggagcgcgacatccccgagcggtcctggaacagcgggtacgagtggatcaccgacttccccggcaagaccgtgtggttcgtgccctccatcaagagcggcaacgacatcgccaactgcctgcgcaagaacgggaagcgggtcatccagctgtcccgcaagacgttcgacaccgagtaccagaagaccaagaacaacgactgggactacgtggtgaccacggacatcagcgagatgggcgccaacttccgggccgaccgcgtcatcgacccgcggcgctgcctcaagcccgtgatcctgaaggacgggcccgagcgggtcatcctggcgggccccatgccggtgaccgtggcctccgccgcccagcgccgggggcgcatcggccggaaccacaacaaggagggcgaccagtacatctacatggggcagcccctcaacaacgacgaggaccacgcccactggaccgaggcgaagatgctgctggacaacatcaacacccccgagggcatcatccccgccctcttcgagccggagcgcgagaagtccgccgccatcgacggggagtaccgcctgcggggcgaggcccgcaagacgttcgtcgagctgatgcggcgcggggacctccccgtgtggctgtcctacaaggtggcgagcgagggcttccagtacagcgaccggcgctggtgcttcgacggcgagcggaacaaccaggtcctggaggagaacatggacgtggagatctggaccaaggagggggagcgcaagaagctccggccccgctggctggacgcccggacctactccgaccccctggccctccgcgagttcaaggagttcgccgccggccggcgcagcgtgtccggggacctgatcctggagatcggcaagctcccgcagcacctgacccagcgggcgcagaacgccctggacaacctcgtcatgctgcacaacagcgagcagggcgggcgcgcctaccggcacgccatggaggagctgcccgacacgatcgagaccctcatgctgctggcgctcatcgccgtgctgaccggcggggtgaccctgttcttcctctccggccgcgggctgggcaagaccagcatcggcctgctctgcgtcatggcctccagcgtgctgctgtggatggcctccgtggagccccactggatcgccgcgagcatcatcctcgagttcttcctgatggtcctgctcatccccgagccggaccggcagcgcacgccccaggacaaccagctggcctacgtggtgatcgggctcctcttcatgatcctgaccgtcgccgccaacgagatgggcctgctcgagaccaccaagaaggacctggggatcggccacgtggccgtggagaaccaccaccacgcgacgatgctggacgtcgacctccaccccgcctccgcctggaccctgtacgccgtggccaccaccatcatcacgccgatgatgcggcacaccatcgagaacaccaccgcgaacatcagcctgacggccatcgccaaccaggccgccatcctcatggggctggacaagggctggcccatctccaagatggacatcggcgtgcccctgctcgcgctggggtgctacagccaggtcaaccccctgaccctcaccgccgccgtgctgatgctggtggcccactacgcgatcatcggcccggggctccaggccaaggccacccgcgaggcccagaagcgcacggccgcgggcatcatgaagaaccccaccgtcgacgggatcgtggccatcgacctggaccccgtggtctacgacgccaagttcgagaagcagctgggccagatcatgctcctgatcctgtgcacctcccagatcctcctgatgcggaccacgtgggccctgtgcgagagcatcaccctcgccaccggccccctgaccacgctgtgggaggggtccccgggcaagttctggaacaccaccatcgcggtgagcatggccaacatcttccgcgggtcctacctcgccggcgccggcctggccttcagcctgatgaagtccctcgggggcgggcggcgcggcaccggggcgcagggcgagacgctgggcgagaagtggaagcggcagctgaaccagctctccaagagcgagttcaacatctacaagcgctccgggatcatggaggtggaccggagcgaggccaaggagggcctgaagcgcggggagaccacccggcacgccgtctcccgcggcaccgccaagctgcggtggttcgtggagcgcaacctggtgaagcccgaggggaaggtcatcgacctcggctgcggccgcggcgggtggagctactactgcgcggggctgaagaaggtgacggaggtgaaggggtacaccaagggcgggcccggccacgaggagcccatcccgatggccacctacgggtggaacctggtcaagctccactccggcaaggacgtgttcttcacgccgcccgagaagtgcgacacgctgctgtgcgacatcggggagagctcccccaacccgaccatcgaggagggccgcaccctccgggtgctgaagatggtcgagccctggctgcgcgggaaccagttctgcatcaagatcctcaacccctacatgcccagcgtggtggagaccctggagcagatgcagcggaagcacggcggcatgctggtccgcaacccgctctcccggaacagcacccacgagatgtactgggtgtcctgcgggacgggcaacatcgtgagcgccgtcaacatgacctcccgcatgctgctgaaccgcttcaccatggcccaccggaagcccacctacgagaaggacgtggacctcggggccggcacgcgccacgtggcggtcgagcccgaggtggccaacctggacatcatcggccagcggatcgagaacatcaagcacgagcacaagagcacctggcactacgacgaggacaacccctacaagacctgggcctaccacgggtcctacgaggtcaagccgagcggctccgccagcagcatggtgaacggggtggtcaagctgctcaccaagccctgggacgtgatccccatggtgacgcagatcgccatgaccgacaccacccccttcggccagcagcgcgtcttcaaggagaaggtggacacgcggaccccgaaggcgaagcgcgggaccgcccagatcatggaggtgaccgcccggtggctgtggggcttcctgtcccgcaacaagaagccccggatctgcacgcgcgaggagttcacccggaaggtccgcagcaacgccgccatcggcgcggtgttcgtggacgagaaccagtggaactccgccaaggaggccgtcgaggacgagcggttctgggacctcgtgcagaaggagcgcgagctgcacaagcaggggaagtgcgcgacctgcgtgtacaacatgatgggcaagcgggagaagaagctgggggagttcggcaaggcgaaggggagccgcgccatctggtacatgtggctcggcgcccggttcctggagttcgaggccctgggcttcatgaacgaggaccactggttctcccgcgagaacagcctctccggggtcgagggcgaggggctgcacaagctgggctacatcctccgggacatcagcaagatccccgggggcaacatgtacgccgacgacaccgcgggctgggacacgcgcatcaccgaggacgacctgcagaacgaggccaagatcaccgacatcatggagccggagcacgccctgctcgccacctccatcttcaagctgacgtaccagaacaaggtggtgcgggtccagcgccccgccaagaacgggaccgtgatggacgtgatcagccgccgggaccagcgcggctccgggcaggtcggcacctacggcctgaacaccttcacgaacatggaggcgcagctcatccggcagatggagagcgaggggatcttcctgccctccgagctggagacccccaacctcgccgagcgcgtgctggactggctggagaagtacggcgtggagcggctcaagcgcatggccatcagcggggacgactgcgtcgtgaagccgatcgacgaccggttcgccaccgccctgaccgcgctgaacgacatgggcaaggtgcgcaaggacatcccccagtgggagccctccaaggggtggaacgactggcagcaggtccccttctgcagccaccacttccaccagctcatcatgaaggacggccgggagatcgtggtgccgtgccgcaaccaggacgagctggtcggccgggcccgcgtgtcccagggggccggctggagcctgcgggagacggcctgcctcggcaagagctacgcccagatgtggcagctgatgtacttccaccgccgggacctgcgcctcgcggccaacgccatctgctccgccgtgcccgtcgactgggtgcccaccagccggaccacctggtccatccacgcgcaccaccagtggatgacgaccgaggacatgctgagcgtgtggaaccgcgtctggatcgaggagaacccctggatggaggacaagacccacgtgtccagctggggcgacgtgccgtacctggggaagcgggaggaccagtggtgcggctccctcatcggcctgaccgcccgcgccacctgggccagcaacatccaggtcgccatcaaccaggtgcgccggctgatcgggaacgagaactacctcgactacatgacgtccatgaagcgcttcaagaacgagggcgaccccgagggggcgctgtggtga

SEQ ID NO: 8513 - RNA, 9879 nt, synthetic construct
  misc_feature 1..9879: note = derived and/or modified CDS sequence (opt1) from DENV-1__GQ199803__SS-prME
  source 1..9879: mol_type = other RNA
agcgtgaccatgctgctcatgctgatgcccaccgccctggccttccacctcaccatccgcggcggggagccccacatgatcgtgtccaagcaggagcggggcaagagcctgctgttcaagacctccgccggggtgaacatgtgcaccctcatcgccatggacctgggcgagctgtgcgaggacaccatgacctacaagtgcccccgcatcaccgaggccgagcccgacgacgtggactgctggtgcaacgccaccgacacctgggtgacctacgggacctgcagccagaccggcgagcaccggcgcgacaagcggtccgtggccctcgcgccccacgtgggcctggggctggagacccgcaccgagacctggatgagctccgagggcgcctggaagcagatccagcgggtcgagacctgggccctccgccaccccgggttcaccgtgatcgccctgttcctggcgcacgccatcggcacgagcatcacccagaaggggatcatcttcatcctcctgatgctggtgaccccctccatggccatgcggtgcgtcggcatcggcagccgcgacttcgtggaggggctctccggcgccacctgggtggacgtcgtgctggagcacgggagctgcgtgacgaccatggccaaggacaagcccaccctggacatcgagctcctgaagaccgaggtcacgaaccccgcggtgctgcggaagctctgcatcgaggccaagatctccaacaccaccaccgacagccgctgcccgacgcagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgacgaagctggagggcaagatcgtccagtacgagaacctgaagtacagcgtgatcgtgaccgtccacaccggcgaccagcaccaggtggggaacgagtccaccgagcacggcacgaccgcgaccatcacgccccaggcccccaccacggagatccagctcaccgactacggggccctgaccctggactgcagcccccgcaccggcctcgacttcaacgagatggtcctgctgacgatgaaggagaagtcctggctcgtgcacaagcagtggttcctggacctgcccctcccctggaccagcggggccagcacctcccaggagacctggaaccggcaggacctgctggtgacgttcaagaccgcccacgcgaagaagcaggaggtcgtggtgctcggcagccaggagggcgccatgcacaccgccctgaccggggccacggagatccagacctccggcaccaccacgatcttcgccgggcacctgaagtgccgcctcaagatggacaagctgaccctgaagggcatgagctacgtcatgtgcaccgggtccttcaagctcgagaaggaggtggcggagacccagcacggcacggtgctggtccagatcaagtacgagggcaccgacgccccctgcaagatccccttcagcacccaggacgagaagggggtgacccagaacggccggctgatcacggccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacaccgcctgggacttcgggtccatcggcggcgtgttcacgagcgtcgggaagctggtgcaccagatcttcggcaccgcctacggggtcctcttctccggcgtcagctggaccatgaagatcgggatcggcgtgctgctgacctggctcggcctgaactcccgcagcacgtccctgagcatgacctgcatcgccgtggggctcgtcaccctgtacctgggcgtgatggtgcaggccgactccgggtgcgtcatcaactggaagggccgggagctcaagtgcgggagcggcatcttcgtgaccaacgaggtgcacacgtggaccgagcagtacaagttccaggcggacagcccgaagcgcctgtccgccgccatcggcaaggcctgggaggagggggtctgcggcatccggagcgccacccgcctggagaacatcatgtggaagcagatctccaacgagctcaaccacatcctgctggagaacgacatgaagctcaccgtggtggtcggggacgtggcgggcatcctggggcagggcaagaagatgatccggccccagcccatggagtacaagtacagctggaagtcctggggcaaggccaagatcatcggggccgacgcccagaacaccacgttcatcatcgacggccccaacaccccggagtgccccgacgaccagcgcgcgtggaacatctgggaggtggaggactacgggttcggcatcttcaccaccaacatctggctgaagctccgggacagctacacgcaggtctgcgaccaccgcctgatgtccgccgccatcaaggacagcaaggccgtgcacgccgacatgggctactggatcgagtccgagaagaacgagacctggaagctggcgcgggccagcttcatcgaggtgaagacctgcatctggcccaagtcccacaccctctggagcaacggggtcctggagtccgagatgatcatccccaagatctacggcgggccgatcagccagcacaactaccgccccggctacttcacgcagaccgccgggccctggcacctgggcaagctcgagctggacttcgacctgtgcgagggcaccaccgtggtggtcgacgagcactgcgggaaccggggcccgtccctccgcacgaccaccgtgaccgggaagatcatccacgagtggtgctgccggagctgcacgctgccgcccctgcgcttccggggcgaggacgggtgctggtacggcatggagatccgccccgtgaaggagaaggaggagaacctcgtcaagtccatggtgagcgccggcagcggggaggtggactccttcagcctgggcctgctctgcatctccatcatgatcgaggaggtcatgcggagccgctggtcccggaagatgctgatgaccgggaccctggccgtgttcttcctcctgatcatgggccagctgacctggaacgacctcatccgcctgtgcatcatggtgggggcgaacgccagcgaccgcatgggcatgggcacgacctacctggccctcatggccaccttcaagatgcggccgatgttcgccgtcgggctgctgttccgccggctcacctcccgcgaggtgctgctgctcacgatcggcctgagcctggtggcgtccgtcgagctccccagctccctggaggagctgggggacggcctcgccatgggcatcatgatcctgaagctgctcaccgacttccagagccaccagctgtgggccaccctgctctccctgaccttcatcaagacggccttcagcctgcactacgcgtggaagaccatggccatggtgctctccatcgtcagcctgttccccctgtgcctctccaccaccagccagaagacgacctggctgcccgtgctgctcgggtccctgggctgcaagccgctgaccatgttcctcatcgccgagaacaagatctgggggcggaagtcctggcccctgaacgagggcatcatggccgtggggatcgtcagcatcctgctctccagcctgctgaagaacgacgtgcccctcgccggccccctgatcgcgggcgggatgctgatcgcctgctacgtgatctccggcagctccgccgacctcagcctggagaaggccgccgaggtctcctgggaggaggaggcggagcacagcggggcctcccacaacatcctggtggaggtgcaggacgacggcaccatgaagatcaaggacgaggagcgcgacgacacgctcaccatcctgctgaaggccaccctcctggccgtcagcggggtgtacccgctgtccatccccgccaccctcttcgtgtggtacttctggcagaagaagaagcagcggagcggcgtcctgtgggacacccccagcccgcccgaggtggagcgcgcggtgctggacgacggcatctaccggatcatgcagcgcgggctgctcggccggagccaggtcggggtgggcgtgttccaggagaacgtcttccacacgatgtggcacgtgacccgcggggccgtgctgatgtaccagggcaagcggctggagccctcctgggccagcgtcaagaaggacctcatctcctacggcgggggctggcgcctgcgggggagctggaacaccggcgaggaggtccaggtgatcgccgtcgagcccgggaagaaccccaagaacgtgcagaccgcccccggcacgttcaagacccccgagggcgaggtgggggcgatcgccctggacttcaagcccggcacctccgggagccccatcgtcaaccgcgagggcaagatcgtgggcctctacgggaacggcgtggtcaccacgagcgggacctacgtgtccgccatcgcccaggcgaaggccagccaggagggcccgctgcccgagatcgaggacgaggtgttccggaagcgcaacctgaccatcatggacctccaccccgggtccggcaagacccggcgctacctgccggccatcgtccgggaggccatcaagcgcaagctgcgcacgctcatcctggcccccacccgggtggtggcgagcgagatggccgaggccctgaagggcatgcccatccgctaccagaccaccgccgtcaagtccgagcacacggggaaggagatcgtggacctcatgtgccacgccaccttcaccatgcggctgctgagccccgtgcgcgtcccgaactacaacatgatcatcatggacgaggcgcacttcaccgacccctccagcatcgccgcccggggctacatctccacgcgcgtggggatgggcgaggccgccgcgatcttcatgaccgccacgccgcccgggagcgtggaggccttcccgcagtccaacgccgtcatccaggacgaggagcgggacatccccgagcgcagctggaactccggctacgagtggatcaccgacttccccggcaagacggtgtggttcgtgcccagcatcaagtccgggaacgacatcgcgaactgcctccggaagaacggcaagcgcgtcatccagctgagccggaagaccttcgacaccgagtaccagaagaccaagaacaacgactgggactacgtggtgacgaccgacatctccgagatgggggccaacttccgcgccgaccgggtcatcgacccgcgccggtgcctgaagcccgtgatcctcaaggacggccccgagcgcgtgatcctggccgggcccatgccggtcaccgtggccagcgcggcccagcggcgcggccggatcggccgcaaccacaacaaggagggggaccagtacatctacatgggccagcccctgaacaacgacgaggaccacgcccactggaccgaggccaagatgctcctggacaacatcaacacgcccgaggggatcatccccgccctgttcgagccggagcgcgagaagtccgcggccgtcgacggcgagtaccggctccgcggggaggcccggaagaccttcgtggagctgatgcgccggggcgacctgcccgtgtggctcagctacaaggtcgccagcgagggcttccagtactccgaccgccggtggtgcttcgacggggagcgcaacaaccaggtgctggaggagaacatggacgtggagatctggaccaaggagggcgaccggaagaagctgcgcccccggtggctcgacgcccgcacctacagcgaccccctggcgctgcgggagttcaaggagttcgccgccgggcgccggtccgtcagcggcgacctcatcctggagatcggcaagctgccgcagcacctcacgcagcgcgcccagaacgcgctggacaacctggtgatgctccacaactccgagcagggcgggcgggcctaccgccacgccatggaggagctgcccgacaccatcgagaccctgatgctcctggccctgatcgccgtgctcaccgggggcgtcacgctgttcttcctgagcgggcggggcctcggcaagacctccatcgggctgctgtgcgtgatggcgagctccgtgctcctgtggatggccagcgtcgagccccactggatcgccgcctccatcatcctggagttcttcctcatggtgctgctgatccccgagccggaccgccagcggacgccccaggacaaccagctcgcctacgtggtcatcggcctgctgttcatgatcctcaccgtggcggccaacgagatggggctgctggagaccacgaagaaggacctcggcatcgggcacgtggccgtcgagaaccaccaccacgccgccatgctggacgtggacctgcaccccgcgagcgcctggaccctctacgccgtggccaccaccatcatcacgccgatgatgcgccacaccatcgagaacaccaccgccaacatctccctgacggcgatcgccaaccaggccgccatcctgatgggcctcgacaagggctggcccatcagcaagatggacatcggggtccccctgctggcgctcggctgctactcccaggtgaaccccctgaccctgaccgccgccgtgctcatgctggtcgcccactacgccatcatcgggccgggcctgcaggcgaaggccacccgcgaggcccagaagcggacggccgccgggatcatgaagaaccccaccgtggacggcatcgtggcgatcgacctcgaccccgtcgtgtacgacgccaagttcgagaagcagctgggccagatcatgctgctcatcctgtgcaccagccagatcctgctcatgcgcaccacgtgggccctgtgcgagtccatcaccctggccaccgggcccctcaccacgctgtgggagggcagcccggggaagttctggaacaccaccatcgccgtgtccatggcgaacatcttccggggcagctacctggccggcgccgggctcgccttcagcctgatgaagtccctgggcgggggccgccgggggaccggcgcgcagggcgagacgctcggggagaagtggaagcgccagctgaaccagctgagcaagtccgagttcaacacctacaagcggagcggcatcatggaggtcgaccgctccgaggccaaggaggggctcaagcggggcgagaccaccaagcacgccgtgagccgcgggacggccaagctgcggtggttcgtggagcgcaacctggtcaagcccgagggcaaggtgatcgacctgggctgcgggcggggcgggtggtcctactactgcgccggcctcaagaaggtgaccgaggtcaaggggtacaccaagggcggccccgggcacgaggagcccatcccgatggcgacctacggctggaacctggtgaagctgcacagcgggaaggacgtgttcttcatcccgcccgagaagtgcgacacgctcctgtgcgacatcggcgagtccagccccaacccgaccatcgaggaggggcgcaccctgcgggtcctcaagatggtggagccctggctgcgcggcaaccagttctgcatcaagatcctgaacccctacatgccctccgtggtcgagaccctcgagcagatgcagcggaagcacggcgggatgctggtgcgcaacccgctgagccggaactccacgcacgagatgtactgggtgagctgcggcaccgggaacatcgtctccgccgtgaacatgaccagccgcatgctcctgaaccgcttcaccatggcccaccggaagcccacctacgagcgcgacgtggacctgggcacgggcacccggcacgtcgccgtggagcccgaggtggccaacctcgacatcatcgggcagcgcatcgagaacatcaagcacgagcacaagtccacctggcactacgacgaggacaacccctacaagacctgggcgtaccacggcagctacgaggtcaagccgtccgggagcgccagctccatggtgaacggcgtcgtgaagctgctgacgaagccctgggacgtgatccccatggtcacccagatcgccatgaccgacaccacgcccttcgggcagcagcgggtgttcaaggagaaggtggacacccgcaccccgaaggccaagcggggcaccgcccagatcatggaggtcacggcgcgctggctctggggcttcctgagccggaacaagaagccccgcatctgcacccgggaggagttcacccgcaaggtgcggtccaacgccgccatcggggccgtgttcgtcgacgagaaccagtggaacagcgcgaaggaggccgtggaggacgagcgcttctgggacctggtgcaccgggagcgcgagctccacaagcagggcaagtgcgcgacctgcgtctacaacatgatggggaagcgggagaagaagctgggcgagttcgggaaggccaagggctcccgcgccatctggtacatgtggctgggcgcgcggttcctcgagttcgaggccctggggttcatgaacgaggaccactggttcagccgcgagaactccctgagcggcgtggagggggagggcctccacaagctggggtacatcctgcgggacatctccaagatccccggcggcaacatgtacgccgacgacacggccgggtgggacacccgcatcaccgaggacgacctccagaacgaggccaagatcaccgacatcatggagccggagcacgcgctgctggccaaggccatcttcaagctcacgtaccagaacaaggtggtccgcgtgcagcggcccgccaagaacggcaccgtgatggacgtcatcagccgccgggaccagcgcgggtccggccaggtgggcacctacgggctgaacaccttcacgaacatggaggcccagctgatccggcagatggagagcgagggcatcttctcccccagcgagctcgagacccccaacctggcggagcgcgccctggactggctcgagaagtacggggtggagcggctgaagcgcatggccatctccggcgacgactgcgtcgtgaagccgatcgacgaccggttcgccaccgccctgaccgcgctcaacgacatggggaaggtgcgcaaggacatcccccagtgggagcccagcaagggctggaacgactggcagcaggtccccttctgctcccaccacttccaccagctgatcatgaaggacggccgggagatcgtggtgccgtgccgcaaccaggacgagctggtcgggcgggcccgcgtgagccagggcgccgggtggagcctccgggagacggcctgcctgggcaagtcctacgcgcagatgtggcagctgatgtacttccaccgccgggacctccgcctggccgccaacgccatctgcagcgccgtgcccgtcgactgggtgcccacctcccggaccacctggagcatccacgcgcaccaccagtggatgacgaccgaggacatgctgtccgtgtggaaccgcgtctggatcgaggagaacccctggatggaggacaagacccacatcagctcctgggaggacgtgccgtacctcgggaagcgcgaggaccagtggtgcggcagcctgatcggcctgaccgcccgggccacgtgggccaccaacatccaggtggccatcaaccaggtccgccggctcatcgggaacgagaactacctggactacatgacctccatgaagcgcttcaagaacgagagcgaccccgagggcgcgctgtggtga

SEQ ID NO: 8514 - RNA, 9879 nt, synthetic construct
  misc_feature 1..9879: note = derived and/or modified CDS sequence (opt1) from DENV-1__GQ199804__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgggacaagcggtccgtggccctcgcgccccacgtgggcctggggctggagacccgcaccgagacctggatgagctccgagggcgcgtggaagcagatccagcgggtcgagacgtgggccctccggcaccccgggttcaccgtgatcgccctgttcctggcccacgtgatcggcaccagcatcacccagaaggggatcatcttcatcctcctgatgctggtcacgccctccatggcgatgcggtgcgtgggcatcggcagccgcgacttcgtggaggggctctccggcgccacctgggtcgacgtggtgctggagcacgggagctgcgtcaccaccatggccaaggacaagcccacgctggacatcgagctcctgaagaccgaggtgaccaaccccgccgtgctgcggaagctctgcatcgaggccaagatctccaacaccacgaccgacagccgctgcccgacccagggcgacgcgaccctggtcgaggagcaggacgccaacttcgtgtgccggcgcacgttcgtggaccggggctgggggaacggctgcgggctgttcggcaaggggtccctcatcacgtgcgccaagttcaagtgcgtcaccaagctggagggcaagatcgtgcagtacgagaacctgaagtacagcgtgatcgtcaccgtgcacacgggcgaccagcaccaggtcgggaacgagtccaccgagcacggcaccaccgccaccatcacgccccaggcccccaccaccgagatccagctcaccgactacggggcgctgacgctggactgcagcccccgcaccggcctcgacttcaacgagatggtgctgctgaccatgaaggagaagtcctggctcgtgcacaagcagtggttcctggacctgcccctcccctggaccagcggggccagcacgtcccaggagacctggaaccggcaggacctgctggtcaccttcaagaccgcccacgccaagaagcaggaggtggtggtcctcggcagccaggagggcgccatgcacacggcgctgaccggggccaccgagatccagacctccggcacgaccaccatcttcgccgggcacctgaagtgccgcctcaagatggacaagctgaccctgaagggcatgagctacgtgatgtgcacggggtccttcaagctcgagaaggaggtggccgagacccagcacggcaccgtcctggtgcagatcaagtacgagggcaccgacgccccctgcaagatccccttcagcacgcaggacgagaagggggtgacccagaacggccggctgatcaccgcgaacccgatcgtcaccgacaaggagaagcccgtgaacatcgaggccgagccgcccttcggggagtcctacatcatcatcggcgccggcgagaaggccctgaagctcagctggttcaagaaggggtccagcatcggcaagatgttcgaggcgacggcccgcggggcccggcgcatggccatcctgggcgacaccgcctgggacttcgggtccatcggcggcgtgttcaccagcgtcgggaagctggtgcaccagatcttcggcaccgcgtacggggtgctgttctccggcgtcagctggacgatgaagatcgggatcggcgtgctgctgacctggctcggcctgaactcccgcagcacctccctgagcatgacctgcatcgccgtggggctcgtcacgctgtacctgggcgtgatggtgcaggccgactccgggtgcgtcatcaactggaagggccgggagctcaagtgcgggagcggcatcttcgtgaccaacgaggtgcacacctggaccgagcagtacaagttccaggccgacagcccgaagcgcctgtccgccgcgatcggcaaggcctgggaggagggggtctgcggcatccggagcgccacccgcctggagaacatcatgtggaagcagatctccaacgagctcaaccacatcctgctggagaacgacatgaagttcacggtggtggtcggggacgtggccggcatcctcgcccaggggaagaagatgatccggccccagcccatggagtacaagtacagctggaagtcctggggcaaggcgaagatcatcggcgccgacgtgcagaacaccaccttcatcatcgacgggcccaacaccccggagtgccccgacgaccagcgcgcctggaacatctgggaggtcgaggactacggcttcgggatcttcacgaccaacatctggctgaagctgcgggacagctacacccaggtgtgcgaccaccgcctcatgtccgccgcgatcaaggacagcaaggccgtgcacgccgacatgggctactggatcgagtccgagaagaacgagacctggaagctggcccgggccagcttcatcgaggtcaagacgtgcatctggcccaagtcccacaccctgtggagcaacggcgtgctcgagtccgagatgatcatccccaagatctacgggggcccgatcagccagcacaactaccgccccgggtacttcacccagaccgcgggcccctggcacctggggaagctggagctcgacttcgacctgtgcgagggcacgaccgtggtcgtggacgagcactgcggcaaccgggggccgtccctgcgcaccaccacggtgaccggcaagatcatccacgagtggtgctgccggagctgcaccctgccgcccctccgcttccgcggggaggacggctgctggtacgggatggagatccgccccgtcaaggagaaggaggagaacctggtgaagtccatggtgagcgccggcagcggcgaggtcgactccttcagcctcgggctgctgtgcatctccatcatgatcgaggaggtgatgcggagccgctggtcccggaagatgctcatgaccggcacgctggccgtgttcttcctgctcatcatggggcagctgacctggaacgacctgatccgcctctgcatcatggtcggcgccaacgccagcgaccgcatggggatgggcaccacctacctggcgctgatggccacgttcaagatgcggccgatgttcgccgtgggcctcctgttccgccggctgacctcccgcgaggtgctcctgctgaccatcgggctcagcctggtcgcctccgtggagctgcccaacagcctcgaggagctgggcgacgggctggccatgggcatcatgatcctcaagctgctgaccgacttccagtcccaccagctctgggcgacgctgctgagcctcaccttcatcaagaccaccttctccctgcactacgcctggaagacgatggccatggtcctgagcatcgtgtccctcttccccctgtgcctgagcaccacctcccagaagaccacgtggctccccgtgctgctgggcagcctcgggtgcaagccgctgaccatgttcctgatcgccgagaacaagatctggggccggcgctcctggcccctcaacgaggggatcatggcggtcggcatcgtgagcatcctgctgagctccctcctgaagaacgacgtgcccctggccgggcccctcatcgccggcggcatgctgatcgcctgctacgtcatcagcgggtccagcgccgacctgtccctcgagaaggcggccgaggtgagctgggaggaggaggccgagcactccggcgccagccacaacatcctggtggaggtccaggacgacgggaccatgaagatcaaggacgaggagcgggacgacaccctgaccatcctcctgaaggccacgctgctcgcggtgtccggcgtgtacccgctgagcatccccgccaccctgttcgtctggtacttctggcagaagaagaagcagcgctccggggtgctctgggacacccccagcccgcccgaggtggagcgggccgtcctggacgacggcatctaccgcatcatgcagcggggcctgctggggcgctcccaggtgggcgtgggggtcttccaggagaacgtgttccacaccatgtggcacgtgacgcggggcgccgtcctcatgtaccaggggaagcgcctggagcccagctgggcctccgtgaagaaggacctgatcagctacggcggcgggtggcggctccagggctcctggaacaccggggaggaggtgcaggtcatcgcggtggagcccggcaagaaccccaagaacgtgcagaccgcccccgggaccttcaagacgcccgagggcgaggtcggcgccatcgccctggacttcaagcccgggaccagcggctcccccatcgtgaaccgcgaggggaagatcgtgggcctgtacggcaacggggtcgtgaccaccagcggcacgtacgtgagcgccatcgcgcaggccaaggcctcccaggaggggccgctccccgagatcgaggacgaggtcttccggaagcgcaacctgaccatcatggacctgcaccccggcagcgggaagacccggcgctacctcccggccatcgtgcgggaggcgatcaagcgcaagctgcgcaccctgatcctcgcccccacgcgggtggtcgcctccgagatggccgaggccctgaagggcatgcccatccgctaccagaccaccgcggtcaagagcgagcacaccggcaaggagatcgtggacctgatgtgccacgccacgttcaccatgcggctcctgtcccccgtccgcgtgccgaactacaacatgatcatcatggacgaggcccacttcaccgaccccagctccatcgccgcccgggggtacatcagcacccgcgtgggcatgggggaggcggccgccatcttcatgacggccacgccgcccggctccgtcgaggccttcccgcagagcaacgcggtgatccaggacgaggagcgggacatccccgagcgctcctggaacagcgggtacgagtggatcaccgacttccccggcaagaccgtgtggttcgtcccctccatcaagagcggcaacgacatcgccaactgcctgcggaagaacgggaagcgcgtgatccagctctcccggaagacgttcgacaccgagtaccagaagaccaagaacaacgactgggactacgtggtcaccacggacatcagcgagatgggcgccaacttccgcgccgaccgggtgatcgacccgcgccggtgcctgaagcccgtgatcctgaaggacgggcccgagcgcgtcatcctcgcgggccccatgccggtgaccgtcgcctccgccgcccagcggcgcgggcggatcggccgcaaccacaacaaggagggcgaccagtacatctacatggggcagcccctgaacaacgacgaggaccacgcccactggaccgaggcgaagatgctgctcgacaacatcaacacccccgagggcatcatccccgccctgttcgagccggagcgcgagaagtccgccgccatcgacggggagtaccggctgcgcggcgaggcccggaagacgttcgtggagctcatgcgccgcggggacctgcccgtgtggctgtcctacaaggtcgcgagcgagggcttccagtacagcgaccgccggtggtgcttcgacggcgagcgcaacaaccaggtgctcgaggagaacatggacgtggagatctggaccaaggagggggagcggaagaagctgcgcccccggtggctggacgcccgcacctactccgaccccctcgccctgcgggagttcaaggagttcgccgccggccgccggagcgtctccggggacctgatcctcgagatcggcaagctgccgcagcacctgacccagcgcgcgcagaacgccctcgacaacctggtgatgctgcacaacagcgagcagggcgggcgggcctaccgccacgccatggaggagctccccgacacgatcgagaccctgatgctgctcgcgctgatcgccgtgctgaccggcggggtcaccctcttcttcctgtccggccgggggctgggcaagaccagcatcggcctcctgtgcgtgatggcctccagcgtgctgctctggatggcctccgtcgagccccactggatcgccgcgagcatcatcctggagttcttcctgatggtgctcctgatccccgagccggaccgccagcggacgccccaggacaaccagctggcctacgtggtcatcgggctcctgttcatgatcctgaccgtggccgccaacgagatgggcctcctggagaccaccaagaaggacctggggatcggccacgtggccgtcgagaaccaccaccacgcggccatgctcgacgtggacctgcaccccgcctccgcctggacgctgtacgccgtggcgaccaccatcatcaccccgatgatgcgccacacgatcgagaacaccaccgccaacatcagcctcaccgccatcgccaaccaggccgcgatcctgatggggctggacaagggctggcccatctccaagatggacatcggcgtccccctcctggccctggggtgctacagccaggtgaaccccctcacgctgaccgccgccgtgctgatgctcgtcgcgcactacgccatcatcggcccggggctgcaggccaaggccacccgcgaggcccagaagcggaccgcggccggcatcatgaagaaccccacggtggacgggatcgtggccatcgacctggaccccgtcgtgtacgacgccaagttcgagaagcagctcggccagatcatgctgctgatcctctgcacctcccagatcctgctgatgcgcaccacctgggccctctgcgagagcatcacgctggcgaccggccccctgaccaccctctgggaggggtccccgggcaagttctggaacacgaccatcgccgtgagcatggccaacatcttccgggggtcctacctggccggcgccggcctggcgttcagcctcatgaagtccctcgggggcgggcgccgggggaccggggcccagggcgagaccctgggcgagaagtggaagcgccagctcaaccagctgtccaagagcgagttcaacacgtacaagcggtccgggatcatggaggtcgaccgcagcgaggccaaggagggcctgaagcgcggggagaccaccaagcacgccgtgtcccgcggcaccgcgaagctccggtggttcgtggagcgcaacctggtcaagcccgaggggaaggtgatcgacctgggctgcggccgcgggggctggagctactactgcgccgggctgaagaaggtgacggaggtcaagggctacaccaagggcggccccggccacgaggagcccatcccgatggccacctacgggtggaacctcgtgaagctgcactccggcaaggacgtgttcttcatcccgcccgagaagtgcgacaccctgctctgcgacatcggggagagctcccccaacccgacgatcgaggagggccgcaccctgcgggtcctgaagatggtggagccctggctccgcgggaaccagttctgcatcaagatcctgaacccctacatgcccagcgtggtcgagaccctggagcagatgcagcggaagcacggcggcatgctcgtgcgcaacccgctgtcccggaacagcacccacgagatgtactgggtgtcctgcgggaccggcaacatcgtcagcgccgtgaacatgacgtcccgcatgctgctcaaccgcttcaccatggcccaccggaagcccacctacgagcgcgacgtggacctgggggcgggcacccggcacgtcgccgtggagcccgaggtggccaacctggacatcatcggccagcgcatcgagaacatcaagcacgagcacaagagcacgtggcactacgacgaggacaacccctacaagacctgggcctaccacgggtcctacgaggtcaagccgagcggctccgccagcagcatggtgaacggggtcgtgaagctcctgaccaagccctgggacgtgatccccatggtcacccagatcgcgatgacggacaccacccccttcggccagcagcgggtgttcaaggagaaggtggacacccgcacgccgaaggccaagcgggggaccgcccagatcatggaggtcaccgccaagtggctgtggggcttcctctcccgcaacaagaagccccggatctgcacccgcgaggagttcacgcggaaggtgcgcagcaacgccgcgatcggcgccgtgttcgtcgacgagaaccagtggaactccgccaaggaggccgtggaggacgagcggttctgggacctggtgcaccgcgagcgggagctgcacaagcaggggaagtgcgcgacctgcgtctacaacatgatgggcaagcgcgagaagaagctcggggagttcggcaaggccaaggggagccgggccatctggtacatgtggctgggcgcccgcttcctggagttcgaggccctcggcttcatgaacgaggaccactggttctcccgggagaacagcctgtccggggtggagggcgaggggctgcacaagctcggctacatcctgcgcgacatcagcaagatccccgggggcaacatgtacgcggacgacaccgccggctgggacacccggatcacggaggacgacctgcagaacgaggcccgcatcaccgacatcatggagccggagcacgccctcctggccaagtccatcttcaagctgacctaccagaacaaggtggtccgcgtgcagcggcccgcgaagaacgggaccgtgatggacgtcatcagccgccgggaccagcgcggctccggccaggtggggacgtacggcctcaacaccttcaccaacatggaggcccagctgatccggcagatggagagcgaggggatcttctcccccagcgagctggagacccccaacctcgccgagcgcgtgctggactggctggagaagtacggcgtcgagcggctcaagcgcatggccatctccggggacgactgcgtggtgaagccgatcgacgaccggttcgccacggcgctgaccgccctgaacgacatgggcaaggtccgcaaggacatcccccagtgggagcccagcaaggggtggaacgactggcagcaggtccccttctgctcccaccacttccaccagctcatcatgaaggacggccgggagatcgtggtcccgtgccgcaaccaggacgagctggtgggccgggcccgcgtgagccagggggccggctggagcctgcgggagaccgcctgcctcgggaagtcctacgcgcagatgtggcagctgatgtacttccaccgccgggacctgcgcctcgccgccaacgccatctgcagcgcggtccccgtggactggatccccacctcccggacgacctggagcatccacgcccaccaccagtggatgaccaccgaggacatgctgtccgtgtggaaccgcgtctggatcgaggagaacccctggatggaggacaagacgcacatcagctcctggggcgacgtgccgtacctggggaagcgcgaggaccagtggtgcggcagcctcatcggcctgaccgcccgggccacctgggccaccaacatccaggtggcgatcaaccaggtccgccggctgatcgggaacgagaactacctcgactacatgacctccatgaagcgcttcaagaacgagagcgaccccgagggcgccctgtggtga

SEQ ID NO: 8515 - RNA, 9879 nt, synthetic construct
  misc_feature 1..9879: note = derived and/or modified CDS sequence (opt1) from DENV-1__GQ199805__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgcgggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtcacctacgggacctgcagccagacgggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgtgatcggcacctccatcacccagaaggggatcatcttcatcctcctgatgctggtcacgcccagcatggccatgcggtgcgtgggcatcggctcccgcgacttcgtggaggggctcagcggcgccacctgggtcgacgtggtgctggagcacgggtcctgcgtcaccaccatggccaaggacaagcccacgctggacatcgagctcctgaagaccgaggtgaccaaccccgccgtgctgcggaagctctgcatcgaggcgaagatcagcaacaccacgaccgactcccgctgccccacccagggcgaggccaccctgatggaggagcaggacgccaacttcgtctgccggcgcacgttcgtggaccggggctgggggaacggctgcgggctgttcggcaaggggagcctcatcacgtgcgccaagttcaagtgcgtgaccaagctggagggcaagatcgtccagtacgagaacctgaagtactccgtgatcgtgaccgtccacacgggcgaccagcaccaggtggggaacgagagcaccgagcacggcaccaccgccaccatcacgccccaggcgcccacctccgagatccagctcaccgactacggggccctgaccctggactgcagcccccgcacgggcctcgacttcaacgagatggtcctgctgaccatgaaggagaagtcctggctcgtgcacaagcagtggttcctggacctgccgctcccctggaccagcggggccagcacctcccaggagacgtggaaccggcaggacctgctggtgaccttcaagaccgcccacgccaagaagcaggaggtcgtggtgctcggcagccaggagggcgcgatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggccgagacgcagcacggcaccgtgctggtccagatcaagtacgagggcaccgacgcgccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccaccgcccgcggggcccggcgcatggccatcctgggcgacacggcgtgggacttcgggtccatcggcggcgtgttcaccagcgtcgggaagctggtgcaccagatcttcggcaccgcctacggggtgctgttctccggcgtcagctggaccatgaagatcgggctgggcgtgctgctcacgtggctgggcctgaactcccgcagcacctccctcagcatgacctgcatcgccgtggggctggtcaccctgtacctcggcgtgatggtgcaggccgactccgggtgcgtcatcaactggaagggccgggagctgaagtgcgggagcggcatcttcgtgacgaacgaggtgcacacctggaccgagcagtacaagttccaggccgacagcccgaagcgcctgtccgcggccatcggcaaggcctgggaggagggggtctgcggcatccggagcgccacccgcctcgagaacatcatgtggaagcagatctccaacgagctgaaccacatcctgctcgagaacgacatgaagttcaccgtggtggtcggggacgtggtgggcatcctggcccaggggaagaagatgatccggccccagcccatggagcacaagtacagctggaagtcctggggcaaggcgaagatcatcggcgccgacgtccagaacacgaccttcatcatcgacgggcccaacaccccggagtgccccgacgaccagcgcgcctggaacatctgggaggtggaggactacggcttcgggatcttcaccacgaacatctggctgaagctccgggacagccacacccaggtgtgcgaccaccgcctgatgtccgccgcgatcaaggacagcaaggccgtccacgccgacatgggctactggatcgagtccgagaagaacgagacctggaagctggcccgggccagcttcatcgaggtgaagacctgcatctggcccaagtcccacacgctctggagcaacggcgtgctggagtccgagatgatcatccccaagatctacgggggcccgatcagccagcacaactaccgccccgggtacttcacccagaccgcgggcccctggcacctggggaagctcgagctggacttcgacctgtgcgagggcaccacggtcgtggtggacgagcactgcggcaaccgggggccgtccctccgcaccaccaccgtcacgggcaagatcatccacgagtggtgctgccggagctgcaccctgccgcccctgcgcttcaagggggaggacggctgctggtacgggatggagatccggcccgtgaaggagaaggaggagaacctcgtgaagtccatggtcagcgccggcagcggcgaggtggactccttcagcctggggctgctctgcatctccatcatgatcgaggaggtgatgcgcagccggtggtcccgcaagatgctgatgaccggcaccctggccgtcttcctcctgctgatcatggggcagctcacgtggaacgacctgacccggctgtgcatcatggtgggcgccaacgccagcgaccgcatggggatgggcaccacctacctcgcgctgatggccacgttcaagatgcgcccgatgttcgccgtgggcctcctgttccggcgcctgacctcccgggaggtcctgctcctgaccatcgggctgagcctcgtggcctccgtcgagctgcccaacagcctggaggagctcggcgacgggctggccatgggcatcatgatcctgaagctcctgaccgacttccagtcccaccagctgtgggcgacgctcctgagcctgaccttcatcaagaccaccctctccctgcactacgcctggaagacgatggccatggtgctgagcatcgtgtccctcttccccctgtgcctgagcaccacctcccagaagaccacgtggctccccgtcctgctgggcagcctcgggtgcaagccgctggccatgttcctgatcgcggagaacaagatctggggccgcaagtcctggcccctcaacgaggggatcatggccgtgggcgtggtcagcatcctgctgagctccctcctgaagaacgacgtgcccctggccgggcccctcatcgccggcggcatgctgatcgcctgctacgtgatcagcgggtccagcgcggacctgtccctcgagaaggccgccgaggtcagctgggaggaggaggccgagcactccggcgccagccacaacatcctggtggaggtgcaggacgacgggaccatgaagatcaaggacgaggagcgggacgacaccctgaccatcctcctgaaggcgaccctgctcgccgtctccggcgtgtacccgctgagcatccccgccacgctgttcgtgtggtacttctggcagaagaagaagcagcgctccggggtcctgtgggacacccccagcccgcccgaggtggagcgggccgtgctcgacgacggcatctaccgcatcatgcagcggggcctgctggggcgctcccaggtcggcgtgggggtgttccaggagaacgtcttccacaccatgtggcacgtgacccggggcgccgtgctcatgtaccaggggaagcgcctggagcccagctgggcgtccgtcaagaaggacctgatcagctacggcggcgggtggcggctccagggctcctggaacacgggggaggaggtccaggtgatcgccgtcgagcccggcaagaaccccaagaacgtgcagaccgcccccgggaccttcaagacccccgagggcgaggtgggcgccatcgccctggacttcaagcccgggacgagcggctcccccatcgtcaaccgcgaggggaagatcgtgggcctgtacggcaacggggtggtcaccaccagcggcacctacgtgagcgcgatcgcccaggccaaggcctcccaggaggggccgctccccgagatcgaggacgaggtgttccggaagcgcaacctgacgatcatggacctgcaccccggcagcgggaagacccggcgctacctcccggcgatcgtccgggaggccatcaagcgcaagctgcggaccctgatcctcgcccccacccgcgtggtggcctccgagatggccgaggcgctgaagggcatgcccatccgctaccagacgaccgccgtcaagagcgagcacaccggcaaggagatcgtggacctgatgtgccacgccaccttcacgatgcggctcctgtcccccgtgcgcgtcccgaactacaacatgatcatcatggacgaggcccacttcaccgaccccagctccatcgccgcgcgggggtacatcagcacccgcgtgggcatgggggaggccgccgccatcttcatgaccgccacgccgcccggctccgtggaggcgttcccgcagagcaacgccgtcatccaggacgaggagcgggacatccccgagcgctcctggaacagcgggtacgagtggatcaccgacttccccggcaagaccgtgtggttcgtgccctccatcaagagcggcaacgacatcgccaactgcctgcggaagaacgggaagcgcgtcatccagctctcccggaagaccttcgacacggagtaccagaagaccaagaacaacgactgggactacgtggtgaccaccgacatcagcgagatgggcgccaacttccgcgcggaccgggtcatcgacccgcgccggtgcctgaagcccgtgatcctgaaggacgggcccgagcgcgtcatcctcgccggccccatgccggtgacggtggcctccgccgcccagcggcgcgggcggatcggccgcaaccacaacaaggagggcgaccagtacatctacatggggcagcccctgaacaacgacgaggaccacgcgcactggaccgaggccaagatgctgctcgacaacatcaacacccccgagggcatcatccccgccctgttcgagccggagcgggagaagtccgccgccatcgacggggagtaccgcctgcgcggcgaggcgcggaagaccttcgtcgagctcatgcgccgcggggacctgcccgtgtggctgtcctacaaggtggccagcgagggcttccagtacagcgaccgccggtggtgcttcgacggcgagcgcaacaaccaggtcctcgaggagaacatggacgtggagatctggacgaaggagggggagcggaagaagctgcgcccccggtggctggacgcccgcacctactccgaccccctcgccctgcgggagttcaaggagttcgccgcgggccgccggagcgtgtccggggacctgatcctcgagatcggcaagctgccgcagcacctgacccagcgcgcccagaacgccctcgacaacctggtcatgctgcacaacagcgagcagggcgggcgggcctaccgccacgcgatggaggagctccccgacaccatcgagacgctgatgctgctcgccctgatcgccgtgctgaccggcggggtgaccctcttcttcctgtccggccgggggctgggcaagaccagcatcggcctcctgtgcgtcatggcctccagcgtgctgctctggatggcctccgtggagccccactggatcgcggccagcatcatcctggagttcttcctgatggtcctcctgatccccgagccggaccgccagcggacgccccaggacaaccagctggcctacgtggtgatcgggctcctgttcatgatcctgacggtcgccgccaacgagatgggcctcctggagaccaccaagaaggacctggggatcggccacgtggcggtggagaaccaccaccacgccaccatgctcgacgtcgacctgcaccccgcctccgcctggacgctgtacgccgtggcgaccaccatcatcaccccgatgatgcgccacacgatcgagaacaccaccgccaacatcagcctcaccgccatcgccaaccaggccgcgatcctgatggggctggacaagggctggcccatctccaagatggacatcggcgtgcccctcctggccctggggtgctacagccaggtcaaccccctcacgctgaccgccgccgtgctgatgctcgtggcgcactacgccatcatcggcccggggctgcaggccaaggccacccgggaggcccagaagcgcaccgcggccggcatcatgaagaaccccacggtcgacgggatcgtggccatcgacctggaccccgtggtctacgacgccaagttcgagaagcagctcggccagatcatgctgctgatcctctgcacctcccagatcctgctgatgcgcaccacctgggccctctgcgagagcatcacgctggcgaccggccccctgaccaccctctgggaggggtccccgggcaagttctggaacacgaccatcgccgtgagcatggccaacatcttccgggggtcctacctggccggcgccggcctggcgttcagcctcatgaagtccctcgggggcgggcgccgggggaccggggcccagggcgagaccctgggcgagaagtggaagcgccagctcaaccagctgtccaagagcgagttcaacatctacaagcggtccgggatcatggaggtggaccgcagcgaggccaaggagggcctgaagcgcggggagacgacccgccacgccgtctcccggggcaccgcgaagctgcgctggttcgtggagcggaacctcgtgaagcccgaggggaaggtcatcgacctgggctgcggccgcgggggctggagctactactgcgccgggctgaagaaggtgaccgaggtgaagggctacacgaagggcgggcccggccacgaggagcccatcccgatggccacctacgggtggaacctcgtcaagctgcactccggcaaggacgtgttcttcacgccgcccgagaagtgcgacaccctgctctgcgacatcggggagagctcccccaacccgacgatcgaggagggccggaccctgcgcgtgctgaagatggtcgagccctggctccgggggaaccagttctgcatcaagatcctgaacccctacatgcccagcgtggtggagaccctggagcagatgcagcgcaagcacggcggcatgctcgtccggaacccgctgtcccgcaacagcacccacgagatgtactgggtgtcctgcgggaccggcaacatcgtgagcgccgtcaacatgacgtcccggatgctgctcaaccgcttcaccatggcccaccgcaagcccacctacgagcgggacgtggacctgggggcgggcacccgccacgtggccgtcgagcccgaggtggccaacctggacatcatcggccagcggatcgagaacatcaagcacgagcacaagagcacgtggcactacgacgaggacaacccctacaagacctgggcctaccacgggtcctacgaggtcaagccgagcggctccgccagcagcatggtgaacggggtggtcaagctcctgaccaagccctgggacgtgatccccatggtgacccagatcgcgatgacggacaccacccccttcggccagcagcgcgtcttcaaggagaaggtggacacccggacgccgaaggccaagcgcgggaccgcccagatcatggaggtgaccgcccggtggctgtggggcttcctctcccgcaacaagaagccccggatctgcacccgcgaggagttcacgcggaaggtccgcagcaacgccgcgatcggcgccgtgttcgtggacgagaaccagtggaactccgccaaggaggccgtcgaggacgagcggttctgggacctggtgcagaaggagcgcgagctgcacaagcaggggaagtgcgcgacctgcgtgtacaacatgatgggcaagcgggagaagaagctcggggagttcggcaaggccaaggggagccgcgccatctggtacatgtggctgggcgcccggttcctggagttcgaggccctcggcttcatgaacgaggaccactggttctcccgcgagaacagcctgtccggggtcgagggcgaggggctgcacaagctcggctacatcctgcgggacatcagcaagatccccgggggcaacatgtacgcggacgacaccgccggctgggacacccgcatcacggaggacgacctgcagaacgaggcccggatcaccgacatcatggagccggagcacgccctcctggccacctccatcttcaagctgacctaccagaacaaggtggtgcgcgtccagcgccccgcgaagaacgggacggtgatggacgtgatcagccggcgcgaccagcggggctccgggcaggtcggcacctacggcctcaacaccttcaccaacatggaggcccagctgatccgccagatggagagcgaggggatcttcctgccctccgagctcgagacgcagaacctggccgagcgggtgctggactggctcgagaagtacggcgtggagcgcctgaagcggatggccatcagcggggacgactgcgtcgtgaagcccatcgacgaccgcttcgccaccgcgctgaccgccctcaacgacatgggcaaggtgcggaaggacatcccgcagtgggagccctccaaggggtggaacgactggcagcaggtccccttctgcagccaccacttccaccagctgatcatgaaggacggccgcgagatcgtggtgccctgccggaaccaggacgagctggtcggccgcgcccgggtgtcccagggggccggctggagcctccgcgagaccgcctgcctgggcaagagctacgcgcagatgtggcagctgatgtacttccaccggcgcgacctccggctggccgccaacgccatctgctccgcggtgccggtcgactgggtgcccacgagccgcaccacctggtccatccacgcccaccaccagtggatgaccacggaggacatgctgagcgtgtggaaccgggtctggatcgaggagaacccctggatggaggacaagacccacgtgtccagctggggcgacgtgccctacctcgggaagcgcgaggaccagtggtgcggctccctgatcggcctgaccgcccgcgccacctgggccagcaacatccaggtcgcgatcaaccaggtgcggcgcctcatcgggaacgagaactacctggactacatgacctccatgaagcggttcaagaacgagggcgacccggagggggccctgtggtga

SEQ ID NO: 8516 - RNA, 9879 nt, synthetic construct
  misc_feature 1..9879: note = derived and/or modified CDS sequence (opt1) from DENV-1__GQ199806__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagttctgcgaggacacgatgacctacaagtgcccccgcatcaccgaggccgagcccgacgacgtggactgctggtgcaacgccaccgacacctgggtcacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtcgagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcgatcctgcggaagctgtgcatcgaggccaagatctccaacaccaccacggacagccgctgcccgacccagggcgaggccaccctcgtggaggagcaggacgccaacttcgtgtgccggcgcaccttcgtcgaccggggctgggggaacggctgcgggctgttcggcaaggggtccctgatcacgtgcgccaagttcaagtgcgtgaccaagctcgagggcaagatcgtgcagtacgagaacctgaagtacagcgtcatcgtgaccgtgcacaccggcgaccagcaccaggtcgggaacgagtccacggagcacggcaccaccgcgaccatcacgccccaggcccccagcacggagatccagctgaccgactacggggccctcaccctggactgcagcccccggaccggcctggacttcaacgagatggtgctcctgacgatgaaggagaagtcctggctggtccacaagcagtggttcctcgacctgccgctgccctggaccagcggggcctccaccagccaggagacctggaaccggaaggacctcctggtgacgttcaagaccgcccacgcgaagaagcaggaggccgtggtcctgggctcccaggagggcgccatgcacaccgccctcaccggggccacggagatccagaccagcggcaccaccacgatcttcgcggggcacctgaagtgccgcctgaagatggacaagctcaccctgaagggcatgtcctacgtgatgtgcaccgggagcttcaagctggagaaggaggtggccgagacccagcacggcacggtcctcgtgcagatcaagtacgagggcaccgacgccccctgcaagatccccttctccacccaggacgagaagggggtgacccagaacggccggctgatcacggccaacccgatcgtcaccgacaaggagaagcccgtgaacatcgaggcggagccgcccttcggggagagctacatcgtgatcggcgccggcgagaaggccctgaagctgtcctggttcaagaaggggagctccatcggcaagatgttcgaggccaccgcccgcggggcgcggcgcatggccatcctcggcgacaccgcctgggacttcgggagcatcggcggcgtcttcacgtccgtggggaagctggtgcaccagatcttcggcaccgcctacggggtcctgttcagcggcgtgtcctggaccatgaagatcgggatcggcgtgctcctgacctggctgggcctcaacagccgctccacgagcctgtccatgacctgcatcgtcgtggggctggtgaccctctacctgggcgtcatggtgcaggccgacagcgggtgcgtgatcaactggaagggccgggagctgaagtgcgggagcggcatcttcgtcaccaacgaggtgcacacgtggaccgagcagtacaagttccaggcggactccccgaagcgcctcagcgccgccatcggcaaggcctgggaggagggggtgtgcggcatccggtccgccacccgcctggagaacatcatgtggaagcagatcagcaacgagctgaaccacatcctcctggagaacgacatgaagttcaccgtcgtggtgggggacgtcgcgggcatcctggcccaggggaagaagatgatccggccccagcccatggagtacaagtactcctggaagtcctggggcaaggccaagatcatcggcgccgacgtgcagaacaccacgttcatcatcgacgggcccaacaccccggagtgccccgacgaccagcgcgcgtggaacatctgggaggtggaggactacggcttcgggatcttcaccaccaacatctggctcaagctgcgggactcctacacgcaggtctgcgaccaccgcctgatgagcgccgccatcaaggactccaaggccgtgcacgccgacatgggctactggatcgagagcgagaagaacgagacctggaagctcgcgcgggcctccttcatcgaggtgaagacctgcatctggcccaagagccacaccctgtggtccaacggcgtcctggagagcgagatgatcatccccaagatctacgggggcccgatctcccagcacaactaccgccccgggtacttcacgcagaccgccggcccctggcacctcgggaagctggagctggacttcgacctctgcgagggcaccaccgtggtggtcgacgagcactgcggcaaccgggggccgagcctgcgcacgaccaccgtgaccggcaagatcatccacgagtggtgctgccggtcctgcacgctgccgcccctgcgcttcaagggggaggacggctgctggtacgggatggagatccggcccgtgaaggagaaggaggagaacctggtcaagagcatggtgagcgccggctccggcgaggtggacagcttctccctggggctcctgtgcatcagcatcatgatcgaggaggtcatgcgctcccggtggagccgcaagatgctgatgaccggcaccctcgccgtgttcttcctgctgatcatggggcagctcacctggaacgacctgatccggctgtgcatcatggtgggcgcgaacgcctccgaccgcatggggatgggcacgacctacctcgccctgatggccaccttcaagatgcgcccgatgttcgccgtcggcctcctgttccggcgcctgaccagccgggaggtgctgctcctgacgatcgggctgtccctcgtggcgagcgtcgagctgcccaactccctggaggagctcggcgacgggctggccatgggcatcatgatcctgaagctcctgaccgacttccagagccaccagctgtgggccaccctcctgtccctgaccttcatcaagacgaccttcagcctccactacgcctggaagaccatggcgatggtgctgtccatcgtcagcctgttccccctctgcctgtccaccacgagccagaagaccacctggctgcccgtgctcctgggctccctggggtgcaagccgctcaccatgttcctgatcgccgagaacaagatctggggccgcaagagctggcccctgaacgaggggatcatggccgtgggcatcgtcagcatcctcctgtccagcctgctcaagaacgacgtgcccctggccgggcccctgatcgccggcggcatgctcatcgcgtgctacgtgatctccgggagctccgccgacctgagcctggagaaggccgccgaggtctcctgggaggaggaggccgagcacagcggcgcgtcccacaacatcctcgtggaggtgcaggacgacgggacgatgaagatcaaggacgaggagcgggacgacaccctgaccatcctgctcaaggccaccctgctggccgtcagcggcgtgtacccgctctccatccccgccaccctgttcgtgtggtacttctggcagaagaagaagcagcgcagcggggtcctgtgggacacgcccagcccgcccgaggtggagcgggccgtgctcgacgacggcatctaccgcatcatgcagcggggcctgctggggcgcagccaggtcggcgtgggggtgttccaggagaacgtcttccacaccatgtggcacgtgacccggggcgcggtgctgatgtaccaggggaagcgcctcgagccctcctgggccagcgtcaagaaggacctgatctcctacggcggcgggtggcggctgcagggcagctggaacaccggggaggaggtccaggtgatcgccgtcgagcccggcaagaaccccaagaacgtgcagacggcccccgggaccttcaagacctccgagggcgaggtgggcgccatcgcgctcgacttcaagcccgggaccagcggcagccccatcgtcaaccgcgaggggaagatcgtgggcctgtacggcaacggggtggtcacgacctccggcacctacgtgagcgccatcgcccaggccaaggcgtcccaggacgggcccctgccggagatcgaggacgaggtgttccggaagcgcaacctcaccatcatggacctgcaccccggcagcgggaagacgcggcgctacctgcccgccatcgtccgggaggccatcaagcgcaagctccggaccctgatcctggccccgacccgcgtggtggcctccgagatggcggaggccctcaagggcatgcccatccgctaccagaccacggccgtcaagagcgagcacaccggcaaggagatcgtggacctgatgtgccacgccaccttcaccatgcggctgctctcccccgtgcgcgtccccaactacaacatgatcatcatggacgaggcccacttcacggacccgagctccatcgcggcccgggggtacatcagcacccgcgtgggcatgggggaggccgccgccatcttcatgaccgcgacgccgcccggctccgtggaggccttcccccagagcaacgccgtcatccaggacgaggagcgggacatcccggagcgctcctggaacagcgggtacgagtggatcacggacttccccggcaagaccgtgtggttcgtgccctccatcaagagcggcaacgacatcgccaactgcctgcggaagaacgggaagcgcgtcatccagctgtcccggaagaccttcgacaccgagtaccagaagacgaagaacaacgactgggactacgtggtgaccaccgacatcagcgagatgggcgcgaacttccgcgccgaccgggtcatcgacccccgccggtgcctcaagccggtgatcctgaaggacgggcccgagcgcgtgatcctggccggccccatgcccgtcaccgtggcctccgccgcgcagcggcgcgggcggatcggccgcaaccacaacaaggagggcgaccagtacatctacatggggcagccgctcaacaacgacgaggaccacgcccactggacggaggccaagatgctgctggacaacatcaacacccccgagggcatcatccccgccctcttcgagcccgagcgggagaagtccgccgcgatcgacggggagtaccgcctgcgcggcgaggcccggaagaccttcgtcgagctgatgcgccgcggggacctcccggtgtggctgagctacaaggtggcctccgagggcttccagtacagcgaccgccggtggtgcttcgacggcgagcgcaacaaccaggtcctggaggagaacatggacgtggagatctggaccaaggagggggagcggaagaagctccgcccccggtggctggacgcccgcacgtactccgaccccctggccctccgggagttcaaggagttcgcggccggccgccggagcgtgtccggggacctgatcctggagatcggcaagctcccccagcacctgacccagcgcgcccagaacgccctggacaacctcgtcatgctgcacaacagcgagcagggcgggcgggcgtaccgccacgccatggaggagctgccggacaccatcgagaccctcatgctgctggccctcatcgccgtgctgacgggcggggtgaccctgttcttcctctccggccgggggctgggcaagaccagcatcggcctgctctgcgtcatggcctccagcgtgctgctgtggatggcgtccgtggagccccactggatcgccgccagcatcatcctcgagttcttcctgatggtcctgctcatccccgagcccgaccgccagcggaccccgcaggacaaccagctggcctacgtggtgatcgggctcctcttcatgatcctgaccgtcgccgcgaacgagatgggcctgctcgagacgaccaagaaggacctggggatcggccacgtggccgtggagaaccaccaccacgccgccatgctggacgtcgacctccaccccgcctccgcgtggaccctgtacgccgtggccaccacgatcatcacccccatgatgcgccacaccatcgagaacaccacggccaacatcagcctgaccgccatcgcgaaccaggccgccatcctcatggggctggacaagggctggccgatctccaagatggacatcggcgtgcccctgctcgccctggggtgctacagccaggtcaaccccctgaccctcaccgcggccgtgctgatgctggtggcccactacgccatcatcggccccgggctccaggccaaggcgacgcgggaggcccagaagcgcaccgccgccggcatcatgaagaacccgaccgtcgacgggatcgtggccatcgacctggaccccgtggtctacgacgcgaagttcgagaagcagctgggccagatcatgctcctgatcctgtgcacctcccagatcctcctgatgcgcacgacctgggccctgtgcgagagcatcaccctcgccaccggccccctgacgaccctgtgggaggggtcccccggcaagttctggaacaccaccatcgccgtgagcatggccaacatcttccgggggagctacctcgcgggcgccggcctggccttctccctgatgaagtccctcgggggcgggcgccggggcacgggggcccagggcgagaccctgggcgagaagtggaagcgccagctgaaccagctctccaagagcgagttcaacacctacaagcggtccgggatcatggaggtggaccgcagcgaggcgaaggagggcctgaagcgcggggagaccacgaagcacgccgtctcccgcggcaccgccaagctgcggtggttcgtggagcgcaacctcgtgaagccggaggggaaggtcatcgacctgggctgcggccgcggcgggtggagctactactgcgccgggctgaagaaggtgaccgaggtgaaggggtacaccaagggcggccccggccacgaggagcccatccccatggccacgtacgggtggaacctggtcaagctcaactccggcaaggacgtgttcttcatcccgcccgagaagtgcgacaccctgctgtgcgacatcggggagagctcccccaaccccaccatcgaggagggccgcaccctccgggtgctgaagatggtcgagccgtggctgcgcgggaaccagttctgcatcaagatcctcaacccctacatgcccagcgtggtggagacgctggagcagatgcagcggaagcacggcggcatgctggtccgcaaccccctctcccggaacagcacccacgagatgtactgggtgtcctgcgggaccggcaacatcgtgagcgcggtcaacatgacctcccgcatgctgctgaaccggttcaccatggcccaccgcaagccgacgtacgagcgcgacgtggacctcggggccggcacccggcacgtggccgtcgagcccgaggtggccaacctggacatcatcggccagcgcatcgagaacatcaagtacgagcacaagagcacctggcactacgacgaggacaacccctacaagacctgggcgtaccacgggtcctacgaggtgaagcccagcggcagcgcctccagcatggtcaacggggtggtcaagctgctcacgaagccgtgggacgtgatccccatggtgacccagatcgccatgaccgacaccacgcccttcggccagcagcgggtcttcaaggagaaggtggacacccgcacccccaaggccaagcgggggaccgcccagatcatggaggtgacggcgaagtggctgtggggcttcctgtcccgcaacaagaagccgcggatctgcacccgcgaggagttcacccggaaggtccgcagcaacgccgccatcggcgccgtgttcgtggacgagaaccagtggaactccgcgaaggaggccgtcgaggacgagcggttctgggacctcgtgcaccgcgagcgggagctgcacaagcaggggaagtgcgcgacctgcgtgtacaacatgatgggcaagcgcgagaagaagctgggggagttcggcaaggccaaggggagccgggccatctggtacatgtggctcggcgcgcgcttcctggagttcgaggccctgggcttcatgaacgaggaccactggttctcccgggagaacagcctctccggggtcgagggcgaggggctgcacaagctgggctacatcctccgcgacatcagcaagatccccgggggcaacatgtacgccgacgacacggccggctgggacacccggatcaccgaggacgacctgcagaacgaggccaagatcaccgacatcatggagcccgagcacgcgctgctcgccaagtccatcttcaagctgacgtaccagaacaaggtggtgcgcgtccagcggccggccaagaacgggaccgtgatggacgtgatcagccgccgcgaccagcggggctccgggcaggtcggcacctacggcctgaacaccttcacgaacatggaggcccagctcatccgccagatggagagcgaggggatcttctcccccagcgagctggagacccccaacctggccggccgggtgctcgactggctggagaagcacggggtggagcgcctgaagcggatggcgatctccggcgacgactgcgtcgtgaagcccatcgacgaccgcttcgccaccgccctcaccgccctgaacgacatggggaaggtgcggaaggacatcccgcagtgggagcccagcaagggctggaacgactggcagcaggtccccttctgcagccaccacttccaccagctgatcatgaaggacggccgcgagatcgtggtgccctgccggaaccaggacgagctcgtcgggcgcgcccgggtgtcccagggcgcggggtggagcctgcgcgagacggcctgcctgggcaagtcctacgcccagatgtggcagctcatgtacttccaccggcgcgacctgcggctggccgcgaacgccatctgcagcgccgtgccggtcgactgggtgcccacctcccgcaccacctggagcatccacgcccaccaccagtggatgacgaccgaggacatgctctccgtgtggaaccgggtctggatcgaggagaacccctggatggaggacaagacccacatcagctcctgggaggacgtgccctacctggggaagcgcgaggaccagtggtgcggcagcctgatcggcctcaccgcccgggcgacgtgggccaccaacatccaggtggccatcaaccaggtccgccgcctgatcgggaacgagaactacctggactacatgacctccatgaagcggttcaagaacgagagcgacccggagggcgccctctggtga

SEQ ID NO: 8517 - RNA, 9879 nt, synthetic construct
  misc_feature 1..9879: note = derived and/or modified CDS sequence (opt1) from DENV-1__GQ199809__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgcgggggtgaacatgtgcaccctcatcgccatggacctgggggagctgtgcgaggacaccatgacctacaagtgcccccggatcaccgaggccgagcccgacgacgtggactgctggtgcaacgccaccgacacctgggtgacctacgggacctgcagccagaccggggagcaccggcgcgacaagcggagcgtggccctcgcgccccacgtgggcctggggctggagacccgcaccgagacctggatgtccagcgagggcgcctggaagcagatccagcgggtggagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcatccagaacggccggctgatcacggccaacccgatcgtgaccgacaaggagaagcccgtgaacatcgaggccgagccgcccttcggggagtcctacatcgtcatcggcgtgggcgagaaggcgctgaagctcagctggttcaagaaggggtccagcatcggcaagatgttcgaggccaccgcccgcggggcccggcgcatggccatcctgggcgacaccgcgtgggacttcgggtccatcggcggcgtgttcacgagcgtcgggaagctggtgcaccagatcttcggcaccgcctacggggtcctgttctccggcgtcagctggaccatgaagatcgggatcggcgtgctgctgacctggctcggcctgaactcccgcagcacgtccctgagcatgacctgcatcgccgtggggctcgtcaccctgtacctgggcgtgatggtgcaggccgactccgggtgcgtcatcaactggaagggccgggagctcaagtgcgggagcggcatcttcgtgaccaacgaggtgcacacgtggaccgagcagtacaagttccaggccgacagcccgaagcgcctgtccgcggccatcggcaaggcctgggaggagggggtctgcggcatccggagcgtgacccgcctggagaacatcatgtggaagcagatctccaacgagctcaaccacatcctgctggagaacgacatgaagttcaccgtggtcgtgggggacgtggtcggcatcctcgcccaggggaagaagatgatccggccccagcccatggagcacaagtacagctggaagtcctggggcaaggccaagatcatcggcgcggacgtgcagaacaccacgttcatcatcgacgggcccaacaccccggagtgccccgacgaccagcgcgcctggaacatctgggaggtggaggactacggcttcgggatcttcaccaccaacatctggctgaagctgcgggacagctacacgcaggcctgcgaccaccgcctcatgtccgccgcgatcaaggacagcaaggccgtccacgccgacatgggctactggatcgagtccgagaagaacgagacctggaagctggcccgggccagcttcatcgaggtgaagacctgcatctggcccaagtcccacaccctgtggagcaacggcgtgctcgagtccgagatggtcatccccaagatctacgggggcccgatcagccagcacaactaccgccccgggtacttcacgcagaccgcgggcccctggcacctggggaagctggagctcgacttcgacctgtgcgagggcaccaccgtggtggtcgacgagcactgcggcaaccgggggccgtccctgcgcacgaccaccgtgaccggcaagatcatccacgagtggtgctgccggagctgcacgctgccgcccctccgcttcaagggggaggacggctgctggtacgggatggagatccggcccgtgaaggagaaggaggagaacctggtcaagtccatggtgagcgccggcagcggcgaggtggactccttcagcctcgggctgctgtgcatctccatcatgatcgaggaggtcatgcgcagccggtggtcccgcaagatgctcatgaccggcaccctggccgtgttcctgctcctgatcatggggcagctgacctggaacgacctcatccggctgtgcatcatggtgggcgccaacgccagcgaccgcatggggatgggcacgacctacctggcgctcatggccaccttcaagatgcgcccgatgttcgccgtcggcctgctgttccggcgcctcacctcccgggaggtgctgctgctcacgatcgggctgagcctggtcgcctccgtggagctccccaacagcctggaggagctgggcgacgggctcgccatgggcatcatgatcctgaagctgctcaccgacttccagtcccaccagctgtgggcgaccctgctcagcctgaccttcatcaagacgaccctgtccctccactacgcctggaagaccatggccatggtgctgagcatcgtctccctgttccccctctgcctgagcaccacgtcccagaagaccacctggctgcccgtgctcctgggcagcctggggtgcaagccgctcaccatgttcctgatcgccgagaacaagatctggggccgcaagtcctggcccctgaacgaggggatcatggcggtgggcgtcgtgagcatcctcctgagctccctgctcaagaacgacgtgcccctggccgggcccctgatcgccggcggcatgctcatcgcctgctacgtcatcagcgggtccagcgccgacctgtccctggagaaggcggccgaggtgagctgggaggaggaggccgagcactccggcgccagccacaacatcctcgtggaggtccaggacgacgggacgatgaagatcaaggacgaggagcgggacgacaccctgaccatcctgctcaaggccaccctgctggcggtgtccggcgtgtacccgctcagcatccccgccaccctgttcgtctggtacttctggcagaagaagaagcagcgctccggggtgctgtgggacacgcccagcccgcccgaggtggagcgggccgtcctggacgacggcatctaccgcatcatgcagcggggcctcctggggcgctcccaggtgggcgtgggggtcttccaggagaacgtgttccacaccatgtggcacgtgacccggggcgccgtcctgatgtaccaggggaagcgcctcgagcccagctgggcctccgtgaagaaggacctgatcagctacggcggcgggtggcggctgcagggctcctggaacaccggggaggaggtgcaggtcatcgcggtggagcccggcaagaaccccaagaacgtgcagacggcccccgggaccttcaagacccccgagggcgaggtcggcgccatcgccctcgacttcaagcccgggaccagcggctcccccatcgtgaaccgcgaggggaagatcgtgggcctgtacggcaacggggtcgtgacgaccagcggcacctacgtgagcgccatcgcgcaggccaaggcctcccaggaggggccgctgcccgagatcgaggacgaggtcttccggaagcgcaacctcaccatcatggacctgcaccccggcagcgggaagacgcggcgctacctgccggccatcgtgcgggaggcgatcaagcgcaagctccggaccctgatcctggcccccacccgcgtggtcgcctccgagatggccgaggccctcaagggcatgcccatccgctaccagaccacggcggtcaagagcgagcacaccggcaaggagatcgtggacctgatgtgccacgccaccttcaccatgcggctgctctcccccgtccgcgtgccgaactacaacatgatcatcatggacgaggcccacttcacggaccccagctccatcgccgcccgggggtacatcagcacccgcgtgggcatgggggaggcggccgccatcttcatgaccgccacgccgcccggctccgtcgaggccttcccgcagagcaacgcggtgatccaggacgaggagcgggacatccccgagcgctcctggaacagcgggtacgagtggatcacggacttccccggcaagaccgtgtggttcgtcccctccatcaagagcggcaacgacatcgccaactgcctgcggaagaacgggaagcgcgtgatccagctgtcccggaagaccttcgacaccgagtaccagaagacgaagaacaacgactgggactacgtggtcaccaccgacatcagcgagatgggcgccaacttccgcgccgaccgggtgatcgacccgcgccggtgcctcaagcccgtcatcctgaaggacgggcccgagcgcgtgatcctggcgggccccatgccggtgaccgtcgcctccgccgcccagcggcgcgggcggatcggccgcaaccacaacaaggagggcgaccagtacatctacatggggcagcccctcaacaacgacgaggaccacgcccactggacggaggcgaagatgctgctggacaacatcaacacccccgagggcatcatccccgccctcttcgagccggagcgggagaagtccgccgccatcgacggggagtaccgcctgcgcggcgaggcccggaagaccttcgtggagctgatgcgccgcggggacctccccgtgtggctgtcctacaaggtcgcgagcgagggcttccagtacagcgaccgccggtggtgcttcgacggcgagcgcaacaaccaggtgctggaggagaacatggacgtggagatctggaccaaggagggggagcggaagaagctccgcccccggtggctggacgcccgcacgtactccgaccccctggccctccgggagttcaaggagttcgccgccggccgccggagcgtctccggggacctgatcctggagatcggcaagctcccgcagcacctgacccagcgcgcgcagaacgccctggacaacctcgtgatgctgcacaacagcgagcagggcgggcgggcctaccgccacgccatggaggagctgcccgacaccatcgagaccctcatgctgctggcgctcatcgccgtgctgacgggcggggtcaccctgttcttcctctccggccgggggctgggcaagaccagcatcggcctgctctgcgtgatggcctccagcgtgctgctgtggatggcctccgtcgagccccactggatcgccgcgagcatcatcctcgagttcttcctgatggtgctgctcatccccgagccggaccgccagcggacgccccaggacaaccagctggcctacgtggtcatcgggctcctcttcatgatcctgaccgtggccgccaacgagatgggcctgctcgagacgaccaagaaggacctggggatcggccacgtggccgtcgagaaccaccaccacgcgaccatgctggacgtggacctccaccccgcctccgcctggaccctgtacgccgtggccacgaccatcatcaccccgatgatgcgccacaccatcgagaacacgaccgcgaacatcagcctgaccgccatcgccaaccaggccgccatcctcatggggctggacaagggctggcccatctccaagatggacatcggcgtccccctgctcgcgctggggtgctacagccaggtgaaccccctgaccctcacggccgccgtgctgatgctggtcgcccactacgcgatcatcggcccggggctccaggccaaggccacccgggaggcccagaagcgcaccgccgcgggcatcatgaagaaccccaccgtggacgggatcgtggccatcgacctggaccccgtcgtgtacgacgccaagttcgagaagcagctgggccagatcatgctcctgatcctgtgcacgtcccagatcctcctgatgcgcaccacctgggccctgtgcgagagcatcaccctcgccacgggccccctgaccaccctgtgggaggggtccccgggcaagttctggaacaccacgatcgcggtgagcatggccaacatcttccgggggtcctacctcgccggcgccggcctggccttcagcctgatgaagtccctcgggggcgggcgccggggcaccggggcgcagggcgagaccctgggcgagaagtggaagcgccagctgaaccagctctccaagagcgagttcaacatctacaagcggtccgggatcatggaggtcgaccgcagcgaggccaaggagggcctgaagcgcggggagaccacgcgccacgccgtgtcccggggcaccgccaagctgcgctggttcgtggagcggaacctggtcaagcccgaggggaaggtgatcgacctcggctgcggccgcgggggctggagctactactgcgcggggctgaagaaggtgaccgaggtcaagggctacaccaagggcgggcccggccacgaggagcccatcccgatggccacgtacgggtggaacctggtgaagctccactccggcaaggacgtgttcttcacgccgcccgagaagtgcgacaccctgctgtgcgacatcggggagagctcccccaacccgaccatcgaggagggccggacgctccgcgtcctgaagatggtggagccctggctgcgggggaaccagttctgcatcaagatcctcaacccctacatgcccagcgtggtcgagaccctggagcagatgcagcgcaagcacggcggcatgctggtgcggaacccgctctcccgcaacagcacccacgagatgtactgggtgtcctgcgggaccggcaacatcgtcagcgccgtgaacatgacctcccggatgctgctgaaccgcttcacgatggcccaccgcaagcccacctacgagcgggacgtggacctcggggccggcacccgccacgtcgcggtggagcccgaggtcgccaacctggacatcatcggccagcggatcgagaacatcaagcacgagcacaagagcacctggcactacgacgaggacaacccctacaagacgtgggcctaccacgggtcctacgaggtgaagccgagcggctccgccagcagcatggtgaacggggtcgtgaagctgctcaccaagccctgggacgtgatccccatggtcacccagatcgccatgaccgacacgacccccttcggccagcagcgcgtgttcaaggagaaggtggacacccggaccccgaaggcgaagcgcgggacggcccagatcatggaggtcaccgcccggtggctgtggggcttcctgtcccgcaacaagaagccccggatctgcacccgcgaggagttcacccggaaggtgcgcagcaacgccgccatcggcgcggtgttcgtcgacgagaaccagtggaactccgccaaggaggccgtggaggacgagcggttctgggacctcgtgcagaaggagcgcgagctgcacaagcaggggaagtgcgccacgtgcgtctacaacatgatgggcaagcgggagaagaagctgggggagttcggcaaggcgaaggggagccgcgccatctggtacatgtggctcggcgcccggttcctggagttcgaggccctgggcttcatgaacgaggaccactggttctcccgcgagaacagcctctccggggtggagggcgaggggctgcacaagctgggctacatcctccgggacatcagcaagatccccgggggcaacatgtacgccgacgacaccgcgggctgggacacccgcatcaccgaggacgacctgcagaacgaggccaagatcacggacatcatggagccggagcacgccctgctcgccacctccatcttcaagctgacctaccagaacaaggtggtccgggtgcagcgccccgccaagaacgggaccgtgatggacgtcatcagccgccgggaccagcgcggctccggccaggtgggcacgtacggcctgaacaccttcaccaacatggaggcgcagctcatccggcagatggagagcgaggggatcttcctgccctccgagctggagacccccaacctcgccgagcgcgtgctggactggctggagaagcacggcgtcgagcggctcaagcgcatggccatcagcggggacgactgcgtggtgaagccgatcgacgaccggttcgccacggccctgaccgcgctgaacgacatgggcaaggtccgcaaggacatcccccagtgggagccctccaaggggtggaacgactggcagcaggtccccttctgcagccaccacttccaccagctcatcatgaaggacggccgggagatcgtggtcccgtgccgcaaccaggacgagctggtgggccgggcccgcgtgtcccagggggccggctggagcctgcgggagaccgcctgcctcggcaagagctacgcccagatgtggcagctgatgtacttccaccgccgggacctgcgcctcgcggccaacgccaactgctccgccgtccccgtggactgggtgcccaccagccggacgacctggtccatccacgcgcaccaccagtggatgaccaccgaggacatgctgagcgtctggaaccgcgtgtggatcgaggagaacccctggatggaggacaagacgcacgtgtccagctggggcgacgtcccgtacctggggaagcgggaggaccagtggtgcggctccctcatcggcctgaccgcccgcgccacctgggccagcaacatccaggtggccatcaaccaggtgcgccggctgatcgggaacgagaactacctcgactacatgacctccatgaagcgcttcaagaacgagggcgaccccgagggggcgctgtggtga

SEQ ID NO: 8518 - RNA, 9879 nt, synthetic construct
  misc_feature 1..9879: note = derived and/or modified CDS sequence (opt1) from DENV-1__GQ199810__SS-prME
  source 1..9879: mol_type = other RNA
agcgtgaccatgctgctgatgctgatgcccaccgccctggccttccacctcaccacccggggcggggagccccacatgatcgtcagcaagcaggagcggggcaagagcctgctgttcaagacctccgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtcacctacgggacctgcagccagacgggcgagcaccggcgggacaagcggtccgtggccctcgcgccccacgtgggcctggggctggagacccgcaccgagacctggatgagctccgagggcgcgtggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcctgacgcaggacgagaagggggtgacccagaacggccggctgatcaccgccaacccgatcgtgaccgacaaggagaagcccgtcaacatcgaggccgagccgcccttcggggagagctacatcatcatcggcgccggcgagaaggcgctcaagctgtcctggttcaagaaggggagctccatcggcaagatgttcgaggccacggcccgcggggcccggcgcatggccatcctgggcgacaccgcgtgggacttcgggagcatcggcggcgtgttcacctccgtggggaagctcgtccaccagatcttcggcaccgcctacggggtgctgttcagcggcgtgtcctggacgatgaagatcgggatcggcgtcctgctcacctggctgggcctgaacagccgctccaccagcctctccatgacctgcatcgccgtggggctggtgacgctgtacctcggcgtcatggtgcaggccgacagcgggtgcgtgatcaactggaagggccgggagctgaagtgcgggtccggcatcttcgtcaccaacgaggtgcacacctggaccgagcagtacaagttccaggccgacagcccgaagcgcctgagcgcggccatcggcaaggcctgggaggagggggtgtgcggcatccggtccgccacccgcctcgagaacatcatgtggaagcagatcagcaacgagctgaaccacatcctgctcgagaacgacatgaagttcacggtcgtggtgggggacgtcgccggcatcctggcgcaggggaagaagatgatccggccccagcccatggagtacaagtactcctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctgaagctccgggactcccacacccaggtctgcgaccaccgcctgatgagcgcggccatcaaggactccaaggccgtgcacgccgacatgggctactggatcgagagcgagaagaacgagacctggaagctggcccgggcgtccttcatcgaggtgaagacgtgcatctggcccaagagccacaccctctggtccaacggcgtcctggagagcgagatgatcatccccaagatctacgggggcccgatctcccagcacaactaccgccccgggtacttcacccagaccgccggcccctggcacctggggaagctcgagctggacttcgacctgtgcgagggcacgaccgtggtggtcgacgagcactgcggcaaccgggggccgagcctccgcaccaccacggtgaccggcaagatcatccacgagtggtgctgccggtcctgcaccctgccgcccctgcgcttccgcggggaggacggctgctggtacgggatggagatccgccccgtgaaggagaaggaggagaacctcgtcaagagcatggtgtccgccggcagcggcgaggtggacagcttctccctggggctgctctgcatcagcatcatgatcgaggaggtcatgcggtcccgctggagccggaagatgctgatgaccggcacgctggccgtgttcttcctcctgatcatggggcagctgacctggaacgacctcatccgcctgtgcatcatggtgggcgccaacgcgtccgaccgcatggggatgggcaccacctacctggccctcatggccacgttcaagatgcggccgatgttcgccgtcggcctgctgttccgccggctcaccagccgcgaggtgctgctgctcaccatcgggctgtccctggtggccagcgtcgagctccccaactccctggaggagctgggcgacgggctcgcgatgggcatcatgatcctgaagctgctcaccgacttccagagccaccagctgtgggccacgctgctctccctgaccttcatcaagaccaccttcagcctgcactacgcctggaagacgatggccatggtgctctccatcgtcagcctgttccccctgtgcctctccaccaccagccagaagaccacgtggctgcccgtgctgctcggctccctggggtgcaagccgctgaccatgttcctcatcgcggagaacaagatctggggccggcgcagctggcccctgaacgaggggatcatggccgtgggcatcgtctccatcctgctcagcagcctgctgaagaacgacgtgcccctcgccgggcccctgatcgccggcggcatgctgatcgcctgctacgtgatctccgggagctccgcggacctcagcctggagaaggccgccgaggtctcctgggaggaggaggtggagcacagcggcgcctcccacaacatcctggtggaggtccaggacgacgggaccatgaagatcaaggacgaggagcgggacgacaccctcaccatcctgctgaaggccacgctcctggcggtgagcggcgtgtacccgctgtccatccccgccaccctcttcgtctggtacttctggcagaagaagaagcagcgcagcggggtgctgtgggacacccccagcccgcccgaggtggagcgggccgtcctggacgacggcatctaccgcatcatgcagcggggcctgctcgggcgcagccaggtgggcgtgggggtcttccaggagaacgtgttccacaccatgtggcacgtgacgcggggcgccgtcctgatgtaccaggggaagcgcctggagccctcctgggccagcgtgaagaaggacctcatctcctacggcggcgggtggcggctgcagggcagctggaacaccggggaggaggtgcaggtcatcgcggtggagcccggcaagaaccccaagaacgtgcagaccgcccccgggaccttcaagacgcccgagggcgaggtcggcgccatcgccctggacttcaagcccgggacctccggcagccccatcgtgaaccgcgaggggaagatcgtgggcctctacggcaacggggtcgtgaccacctccggcacgtacgtgagcgccatcgcgcaggccaaggccagccaggaggggccgctgcccgagatcgaggacgaggtcttccggaagcgcaacctgaccatcatggacctccaccccggctccgggaagacccggcgctacctgccggccatcgtgcgggaggcgatcaagcgcaagctgcgcaccctcatcctggcccccacgcgggtggtcgccagcgagatggccgaggccctgaagggcatgcccatccgctaccagaccaccgcggtgaagtccgagcacaccggcaaggagatcgtggacctcatgtgccacgccacgttcaccatgcggctgctgagccccgtccgcgtgccgaactacaacatgatcatcatggacgaggcccacttcaccgacccctccagcatcgccgcccgggggtacatctccacccgcgtgggcatgggggaggcggccgccatcttcatgacggccacgccgcccggcagcgtcgaggccttcccgcagtccaacgcggtgatccaggacgaggagcgggacatccccgagcgcagctggaactccgggtacgagtggatcaccgacttccccggcaagaccgtgtggttcgtccccagcatcaagtccggcaacgacatcgccaactgcctccggaagaacgggaagcgcgtgatccagctgagccggaagacgttcgacaccgagtaccagaagaccaagaacaacgactgggactacgtggtcaccacggacatctccgagatgggcgccaacttccgcgccgaccgggtgatcgacccgcgccggtgcctgaagcccgtgatcctcaaggacgggcccgagcgcgtcatcctggcgggccccatgccggtgaccgtcgccagcgccgcccagcggcgcgggcggatcggccgcaaccacaacaaggagggcgaccagtacatctacatggggcagcccctgaacaacgacgaggaccacgcccactggaccgaggcgaagatgctcctggacaacatcaacacccccgagggcatcatccccgccctgttcgagccggagcgcgagaagtccgccgccatcgacggggagtaccggctccgcggcgaggcccggaagacgttcgtggagctgatgcgccgcggggacctgcccgtgtggctcagctacaaggtcgcgtccgagggcttccagtacagcgaccgccggtggtgcttcgacggcgagcgcaacaaccaggtgctggaggagaacatggacgtggagatctggaccaaggagggggagcggaagaagctgcgcccccggtggctcgacgcccgcacctacagcgaccccctggccctgcgggagttcaaggagttcgccgccggccgccggtccgtcagcggggacctcatcctggagatcggcaagctgccgcagcacctcacccagcgcgcgcagaacgccctggacaacctggtgatgctccacaactccgagcagggcgggcgggcctaccgccacgccatggaggagctgcccgacacgatcgagaccctgatgctcctggcgctgatcgccgtgctcaccggcggggtcaccctgttcttcctgagcggccgggggctcggcaagacctccatcggcctgctgtgcgtgatggccagctccgtgctcctgtggatggccagcgtcgagccccactggatcgccgcgtccatcatcctggagttcttcctcatggtgctgctgatccccgagccggaccgccagcggacgccccaggacaaccagctcgcctacgtggtcatcgggctgctgttcatgatcctcaccgtggccgccaacgagatgggcctgctggagaccaccaagaaggacctcgggatcggccacgtggccgtcgagaaccaccaccacgcggccatgctggacgtggacctgcaccccgccagcgcctggacgctctacgccgtggcgaccaccatcatcaccccgatgatgcgccacacgatcgagaacaccaccgccaacatctccctgaccgccatcgccaaccaggccgcgatcctgatggggctcgacaagggctggcccatcagcaagatggacatcggcgtccccctgctggccctcgggtgctactcccaggtgaaccccctgacgctgaccgccgccgtgctcatgctggtcgcgcactacgccatcatcggcccggggctgcaggccaaggccacccgcgaggcccagaagcggaccgcggccggcatcatgaagaaccccacggtggacgggatcgtggccatcgacctcgaccccgtcgtgtacgacgccaagttcgagaagcagctgggccagatcatgctgctcatcctgtgcaccagccagatcctgctcatgcgcaccacctgggccctgtgcgagtccatcacgctggcgaccggccccctcaccaccctgtgggaggggagcccgggcaagttctggaacacgaccatcgccgtgtccatggccaacatcttccgggggagctacctggccggcgccggcctcgcgttctccctgatgaagtccctcgggggcgggcgccgggggaccggggcccagggcgagaccctcggcgagaagtggaagcgccagctgaaccagctgagcaagtccgagttcaacacgtacaagcggagcgggatcatggaggtcgaccgctccgaggccaaggagggcctcaagcgcggggagaccaccaagcacgccgtgagccgcggcaccgcgaagctgcggtggttcgtggagcgcaacctggtcaagcccgaggggaaggtgatcgacctgggctgcggccgcggcgggtggtcctactactgcgccgggctcaagaaggtgacggaggtcaaggggtacaccaagggcggccccggccacgaggagcccatcccgatggccacctacgggtggaacctggtgaagctgcacagcggcaaggacgtgttcttcatcccgcccgagaagtgcgacaccctcctgtgcgacatcggggagtccagccccaacccgacgatcgaggagggccgcaccctgcgggtcctcaagatggtggagccctggctgcgcgggaaccagttctgcatcaagatcctgaacccctacatgccctccgtggtcgagaccctcgagcagatgcagcggaagcacggcggcatgctggtgcgcaacccgctgagccggaactccacccacgagatgtactgggtgagctgcgggaccggcaacatcgtctccgccgtgaacatgacgagccgcatgctcctgaaccgcttcaccatggcccaccggaagcccacctacgagcgcgacgtggacctgggggcgggcacccggcacgtcgccgtggagcccgagatcgccaacctcgacatcatcggccagcgcatcgagaacatcaagcacgagcacaagtccacgtggcactacgacgaggacaacccctacaagacctgggcctaccacgggagctacgaggtgaagccgtccggcagcgcctccagcatggtcaacggggtggtcaagctgctgaccaagccctgggacgtgatccccatggtgacccagatcgcgatgacggacaccacccccttcggccagcagcgggtcttcaaggagaaggtggacacccgcacgccgaaggccaagcgggggaccgcccagatcatggaggtgaccgccaagtggctctggggcttcctgagccgcaacaagaagccccggatctgcacccgcgaggagttcacgcggaaggtccgctccaacgccgcgatcggcgccgtgttcgtggacgagaaccagtggaacagcgccaaggaggccgtcgaggacgagcggttctgggacctggtgcaccgcgagcgggagctccacaagcaggggaagtgcgcgacctgcgtgtacaacatgatgggcaagcgcgagaagaagctgggggagttcggcaaggccaaggggtcccgggccatctggtacatgtggctgggcgcccgcttcctcgagttcgaggccctgggcttcatgaacgaggaccactggttcagccgggagaactccctgagcggggtcgagggcgaggggctccacaagctgggctacatcctgcgcgacatctccaagatccccgggggcaacatgtacgcggacgacaccgccggctgggacacccggatcacggaggacgacctccagaacgaggcccgcatcaccgacatcatggagccggagcacgccctgctggccaagagcatcttcaagctcacctaccagaacaaggtggtgcgcgtccagcggcccgcgaagaacgggaccgtgatggacgtgatctcccgccgggaccagcgcggcagcgggcaggtcggcacgtacggcctgaacaccttcaccaacatggaggcccagctgatccggcagatggagtccgaggggatcttcagcccctccgagctcgagacccccaacctggccgagcgcgtgctggactggctcgagaagtacggcgtggagcggctgaagcgcatggccatcagcggggacgactgcgtcgtgaagccgatcgacgaccggttcgccacggcgctgaccgccctcaacgacatgggcaaggtgcgcaaggacatcccccagtgggagccctccaaggggtggaacgactggcagcaggtccccttctgcagccaccacttccaccagctgatcatgaaggacggccgggagatcgtggtgccgtgccgcaaccaggacgagctggtcggccgggcccgcgtgtcccagggggccggctggagcctccgggagaccgcctgcctgggcaagagctacgcgcagatgtggcagctgatgtacttccaccgccgggacctccgcctggccgccaacgccatctgctccgcggtgcccgtcgactggatccccaccagccggacgacctggtccatccacgcccaccaccagtggatgaccaccgaggacatgctgagcgtgtggaaccgcgtgtggatcgaggagaacccctggatggaggacaagacgcacatctccagctggggcgacgtcccgtacctcgggaagcgcgaggaccagtggtgcggctccctgatcggcctgaccgcccgggccacctgggccaccaacatccaggtggcgatcaaccaggtgcgccggctcatcgggaacgagaactacctggactacatgaccagcatgaagcgcttcaagaacgagggcgaccccgagggggccctgtggtga

SEQ ID NO: 8519 - RNA, 9879 nt, synthetic construct
  misc_feature 1..9879: note = derived and/or modified CDS sequence (opt1) from DENV-1__GQ199811__SS-prME
  source 1..9879: mol_type = other RNA
agcgtgaccatgctgctgatgctgatgcccaccgccctggccttccacctcacgacccgcggcggggagccccacatgatcgtgagcaagcaggagcggggcaagagcctgctgttcaagaccagcgccggggtgaacatgtgcaccctcatcgccatggacctgggcgagttctgcgaggacaccatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctggcgccccacgtgggcctcgggctggagacgcgcaccgagacctggatgagctccgagggcgcctggaagcagatccagcgggtcgagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggaccagcggggcctccaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctcgtccagatcaagtacgagggcaccgacgccccctgcaagatccccttctccacccaggacgagaagggggtgacccagaacggccggctgatcacggccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacaccgcctgggacttcgggagcatcggcggcgtgttcacgtccgtcgggaagctggtgcaccagatcttcggcaccgcctacggggtgctgttcagcggcgtctcctggaccatgaagatcgggatcggcgtgctcctgacctggctgggcctcaacagccgctccacgagcctgtccatgacctgcatcgccgtggggctggtcaccctctacctgggcgtgatggtgcaggccgacagcgggtgcgtcatcaactggaagggccgggagctgaagtgcgggagcggcatcttcgtgaccaacgaggtgcacacgtggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaactacatcctcctggagaacgacatgaagctgaccgtggtggtcggggacgtggcgggcatcctcgcccaggggaagaagatgatccggccccagcccatggagtacaagtactcctggaagtcctggggcaaggccaagatcatcggcgccgacgtgcagaacaccacgttcatcatcgacgggcccaacaccccggagtgccccgacgaccagcgcgcgtggaacatctgggaggtcgaggactacggcttcgggatcttcaccaccaacatctggctgaagctgcgggactcctacacccaggtgtgcgaccaccgcctcatgagcgccgccatcaaggactccaaggccgtgcacgccgacatgggctactggatcgagagcgagaagaacgagacctggaagctggcgcgggcctccttcatcgaggtcaagacctgcatctggcccaagagccacaccctgtggtccaacggcgtgctcgagagcgagatgatcatccccaagatctacgggggcccgatctcccagcacaactaccgccccgggtacttcacgcagaccgccggcccctggcacctggggaagctggagctcgacttcgacctgtgcgagggcaccaccgtggtcgtggacgagcactgcggcaaccgggggccgagcctgcgcacgaccaccgtgaccggcaagatcatccacgagtggtgctgccggtcctgcacgctgccgcccctccgcttcaagggggaggacggctgctggtacgggatggagatccggcccgtcaaggagaaggaggagaacctggtcaagagcatggtgagcgccggctccggcgaggtcgacagcttctccctcgggctgctgtgcatcagcatcatgatcgaggaggtgatgcgctcccggtggagccgcaagatgctcatgaccggcaccctggccgtgttcttcctgctcatcatggggcagctgacctggaacgacctgatccggctctgcatcatggtcggcgcgaacgcctccgaccgcatggggatgggcacgacctacctggccctgatggccaccttcaagatgcgcccgatgttcgccgtgggcctcctgttccggcgcctgaccagccgggaggtgctcctgctgacgatcgggctctccctggtcgcgagcgtggagctgcccaactccctcgaggagctgggcgacgggctggccatgggcatcatgatcctcaagctgctgaccgacttccagagccaccagctctgggccaccctgctgtccctcaccttcgtccgcacgaccttcagcctgcactacgcctggaagaccatggcgatggtgctgtccatcgtgagcctcttccccctgtgcctgtccaccacgagccagaagaccacctggctccccgtcctgctgggctccctcgggtgcaagccgctgaccatgttcctgatcgccgagaacaagatctggggccgcaagagctggcccctcaacgaggggatcatggccgtgggcatcgtgagcatcctgctgtccagcctcctgaagaacgacgtccccctggccgggcccctcatcgccggcggcatgctgatcgcgtgctacgtgatctccgggagctccgccgacctgagcctcgagaaggccgccgtggtctcctgggaggaggaggccgagcacagcggcgcgtcccacaacatcctggtggaggtgcaggacgacgggacgatgaagatcaaggacgaggagcgcgacgacaccctgaccatcctcctgaaggccaccctgctcgccgtcagcggcgtgtacccgctgtccatccccgccaccctgttcgtgtggtacttctggcagaagaagaagcagcggagcggggtcctctgggacacgcccagcccgcccgaggtggagcgcgccgtgctggacgacggcatctaccggatcatgcagcgcggcctgctggggcggagccaggtcggcgtgggggtgttccaggagaacgtcttccacaccatgtggcacgtgacccgcggcgcggtgctcatgtaccaggggaagcggctggagccctcctgggccagcgtcaagaaggacctgatctcctacggcggcgggtggcgcctccagggcagctggaacaccggggaggaggtccaggtgatcgccgtcgagcccggcaagaaccccaagaacgtgcagacggcccccgggaccttcaagacctccgagggcgaggtgggcgccatcgcgctggacttcaagcccgggaccagcggcagccccatcgtcaaccgggaggggaagatcgtgggcctgtacggcaacggggtggtcacgacctccggcacctacgtgagcgccatcgcccaggccaaggcgtcccaggaggggcccctcccggagatcgaggacgaggtgttccgcaagcggaacctgaccatcatggacctgcaccccggcagcgggaagacgcgccggtacctccccgccatcgtccgcgaggccatcaagcggaagctgcgcaccctgatcctcgccccgacccgcgtggtggcctccgagatggcggaggccctgaagggcatgcccatccggtaccagaccacggccgtcaagagcgagcacaccggcaaggagatcgtggacctgatgtgccacgccaccttcaccatgcgcctcctgtcccccgtgcgggtccccaactacaacatgatcatcatggacgaggcccacttcacggacccgagctccatcgcggcccgcgggtacatcagcacccgggtgggcatgggggaggccgccgccatcttcatgaccgcgacgccgcccggctccgtggaggccttcccccagagcaacgccgtcatccaggacgaggagcgcgacatcccggagcggtcctggaacagcgggtacgagtggatcacggacttccccggcaagaccgtgtggttcgtgccctccatcaagagcggcaacgacatcgccaactgcctgcgcaagaacgggaagcgggtcatccagctctcccgcaagaccttcgacaccgagtaccagaagacgaagaacaacgactgggactacgtggtgaccaccgacatcagcgagatgggcgcgaacttccgggccgaccgcgtcatcgacccccggcgctgcctgaagccggtgatcctgaaggacgggcccgagcgggtcatcctcgccggccccatgcccgtgaccgtggcctccgccgcgcagcgccgggggcgcatcggccggaaccacaacaaggagggcgaccagtacatctacatggggcagccgctgaacaacgacgaggaccacgcccactggacggaggccaagatgctgctcgacaacatcaacacccccgagggcatcatccccgccctgttcgagcccgagcgcgagaagtccgccgcgatcgacggggagtaccgcctgcggggcgaggcccgcaagaccttcgtcgagctcatgcggcgcggggacctgccggtgtggctgagctacaaggtggcctccgagggcttccagtacagcgaccggcgctggtgcttcgacggcgagcggaacaaccaggtcctcgaggagaacatggacgtggagatctggaccaaggagggggagcgcaagaagctgcggccccgctggctggacgcccggacgtactccgaccccctcgccctgcgcgagttcaaggagttcgcggccggccggcgcagcgtgtccggggacctgatcctcgagatcggcaagctgccccagcacctgacccagcgggcccagaacgccctcgacaacctggtcatgctgcacaacagcgagcagggcgggcgcgcgtaccggcacgccatggaggagctcccggacaccatcgagaccctgatgctgctcgccctgatcgccgtgctgacgggcggggtgaccctcttcttcctgtccggccgcgggctgggcaagaccagcatcggcctcctgtgcgtcatggcctccagcgtgctgctctggatggcgtccgtggagccccactggatcgccgccagcatcatcctggagttcttcctgatggtcctcctgatccccgagcccgaccggcagcgcaccccgcaggacaaccagctggcctacgtggtgatcgggctcctgttcatgatcctgaccgtcgccgcgaacgagatgggcctcctggagacgaccaagaaggacctggggatcggccacgtggccgtggagaaccaccaccacgccgccatgctcgacgtcgacctgcaccccgcctccgcgtggaccctgtacgccgtggccaccacgatcatcacccccatgatgcggcacaccatcgagaacaccacggccaacatcagcctcaccgccatcgcgaaccaggccgccatcctgatggggctggacaagggctggccgatctccaagatggacatcggcgtgcccctcctggccctggggtgctacagccaggtcaaccccctcaccctgaccgcggccgtgctgatgctcgtggcccactacgccatcatcggccccgggctgcaggccaaggcgacgcgcgaggcccagaagcgcaccgccgccggcatcatgaagaacccgaccgtcgacgggatcgtggccatcgacctggaccccgtggtctacgacgcgaagttcgagaagcagctcggccagatcatgctgctgatcctctgcacctcccagatcctgctgatgcggacgacctgggccctctgcgagagcatcaccctggccaccggccccctgacgaccctctgggaggggtcccccggcaagttctggaacaccaccatcgccgtgagcatggccaacatcttccgcgggagctacctggcgggcgccggcctggccttctccctcatgaagtccctcgggggcgggcggcgcgggacgggggcccagggcgagaccctgggcgagaagtggaagcggcagctcaaccagctgtccaagagcgagttcaacacctacaagcgctccgggatcatggaggtggaccggagcgaggcgaaggagggcctgaagcgcggggagaccacgaagcacgccgtctcccggggcaccgccaagctccgctggttcgtggagcggaacctggtgaagccggaggggaaggtcatcgacctgggctgcggccgcgggggctggagctactactgcgccgggctgaagaaggtgaccgaggtgaagggctacaccaagggcgggcccggccacgaggagcccatccccatggccacgtacgggtggaacctcgtcaagctgcactccggcaaggacgtgttcttcatcccgcccgagaagtgcgacaccctgctctgcgacatcggggagagctcccccaaccccaccatcgaggagggccggaccctgcgcgtgctgaagatggtcgagccgtggctccgggggaaccagttctgcatcaagatcctgaacccctacatgcccagcgtggtggagacgctggagcagatgcagcgcaagcacggcggcatgctcgtccggaaccccctgtcccgcaacagcacccacgagatgtactgggtgtcctgcgggaccggcaacatcgtgagcgcggtcaacatgacctcccggatgctgctcaaccgcttcaccatggcccaccgcaagccgacgtacgagcgggacgtggacctgggggccggcacccgccacgtggccgtcgagcccgaggtggccaacctggacatcatcggccagcggatcgagaacatcaagcacgagcacaagagcacctggcactacgacgaggacaacccctacaagacctgggcgtaccacgggtcctacgaggtcaagcccagcggcagcgcctccagcatggtgaacggggtggtcaagctcctgacgaagccgtgggacgtgatccccatggtgacccagatcgccatgaccgacaccacgcccttcggccagcagcgcgtcttcaaggagaaggtggacacccggacccccaaggccaagcgcgggaccgcccagatcatggaggtgacggcgaagtggctgtggggcttcctctcccggaacaagaagccgcgcatctgcacccgggaggagttcacccgcaaggtccggagcaacgccgccatcggcgccgtgttcgtggacgagaaccagtggaactccgcgaaggaggccgtcgaggacgagcgcttctgggacctggtgcaccgggagcgcgagctgcacaagcaggggaagtgcgcgacctgcgtgtacaacatgatgggcaagcgggagaagaagctcggggagttcggcaaggccaaggggagccgcgccatctggtacatgtggctgggcgcgcggttcctggagttcgaggccctcggcttcatgaacgaggaccactggttctcccgcgagaacagcctgtccggggtcgagggcgaggggctgcacaagctcggctacatcctgcgggacatcagcaagatccccgggggcaacatgtacgccgacgacacggccggctgggacacccgcatcaccgaggacgacctgcagaacgaggccaagatcaccgacatcatggagcccgagcacgcgctcctggccaagtccatcttcaagctgacgtaccagaacaaggtggtgcgggtccagcgcccggccaagaacgggaccgtgatggacgtgatcagccgccgggaccagcgcggctccgggcaggtcggcacctacggcctcaacaccttcacgaacatggaggcccagctgatccggcagatggagagcgaggggatcttctcccccagcgagctggagacccccaacctcgccggccgcgtgctggactggctggagaagcacggggtggagcggctcaagcgcatggcgatctccggcgacgactgcgtcgtgaagcccatcgacgaccggttcgccaccgccctgaccgccctgaacgacatggggaaggtgcgcaaggacatcccgcagtgggagcccagcaagggctggaacgactggcagcaggtccccttctgcagccaccacttccaccagctcatcatgaaggacggccgggagatcgtggtgccctgccgcaaccaggacgagctggtcgggcgggcccgcgtgtcccagggcgcggggtggagcctgcgggagacggcctgcctcggcaagtcctacgcccagatgtggcagctgatgtacttccaccgccgggacctgcgcctcgccgcgaacgccatctgcagcgccgtgccggtcgactgggtgcccacctcccggaccacctggagcatccacgcccaccaccagtggatgacgaccgaggacatgctgtccgtgtggaaccgcgtctggatcgaggagaacccctggatggaggacaagacccacatcagctcctggggcgacgtgccctacctgggcaagcgggaggaccagtggtgcggcagcctcatcgggctgaccgcccgcgcgacgtgggccaccaacatccaggtggccatcaaccaggtccgccggctgctcggcaacgagaactacctggactacatgacctccatgaagcgcttcaagaacgagagcgacccggagggggccctgtggtga

SEQ ID NO: 8520 - RNA, 9879 nt, synthetic construct
  misc_feature 1..9879: note = derived and/or modified CDS sequence (opt1) from DENV-1__FJ882549__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgaggtggagcccgacgacgtggactgctggtgcaacaccaccgacacctgggtgacctacgggacctgcagccagacgggcgagcaccggcgcgacaagcggagcgtggccctcgcgccccacgtcggcctggggctggagacccgcgccgagacctggatgagctccgagggcgcgtggaagcagatccagaaggtggagacctgggccctccggcaccccgggttcacggtgatcgccctgttcctggcccacgcgatcggcaccagcatcacccagaaggggatcatcttcatcctcctgatgctggtcaccccctccatggccatgcgctgcgtgggcatcggcagccgggacttcgtggaggggctctccggcgccacgtgggtcgacgtggtgctggagcacgggagctgcgtcaccaccatggccaaggacaagcccaccctggacatcgagctcctgaagacggaggtgaccaaccccgccgtgctgcgcaagctctgcatcgaggcgaagatctccaacaccaccacggacagccggtgcccgacccagggcgaggccaccctggtcgaggagcaggacgccaacttcgtgtgccgccggaccttcgtggaccgcggctgggggaacggctgcgggctgttcggcaaggggtccctcatcacgtgcgccaagttcaagtgcgtcaccaagctggagggcaagatcgtgcagtacgagaacctgaagtacagcgtgatcgtcaccgtgcacaccggcgaccagcaccaggtcgggaacgagtccacggagcacggcaccaccgccaccatcacgccccaggcgcccacgagcgagatccagctcaccgactacggggccctgaccctggactgcagcccccggaccggcctcgacttcaacgagatggtgctgctgacgatgaaggagaagtcctggctcgtgcacaagcagtggttcctggacctgcccctcccctggaccagcggggcctccaccagccaggagacctggaaccgccaggacctgctggtcacgttcaagaccgcccacgccaagaagcaggaggtggtggtcctcggctcccaggagggcgcgatgcacaccgccctgaccggggccacggagatccagaccagcggcaccaccacgatcttcgccgggcacctgaagtgccggctcaagatggacaagctgaccctgaagggcatgtcctacgtgatgtgcaccgggagcttcaagctcgagaaggaggtggccgagacccagcacggcacggtcctggtgcagatcaagtacgagggcaccgacgcgccctgcaagatccccttctccacccaggacgagaagggggtgacccagaacggccgcctgatcacggccaacccgatcgtcaccgacaaggagaagcccgtgaacatcgaggccgagccgcccttcggggagagctacatcgtgatcggcgccggcgagaaggcgctgaagctctcctggttcaagaaggggagctccatcggcaagatgttcgaggccaccgcccgcggggcccgccggatggccatcctgggcgacaccgcgtgggacttcgggagcatcggcggcgtcttcacgtccgtggggaagctggtgcaccagatcttcggcaccgcctacggggtcctcttcagcggcgtgtcctggaccatgaagatcgggatcggcgtgctgctgacctggctcggcctgaacagccgctccacgagcctgtccatgacctgcatcgccgtcgggctcgtgaccctgtacctgggcgtgatggtccaggccgacagcgggtgcgtgatcaactggaagggccgcgagctcaagtgcgggagcggcatcttcgtgaccaacgaggtccacacgtggaccgagcagtacaagttccaggccgactccccgaagcggctgagcgcggccatcggcaaggcctgggaggagggggtgtgcggcatccgctccgccacccggctggagaacatcatgtggcgccagatcagcaacgagctcaaccacatcctgctggagaacgacatgaagttcaccgtggtcgtgggggacgtggtcggcatcctcgcccaggggaagaagatgatccggccccagcccatggagcacaagtactcctggaagtcctggggcaaggcgaagatcatcggcgccgacgtgcagaacaccacgttcatcatcgacgggcccaacaccccggagtgccccgacgaccagcgcgcctggaacatctgggaggtggaggactacggcttcgggatcttcaccaccaacatctggctgaagctgcgggactcctacacgcaggtctgcgaccaccgcctcatgagcgccgcgatcaaggactccaaggccgtgcacgccgacatgggctactggatcgagagcgagaagaacgagacctggaagctggcccgggcctccttcatcgaggtgaagacctgcatctggcccaagagccacaccctgtggtccaacggcgtcctcgagagcgagatgatcatccccaagatctacgggggcccgatctcccagcacaactaccgccccgggtacttcacgcagaccgcgggcccctggcacctggggaagctggagctcgacttcgacctgtgcgagggcaccaccgtggtggtcgacgagcactgcggcaaccgggggccgagcctgcgcacgaccaccgtgaccggcaagatcatccacgagtggtgctgccggtcctgcacgctgccgcccctccgcttcaagggggaggacggctgctggtacgggatggagatccggcccgtgaaggagaaggaggagaacctggtcaagagcatggtgagcgccggctccggcgaggtggacagcttctccctcgggctgctgtgcatcagcatcatgatcgaggaggtcatgcgctcccggtggagccgcaagatgctcatgaccggcaccctggccgtgttcttcctgctcatcatggggcagctgacctggaacgacctgatccggtcctgcatcatggtgggcgccaacgccagcgaccgcatggggatgggcacgacctacctcgcgctgatggccaccttcaagatgcgcccgatgttcgccgtcgggctgctgttccggcgcctgacctcccgggaggtgctgctcctgacgatcgggctgagcctcgtcgcctccgtggagctgcccaacagcctggaggagctcggcgacgggctggccatgggcatcatgatcctgaagctcctgaccgacttccagtcctaccagctgtgggcgaccctcctgagcctgaccttcatcaagacgaccttctccctccactacgcctggaagaccatggccatggtgctgagcatcgtctccctgctccccctgtgcctgagcaccacgtcccagaagaccacctggctccccgtgctgctgggcagcctcgggtgcaagccgctgaccatgttcctgatcgccgagaacaagatctggggccgcaagagctggcccctcaacgaggggatcatggcggtgggcatcgtctccatcctgctgagctccctcctgaagaacgacgtgcccctggccgggcccctcatcgccggcggcatgctgatcgcctgctacgtgatcagcgggtccagcgccgacctgtccctcgagaaggcggccgaggtcagctgggaggaggaggccgagcactccggcgccagccacaacatcctggtggaggtgcaggacgacgggacgatgaagatcaaggacgaggagcgggacgacaccctgaccatcctcctgaaggccaccctgctcgcggtctccggcgtgtacccgctgagcatccccgccaccctgttcgtgtggtacttctggcagaagaagaagcagcgctccggggtcctctgggacacgcccagcccgcccgaggtggagcgggccgtgctggacgacggcatctaccgcatcatgcagcggggcctgctggggcgctcccaggtcggcgtgggggtgttccaggagaacgtcttccacaccatgtggcacgtgacccggggcgccgtgctcatgtaccaggggaagcgcctggagcccagctgggcctccgtcaagaaggacctgatcagctacggcggcgggtggcggctccagggctcctggaacaccggggaggaggtccaggtgatcgcggtcgagcccggcaagaaccccaagaacgtgcagacggcccccgggaccttcaagacccccgagggcgaggtgggcgccatcgccctggacttcaagcccgggaccagcggcagccccatcgtcaaccgcgaggggaagatcgtgggcctgtacggcaacggggtggtcacgacctccggcacctacgtgagcgccatcgcgcaggccaaggcctcccaggaggggccgctccccgagatcgaggacgaggtgttccggaagcgcaacctgaccatcatggacctgcaccccggcagcgggaagacgcggcgctacctcccggccatcgtccgggaggcgatcaagcgcaagctgcggaccctgatcctcgcccccacccgcgtggtggcctccgagatggccgaggccctgaagggcatgcccatccgctaccagaccacggcggtcaagagcgagcacaccggccgggagatcgtggacctgatgtgccacgccaccttcaccatgcgcctcctgtcccccgtgcgggtcccgaactacaacatgatcatcatggacgaggcccacttcacggaccccagctccatcgccgcccgcgggtacatcagcacccgggtgggcatgggggaggcggccgccatcttcatgaccgccacgccgcccggctccgtggaggccttcccgcagagcaacgcggtcatccaggacgaggagcgcgacatccccgagcggtcctggaacagcgggtacgagtggatcacggacttccccggcaagaccgtgtggttcgtgccctccatcaagagcggcaacgacatcgccaactgcctgcgcaagaacgggaagcgggtcatccagctctcccgcaagaccttcgacaccgagtaccagaagacgaagaacaacgactgggactacgtggtgaccaccgacatcagcgagatgggcgccaacttccgggccgaccgcgtcatcgacccgcggcgctgcctgaagcccgtgatcctgaaggacgggcccgagcgggtcatcctcgcgggccccatgccggtgaccgtggcctccgccgcccagcgccgggggcgcatcggccggaaccacaacaaggagggcgaccagtacatctacatggggcagcccctgaacaacgacgaggaccacgcccactggacggaggcgaagatgctgctcgacaacatcaacacccccgagggcatcatccccgccctgttcgagccggagcgcgagaagtccgccgccatcgacggggagtaccgcctgcggggcgaggcccgcaagaccttcgtcgagctcatgcggcgcggggacctgcccgtgtggctgagctacaaggtggcgtccgagggcttccagtacagcgaccggcgctggtgcttcgacggcgagcggaacaaccaggtcctcgaggagaacatggacgtggagatctggaccaaggagggggagcgcaagaagctgcggccccgctggctggacgcccggacgtactccgaccccctcgccctgcgcgagttcaaggagttcgccgccggccggcgcagcgtgtccggggacctgatcctcgagatcggcaagctgccgcagcacctgacccagcgggcgcagaacgccctcgacaacctggtcatgctgcacaacagcgagcagggcgggcgcgcctaccggcacgccatggaggagctccccgacaccatcgagaccctgatgctgctcgcgctgatcgccgtgctgacgggcggggtgaccctcttcttcctgtccggcaaggggctgggcaagaccagcatcggcctcctgtgcgtcatggcctccagcgccctgctctggatggcctccgtggagccccactggatcgcggccagcatcatcctggagttcttcctgatggtgctcctgatccccgagccggaccgccagcggacgccccaggacaaccagctggcctacgtcgtgatcgggctcctgttcatgatcctgaccgtggccgccaacgagatgggcctcctggagacgaccaagaaggacctggggatcggccacgtcgcggtggagaaccaccaccacgccaccatgctcgacgtggacctgcaccccgcctccgcctggaccctgtacgccgtcgcgacgaccatcatcaccccgatgatgcgccacaccatcgagaacacgaccgccaacatcagcctcaccgccatcgccaaccaggccgcgatcctgatggggctggacaagggctggcccatctccaagatggacatcggcgtgcccctcctggccctggggtgctacagccaggtgaaccccctcaccctgacggccgccgtcctgatgctcgtggcgcactacgccatcatcggcccggggctgcaggccaaggccacccgggaggcccagaagcgcaccgcggccggcatcatgaagaaccccaccgtggacgggatcgtcgccatcgacctggaccccgtggtgtacgacgccaagttcgagaagcagctcggccagatcatgctgctgatcctctgcacgtcccagatcctgctgatgcgcaccacctgggccctctgcgagagcatcaccctggcgacgggccccctgaccaccctctgggaggggtccccgggcaagttctggaacaccacgatcgccgtcagcatggccaacatcttccgggggagctacctggccggcgccggcctggcgttctccctcatgaagtccctcgggggcgggcgccgggggaccggggcccagggcgagaccctgggcgagaagtggaagcgccagctcaaccagctgtccaagagcgagttcaacacctacaagcggtccgggatcatggaggtggaccgcagcgaggccaaggagggcctgcggcgcggggagacgaccaagcacgccgtgtcccggggcaccgcgaagctccgctggttcgtcgagcggaacctggtgaagcccgaggggaaggtgatcgacctgggctgcggccgcgggggctggagctactactgcgccgggctgaagaaggtcaccgaggtgaagggctacacgaagggcgggcccggccacgaggagcccatcccgatggccacctacgggtggaacctcgtgaagctgcactccggcaaggacgtcttcttcatcccgcccgagaagtgcgacaccctgctctgcgacatcggggagagctcccccaacccgaccatcgaggagggccggacgctgcgcgtgctgaagatggtggagccctggctccgggggaaccagttctgcatcaagatcctgaacccctacatgcccagcgtcgtggagaccctggagcagatgcagcgcaagcacggcggcatgctcgtgcggaacccgctgtcccgcaacagcacccacgagatgtactgggtctcctgcgggaccggcaacatcgtgagcgccgtgaacatgacctcccggatgctgctcaaccgcttcacgatggcccaccgcaagcccacctacgagcgggacgtcgacctgggggcgggcacccgccacgtggccgtggagcccgaggtcgccaacctggacatcatcggccagcggatcgagaacatcaagcacgagcacaagagcacctggcactacgacgaggacaacccctacaagacgtgggcctaccacgggtcctacgaggtgaagccgagcggcagcgcctccagcatggtcaacggggtggtgaagctcctgaccaagccctgggacgtcatccccatggtgacccagatcgcgatgaccgacacgacccccttcggccagcagcgcgtgctgaaggagaaggtcgacacccggaccccgaaggccaagcgcgggacggcccagatcatggaggtgaccgccaagtggctctggggcttcctgtcccggaacaagaagccccgcatctgcacccgggaggagttcacccgcaaggtgcggagcaacgccgcgatcggcgccgtcttcgtggacgagaaccagtggaactccgccaaggaggccgtggaggacgagcgcttctgggacctggtccaccgggagcgcgagctccacaagcaggggaagtgcgcgacgtgcgtgtacaacatgatgggcaagcgggagaagaagctgggggagttcggcaaggccaaggggagccgcgccatctggtacatgtggctgggcgcccggttcctcgagttcgaggccctgggcttcatgaacgaggaccactggttctcccgcgagaacagcctgtccggggtggagggcgaggggctccacaagctgggctacatcctgcgggacatcagcaagatccccgggggcaacatgtacgcggacgacaccgccggctgggacacccgcatcaccgaggacgacctccagaacgaggccaagatcacggacatcatggagccggagcacgccctgctggccacctccatcttcaagctcacctaccagaacaaggtcgtgcgggtgcagcgccccgcgcgcaacgggaccgtcatggacgtgatcagccggcgcgaccagcggggctccggccaggtgggcacgtacggcctgaacaccttcaccaacatggaggcccagctgatccgccagatggagagcgaggggatcttctcccccagcgagctcgagacccccaacctggccgagcgggtcctggactggctcgagaagcacggcgtggagcgcctgaagcggatggccatctccggggacgactgcgtggtcaagccgatcgacgaccgcttcgccacggcgctgagcgccctcaacgacatgggcaaggtgcggaaggacatcccccagtgggagcccagcaaggggtggaacgactggcagcaggtccccttctgctcccaccacttccaccagctgatcatgaaggacggccgcgagatcgtcgtgccgtgccggaaccaggacgagctggtgggccgcgcccgggtcagccagggggccggctggtccctccgcgagaccgcctgcctgggcaagagctacgcgcagatgtggcagctgatgtacttccaccggcgcgacctccggctggccgccaacgccatctgctccgcggtgcccgtggactgggtccccaccagccgcaccacgtggtccatccacgcccaccaccagtggatgaccaccgaggacatgctgagcgtgtggaaccgggtgtggatcgaggagaacccctggatggaggacaagacccacatctccagctggggcgacgtcccgtacctcgggaagcgcgaggaccagtggtgcggctccctgatcggcctgacggcccgcgccacctgggccaccaacatccaggtggcgatcaaccaggtgcggcgcctcatcgggaacgagaactacctggactacatgaccagcatgaagcggttcaagaacgagtccgaccccgagggcgccctgtggtga

SEQ ID NO: 8521 - RNA, 9879 nt, synthetic construct
  misc_feature 1..9879: note = derived and/or modified CDS sequence (opt1) from DENV-1__GQ199814__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagaccagcgcgggggtgaacatgtgcaccctcatcgccatggacctgggcgagttctgcgaggacacgatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggaccagcggggcctccaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctcgtccagatcaagtacgagggcaccgacgccccctgcaagatccccttctccacccaggacgagaagggggtgacccagaacggccggctgatcacggccaacccgatcgtgaccgacaaggacaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacaccgcctgggacttcgggagcatcggcggcgtgttcacgtccgtcgggaagctggtgcaccagatcttcggcaccgcctacggggtgctgttcagcggcgtctcctggaccatgaagatcgggatcggcgtgctcctgacctggctgggcctcaacagccgctccacgagcctgtccatgacctgcatcgccgtggggctggtcaccctctacctgggcgtgatggtgcaggccgacagcgggtgcgtcatcaactggaagggccgggagctgaagtgcgggagcggcatcttcgtgaccaacgaggtgcacacgtggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagttcaccgtggtggtcggggacgtggcgggcatcctggcccaggggaagaagatgatccggccccagcccatggagtacaagtactcctggaagtcctggggcaaggccaagatcatcggcgccgacgtgcagaacaccacgttcatcatcgacgggcccaacaccccggagtgccccgacgaccagcgcgcgtggaacatctgggaggtcgaggactacggcttcgggatcttcaccaccaacatctggctcaagctgcgggactcctacacccaggtgtgcgaccaccgcctgatgagcgccgccatcaaggactccaaggccgtgcacgccgacatgggctactggatcgagagcgagaagaacgagacctggaagctcgcgcgggcctccttcatcgaggtcaagacctgcatctggcccaagagccacaccctgtggtccaacggcgtgctggagagcgagatgatcatccccaagatctacgggggcccgatctcccagcacaactaccgccccgggtacttcacgcagaccgccggcccctggcacctcgggaagctggagctggacttcgacctctgcgagggcaccaccgtggtcgtggacgagcactgcggcaaccgggggccgagcctgcgcacgaccaccgtgaccggcaagatcatccacgagtggtgctgccggtcctgcacgctgccgcccctgcgcttcaagggggaggacggctgctggtacgggatggagatccggcccgtcaaggagaaggaggagaacctggtcaagagcatggtgagcgccggctccggcgaggtcgacagcttctccctggggctcctgtgcatcagcatcatgaccgaggaggtgatgcgctcccggtggagccgcaagatgctgatgaccggcaccctcgccgtgttcttcctgctgatcatggggcagctcacgtggaacgacctgatccggctgtgcatcatggtcggcgcgaacgcctccgaccgcatggggatgggcaccacctacctcgccctgatggccaccttcaagatgcgcccgatgttcgccgtggggctcctgttccggcgcctgacgagccgggaggtgctgctcctgaccatcgggctgtccctcgtcgcgagcgtggagctgcccaactccctggaggagctcggcgacgggctggccatgggcatcatgatcctgaagctcctgaccgacttccagagccaccagctgtgggccaccctcctgtccctgacgttcatcaagaccaccttcagcctccactacgcctggaagaccatggcgatggtcctgtccatcgtgagcctgttccccctctgcctgtccacgaccagccagaagaccacctggctgcccgtgctcctgggctccctggggtgcaagccgctcacgatgttcctgatcgccgagaacaagatctggggccgcaagagctggcccctgaacgaggggatcatggccgtcggcatcgtgagcatcctcctgtccagcctgctcaagaacgacgtgcccctggccgggcccctgatcgccggcggcatgctcatcgcgtgctacgtcatctccgggagctccgccgacctgagcctggagaaggccgccgaggtgtcctgggaggaggaggccgagcacagcggcgcgtcccacaacatcctcgtggaggtccaggacgacgggaccatgaagatcaaggacgaggagcgggacgacaccctgaccatcctgctcaaggccaccctgctggccgtgagcggcgtgtacccgctctccatccccgccacgctgttcgtctggtacttctggcagaagaagaagcagcgcagcggggtgctgtgggacacccccagcccgcccgaggtggagcgggccgtcctcgacgacggcatctaccgcatcatgcagcggggcctgctggggcgcagccaggtgggcgtgggggtcttccaggagaacgtgttccacaccatgtggcacgtgacccggggcgcggtcctgatgtaccaggggaagcgcctcgagccctcctgggccagcgtgaagaaggacctgatctcctacggcggcgggtggcggctgcagggcagctggaacacgggggaggaggtgcaggtcatcgccgtggagcccggcaagaaccccaagaacgtgcagaccgcccccgggaccttcaagacctccgagggcgaggtcggcgccatcgcgctcgacttcaagcccgggacgagcggcagccccatcgtgaaccgcgaggggaagatcgtgggcctgtacggcaacggggtcgtgaccacctccggcacctacgtgagcgccatcgcccaggccaaggcgtcccaggaggggcccctgccggagatcgaggacgaggtcttccggaagcgcaacctcacgatcatggacctgcaccccggcagcgggaagacccggcgctacctgcccgccatcgtgcgggaggccatcaagcgcaagctccggaccctgatcctggccccgacccgcgtggtcgcctccgagatggcggaggccctcaagggcatgcccatccgctaccagacgaccgccgtcaagagcgagcacaccggcaaggagatcgtggacctgatgtgccacgccaccttcacgatgcggctgctctcccccgtccgcgtgcccaactacaacatgatcatcatggacgaggcccacttcaccgacccgagctccatcgcggcccgggggtacatcagcacccgcgtgggcatgggggaggccgccgccatcttcatgaccgcgacgccgcccggctccgtcgaggccttcccccagagcaacgccgtgatccaggacgaggagcgggacatcccggagcgctcctggaacagcgggtacgagtggatcaccgacttccccggcaagaccgtgtggttcgtcccctccatcaagagcggcaacgacatcgccaactgcctgcggaagaacgggaagcgcgtgatccagctgtcccggaagaccttcgacacggagtaccagaagaccaagaacaacgactgggactacgtggtcaccaccgacatcagcgagatgggcgcgaacttccgcgccgaccgggtgatcgacccccgccggtgcctcaagccggtgatcctgaaggacgggcccgagcgcgtcatcctggccggccccatgcccgtgacggtcgcctccgccgcgcagcggcgcgggcggatcggccgcaaccacaacaaggagggcgaccagtacgtgtacatggggcagccgctcaacaacgacgaggaccacgcccactggaccgaggccaagatgctgctggacaacatcaacacccccgagggcatcatccccgccctcttcgagcccgagcgggagaagtccgccgcgatcgacggggagtaccgcctgcgcggcgaggcccggaagaccttcgtggagctgatgcgccgcggggacctcccggtctggctgagctacaaggtggcctccgagggcttccagtacagcgaccgccggtggtgcttcgacggcgagcgcaacaaccaggtgctggaggagaacatggacgtcgagatctggacgaaggagggggagcggaagaagctccgcccccggtggctggacgcccgcacctactccgaccccctggccctccgggagttcaaggagttcgcggccggccgccggagcgtgtccggggacctgatcctggagatcggcaagctcccccagcacctgacccagcgcgcccagaacgccctggacaacctcgtgatgctgcacaacagcgagcagggcgggcgggcgtaccgccacgccatggaggagctgccggacaccatcgagacgctcatgctgctggccctcatcgccgtcctgaccggcggggtgaccctgttcttcctctccggccgggggctgggcaagaccagcatcggcctgctctgcgtgatggcctccagcgtcctgctgtggatggcgtccgtggagccccactggatcgccgccagcatcatcctcgagttcttcctgatggtgctgctcatccccgagcccgaccgccagcggaccccgcaggacaaccagctggcctacgtcgtgatcgggctcctcttcatgatcctgacggtggccgcgaacgagatgggcctgctcgagaccaccaagaaggacctggggatcggccacgtcgccgtggagaaccaccaccacgccgccatgctggacgtggacctccaccccgcctccgcgtggaccctgtacgccgtcgccacgaccatcatcacccccatgatgcgccacaccatcgagaacacgaccgccaacatcagcctgaccgccatcgcgaaccaggccgccatcctcatggggctggacaagggctggccgatctccaagatggacatcggcgtgcccctgctcgccctggggtgctacagccaggtgaaccccctgaccctcacggcggccgtcctgatgctggtggcccactacgccatcatcggccccgggctccaggccaaggcgacccgggaggcccagaagcgcaccgccgccggcatcatgaagaacccgaccgtggacgggatcgtcgccatcgacctggaccccgtggtgtacgacgcgaagttcgagaagcagctgggccagatcatgctcctgatcctgtgcacgtcccagatcctcctgatgcgcaccacctgggccctgtgcgagagcatcaccctcgccacgggccccctgaccaccctgtgggaggggtcccccggcaagttctggaacaccacgatcgccgtcagcatggccaacatcttccgggggagctacctcgcgggcgccggcctggccttctccctgatgaagtccctcgggggcgggcgccggggcaccggggcccagggcgagaccctgggcgagaagtggaagcgccagctgaaccagctctccaagagcgagttcaacacctacaagcggtccgggatcatggaggtggaccgcagcgaggcgaaggagggcctgaagcgcggggagacgaccaagcacgccgtgtcccgcggcaccgccaagctgcggtggttcgtcgagcgcaacctcgtgaagccggaggggaaggtgatcgacctgggctgcggccgcggcgggtggagctactactgcgccgggctgaagaaggtcaccgaggtgaaggggtacacgaagggcgggcccggccacgaggagcccatccccatggccacctacgggtggaacctggtgaagctccactccggcaaggacgtcttcttcatcccgcccgagaagtgcgacaccctgctgtgcgacatcggggagagctcccccaaccccaccatcgaggagggccgcacgctccgggtgctgaagatggtggagccgtggctgcgcgggaaccagttctgcatcaagatcctcaacccctacatgcccagcgtcgtggagaccctggagcagatgcagcggaagcacggcggcatgctggtgcgcaaccccctctcccggaacagcacccacgagatgtactgggtctcctgcgggaccggcaacatcgtgagcgcggtgaacatgacctcccgcatgctgctgaaccggttcacgatggcccaccgcaagccgacctacgagcgcgacgtcgacctcggggccggcacccggcacgtggccgtggagcccgaggtcgccaacctggacatcatcggccagcgcatcgagaacatcaagcacgagcacaagagcacctggcactacgacgaggacaacccctacaagacgtgggcgtaccacgggtcctacgaggtgaagcccagcggcagcgcctccagcatggtcaacggggtggtgaagctgctcaccaagccgtgggacgtcatccccatggtgacccagatcgccatgaccgacacgacccccttcggccagcagcgggtgttcaaggagaaggtcgacacccgcacccccaaggccaagcgggggacggcccagatcatggaggtgaccgcgaagtggctgtggggcttcctgtcccgcaacaagaagccgcggatctgcacccgcgaggagttcacccggaaggtgcgcagcaacgccgccatcggcgccgtcttcgtggacgagaaccagtggaactccgcgaaggaggccgtggaggacgagcggttctgggacctcgtccaccgcgagcgggagctgcacaagcaggggaagtgcgccacgtgcgtgtacaacatgatgggcaagcgcgagaagaagctgggggagttcggcaaggccaaggggagccgggccatctggtacatgtggctcggcgcgcgcttcctggagttcgaggccctgggcttcatgaacgaggaccactggttctcccgggagaacagcctctccggggtggagggcgaggggctgcacaagctgggctacatcctccgcgacatcagcaagatccccgggggcaacatgtacgccgacgacaccgccggctgggacacccggatcaccgaggacgacctgcagaacgaggccaagatcacggacatcatggagcccgagcacgcgctgctcgccaagtccatcttcaagctgacctaccagaacaaggtcgtgcgcgtgcagcggccggccaagaacgggaccgtcatggacgtgatcagccgccgcgaccagcggggctccggccaggtgggcacctacggcctgaacacgttcaccaacatggaggcccagctcatccgccagatggagagcgaggggatcttctcccccagcgagctggagacccccaacctggccggccgggtcctcgactggctggagaagcacggggtggagcgcctgaagcggatggcgatctccggcgacgactgcgtggtcaagcccatcgacgaccgcttcgccaccgccctcacggccctgaacgacatggggaaggtgcggaaggacatcccgcagtgggagcccagcaagggctggaacgactggcagcaggtccccttctgcagccaccacttccaccagctgatcatgaaggacggccgcgagatcgtcgtgccctgccggaaccaggacgagctcgtggggcgcgcccgggtctcccagggcgcggggtggagcctgcgcgagaccgcctgcctgggcaagtcctacgcccagatgtggcagctcatgtacttccaccggcgcgacctgcggctggccgcgaacgccatctgcagcgccgtgccggtggactgggtccccacctcccgcaccacgtggagcatccacgcccaccaccagtggatgaccaccgaggacatgctctccgtgtggaaccgggtgtggatcgaggagaacccctggatggaggacaagacccacatcagctcctggggcgacgtcccctacctgggcaagcgcgaggaccagtggtgcggcagcctgatcgggctcacggcccgggcgacctgggccaccaacatccaggtggccatcaaccaggtgcgccgcctgatcggcaacgagaactacctggactacatgacctccatgaagcggttcaagaacgagagcgacccggagggggccctctggtga

SEQ ID NO: 8522 - RNA, 9879 nt, synthetic construct
  misc_feature 1..9879: note = derived and/or modified CDS sequence (opt1) from DENV-1__GQ199816__SS-prME
  source 1..9879: mol_type = other RNA
agcgtgaccatgctgctcatgctgatgcccaccgccctggccttccacctcaccacccggggcggggagccccacatgatcgtgtccaagcaggagcggggcaagagcctgctgttcaagacctccgcgggggtgaacatgtgcaccctcatcgccatggacctgggggagttctgcgaggacacgatgacctacaagtgcccccgcatcaccgaggccgagcccgacgacgtggactgctggtgcaacgccaccgacacgtgggtcacctacgggacctgcagccagaccggggagcaccggcgcgacaagcggtccgtggccctggcgccccacgtgggcctcgggctggagacgcgcaccgagacctggatgagctccgagggcgcctggaagcagatccagaaggtcgagacctgggccctgcggcaccccgggttcacggtgatcgccctcttcctggcgcacgccatcggcaccagcatcacccagaaggggatcatcttcatcctgctcatgctggtgaccccctccatggccatgcgctgcgtcggcatcggcagccgggacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcgcaagctgtgcatcgaggccaagatctccaacaccaccacggacagccggtgcccgacccagggcgaggccaccctcgtggaggagcaggacgccaacttcgtctgccgccggaccttcgtggaccgcggctgggggaacggctgcgggctgttcggcaaggggtccctgatcacgtgcgccaagttcaagtgcgtgaccaagctcgagggcaagaccgtccagtacgagaacctgaagtacagcgtgatcgtgaccgtccacacgggcgaccagcaccaggtggggaacgagtccaccgagcacggcaccaccgcgaccatcacgccccaggcccccagcaccgagatccagctgaccgactacggggccctcaccctggactgcagcccccggacgggcctggacttcaacgagatggtcctcctgaccatgaaggagaaggcctggctggtgcacaagcagtggttcctcgacctgccgctgccctggaccagcggggccagcacctcccaggagacgtggaaccgcaaggacctcctggtgaccttcaagaccgcgcacgccaagaagcaggaggtcgtggtgctgggcagccaggagggcgccatgcacaccgccctcacgggggccaccgagatccagacctccggcaccacgaccatcttcgcggggcacctgaagtgccggctgaagatggacaagctcaccctgaagggcatgagctacgtcatgtgcaccgggtccttcaagctggagaaggaggtggccgagacgcagcacggcaccgtgctcgtccagatcaagtacgagggcaccgacgccccctgcaagatccccttcagcacccaggacgagaagggggtgacgcagaacggccgcctgatcaccgccaacccgatcgtgaccgacaaggagaagcccgtcaacatcgaggcggagccgcccttcggggagtcctacatcgtgatcggcgccggcgagaaggccctgaagctgagctggttcaagaaggggtccagcatcggcaagatgttcgaggccaccgcccgcggggcgcgccggatggccatcctcggcgacacggcctgggacttcgggtccatcggcggcgtgttcaccagcgtcgggaagctggtgcaccagatcttcggcaccgcctacggggtgctgttctccggcgtcagctggaccatgaagatcgggatcggcgtgctcctgacgtggctgggcctcaactcccgcagcacctccctgagcatgacctgcatcgccgtggggctggtcaccctctacctgggcgtgatggtgcaggcggactccgggtgcgtcatcaactggaagggccgcgagctgaagtgcgggagcggcatcttcgtgacgaacgaggtgcacacctggaccgagcagtacaagttccaggccgacagcccgaagcggctctccgccgccatcggcaaggcctgggaggagggggtctgcggcatccgcagcgcgacccggctggagaacatcatgtggaagcagatctccaacgagctgaaccacatcctcctggagaacgacatgaagttcaccgtggtggtcggggacgtggccggcatcctggcccaggggaagaagatgatccgcccccagcccatggagtacaagtacagctggaagtcctggggcaaggccaagatcatcggcgcggacgtgcagaacgccacgttcatcatcgacgggcccaacaccccggagtgccccgacgaccagcgggcctggaacatctgggaggtcgaggactacggcttcgggatcttcaccaccaacatctggctcaagctgcgcgacagctacacccaggtgtgcgaccaccggctgatgtccgccgccatcaaggacagcaaggcggtgcacgccgacatgggctactggatcgagtccgagaagaacgagacgtggaagctcgcccgcgccagcttcatcgaggtcaagacctgcatctggcccaagtcccacaccctgtggagcaacggcgtgctggagtccgagatgatcatccccaagatctacgggggcccgatcagccagcacaactaccggcccgggtacttcacgcagaccgccggcccctggcacctcgggaagctggagctggacttcgacctctgcgagggcaccaccgtggtcgtggacgagcactgcggcaaccgcgggccgtccctgcggacgaccaccgtgaccggcaagatcatccacgagtggtgctgccgcagctgcacgctgccgcccctgcggttcaagggggaggacggctgctggtacgggatggagatccgccccgtcaaggagaaggaggagaacctggtgaagtccatggtgagcgcgggcagcggcgaggtcgactccttcagcctggggctcctgtgcatctccatcatgatcgaggaggtgatgcggagccgctggtcccggaagatgctgatgaccggcatcctcgccgtgttcttcctgctgatcatggggcagctcacctggaacgacctgatccgcctgtgcatcatggtcggcgccaacgccagcgaccggatggggatgggcaccacgtacctcgccctgatggcgaccttcaagatgcgcccgatgttcgccgtgggcctcctgttccgccggctgacctcccgcgaggtgctgctcctgaccatcgggctgagcctcgtcgcctccgtggagctgcccaacagcctggaggagctcggcgacgggctggccatgggcatcatgatcctgaagctcctgacggacttccagtcccaccagctgtgggcgaccctcctgagcctgaccttcatcaagaccacgttctccctccactacgcctggaagaccatggccatggtcctgagcatcgtgtccctgttccccctctgcctgagcaccacctcccagaagacgacctggctgcccgtgctcctgggcagcctggggtgcaagccgctcaccatgttcctgatcgccgagaacaagatctggggccggaagtcctggcccctgaacgaggggatcatggccgtcggcatcgtgagcatcctcctgagctccctgctcaagaacgacgtgcccctggcggggcccctgatcgccggcggcatgctcatcgcctgctacgtcatcagcgggtccagcgccgacctgtccctggagaaggccgcggaggtgagctgggaggaggaggccgagcactccggcgccagccacaacatcctcgtggaggtccaggacgacgggaccatgaagatcaaggacgaggagcgcgacgacacgctgaccatcctgctcaaggccaccctgctggccgtgtccggcgtgtacccgctcagcatccccgcgaccctgttcgtctggtacttctggcagaagaagaagcagcggtccggggtgctgtgggacaccccctccccgcccgaggtggagcgcgccgtcctcgacgacggcatctaccggatcatgcagcgcggcctgctggggcggtcccaggtgggcgtgggggtcttccaggagaacgtgttccacacgatgtggcacgtgacccgcggcgccgtcctgatgtaccaggggaagcggctcgagcccagctgggcctccgtgaagaaggacctgatcagctacggcggcgggtggcgcctgcagggctcctggaacaccggggaggaggtgcaggtcatcgccgtggagcccggcaagaaccccaagaacgtgcagaccgcgcccgggacgttcaagaccagcgagggcgaggtcggcgccatcgccctcgacttcaagcccgggacctccggcagccccatcgtgaaccgggaggggaagatcgtgggcctgtacggcaacggggtcgtgaccacgagcggcacctacgtgtccgccatcgcgcaggccaaggccagccaggaggggcccctgccggagatcgaggacgaggtcttccgcaagcggaacctcaccatcatggacctgcaccccggctccgggaagacccgccggtacctgcccgccatcgtgcgcgaggccatcaagcggaagctccgcacgctgatcctggcgccgacccgggtggtcgccagcgagatggccgaggccctcaagggcatgcccatccgctaccagaccaccgccgtgaagtccgagcacacgggcaaggagatcgtggacctgatgtgccacgcgaccttcaccatgcgcctgctcagccccgtccgggtgcccaactacaacatgatcatcatggacgaggcccacttcaccgacccgtccagcatcgccgcccgcgggtacatctccacgcgggtgggcatgggggaggccgcggccatcttcatgaccgccacgccgcccggcagcgtcgaggccttcccccagtccaacgcggtgatccaggacgaggagcgcgacatcccggagcggagctggaactccgggtacgagtggatcaccgacttccccggcaagacggtgtggttcgtccccagcatcaagtccggcaacgacatcgccaactgcctgcgcaagaacgggaagcgggtgatccagctgagccgcaagaccttcgacaccgagtaccagaagaccaagaacaacgactgggactacgtggtcacgaccgacatctccgagatgggcgccaacttccgggccgaccgcgtgatcgacccccggcgctgcctcaagccggtgatcctgaaggacgggcccgagcgggtcatcctggccggccccatgcccgtgaccgtcgcgagcgccgcccagcgccgggggcgcatcggccggaaccacaacaaggagggcgaccagtacatctacatggggcagccgctcaacaacgacgaggaccacgcccactggaccgaggccaagatgctgctggacaacatcaacacgcccgagggcatcatccccgccctcttcgagcccgagcgcgagaagtccgccgccatcgacggggagtaccggctgcgcggcgaggcccgcaagaccttcgtggagctgatgcggcgcggggacctcccggtgtggctgagctacaaggtcgccagcgagggcttccagtactccgaccggcgctggtgcttcgacggcgagcggaacaaccaggtgctggaggagaacatggacgtggagatctggaccaaggagggggagcgcaagaagctccggccccgctggctggacgcgcggacctacagcgaccccctggccctccgcgagttcaaggagttcgccgccggccggcgctccgtcagcggggacctgatcctggagatcggcaagctcccccagcacctgacgcagcgggcgcagaacgccctggacaacctcgtgatgctgcacaactccgagcagggcgggcgcgcctaccggcacgccatggaggagctgccggacaccatcgagaccctcatgctgctggccctcatcgcggtgctgaccggcggggtcacgctgttcttcctcagcggccgcgggctgggcaagacctccatcggcctgctctgcgtgatggccagctccgtgctgctgtggatggccagcgtcgagccccactggatcgccgcctccatcatcctcgagttcttcctgatggtgctgctcatccccgagcccgaccggcagcgcaccccgcaggacaaccagctggcgtacgtggtcatcgggctcctcttcatgatcctgaccgtggccgccaacgagatgggcctgctcgagaccacgaagaaggacctggggatcggccacgtggccgtcgagaaccaccaccacgccgcgatgctggacgtggacctccaccccgccagcgcctggaccctgtacgccgtggccaccaccatcatcacgcccatgatgcggcacaccatcgagaacaccaccgcgaacatctccctgacggccatcgccaaccaggccgcgatcctcatggggctggacaagggctggccgatcagcaagatggacatcggcgtccccctgctcgccctggggtgctactcccaggtgaaccccctgaccctcaccgccgccgtgctgatgctggtcgcccactacgcgatcatcggccccgggctccaggccaaggccacccgcgaggcccagaagcggacggccgcgggcatcatgaagaacccgaccgtggacgggatcgtggccatcgacctggaccccgtcgtgtacgacaccaagttcgagaagcagctgggccagatcatgctcctgatcctgtgcaccagccagatcctcctgatgcgcacgacctgggccctgtgcgagtccatcaccctcgccaccggccccctgacgaccctgtgggaggggagccccggcaagttctggaacaccaccatcgccgtgtccatggcgaacatcttccgcgggagctacctcgccggcgccggcctggccttcagcctgatgaagtccctcgggggcgggcggcgcggcacgggggcgcagggcgagaccctgggcgagaagtggaagcggcagctgaaccagctcagcaagtccgagttcaacacctacaagcgcagcgggatcatggaggtcgaccggtccgaggccaaggagggcctgaagcgcggggagaccacgaagcacgccgtgagccggggcaccgccaagctgcgctggttcgtggagcggaacctcgtcaagccggaggggaaggtgatcgacctgggctgcggccgcgggggctggtcctactactgcgccgggctgaagaaggtgaccgaggtcaagggctacaccaagggcgggcccggccacgaggagcccatccccatggcgacgtacgggtggaacctggtgaagctccacagcggcaaggacgtgttcttcatcccgcccgagaagtgcgacaccctgctgtgcgacatcggggagtccagccccaaccccaccatcgaggagggccggaccctccgcgtcctgaagatggtggagccgtggctgcgggggaaccagttctgcatcaagatcctcaacccctacatgccctccgtggtcgagacgctggagcagatgcagcgcaagcacggcggcatgctggtgcggaaccccctcagccgcaactccacccacgagatgtactgggtgagctgcgggaccggcaacatcgtctccgccgtgaacatgaccagccggatgctgctgaaccgcttcaccatggcccaccggaagccgacgtacgagcgcgacgtggacctcggggccggcacccgccacgtcgccgtggagcccgaggtggcgaacctggacatcatcggccagcggatcgagaacatcaagcacgagcacaagtccacctggcactacgacgaggacaacccctacaagacctgggcctaccacgggagctacgaggtcaagccctccggcagcgccagctccatggtgaacggggtcgtgaagctgctcacgaagccgtgggacgtgatccccatggtcacccagatcgccatgaccgacaccacgcccttcggccagcagcgcgtgttcaaggagaaggtggacacccggacccccaaggccaagcgcgggaccgcgcagatcatggaggtcacggccaagtggctgtggggcttcctgagccggaacaagaagccgcgcatctgcacccgggaggagttcacccgcaaggtgcggtccaacgccgccatcggcgcggtgttcgtcgacgagaaccagtggaacagcgccaaggaggccgtggaggacgagcgcttctgggacctcgtgcaccgggagcgcgagctgcacaagcaggggaagtgcgcgacctgcgtctacaacatgatgggcaagcgggagaagaagctgggggagttcggcaaggccaaggggtcccgcgcgatctggtacatgtggctcggcgcccggttcctggagttcgaggccctgggcttcatgaacgaggaccactggttcagccgcgagaactccctcagcggggtggagggcgaggggctgcacaagctgggctacatcctccgggacatctccaagatccccgggggcaacatgtacgccgacgacacggccggctgggacacccgcatcaccgaggacgacctgcagaacgaggcgaagatcaccgacatcatggagcccgagcacgccctgctcgccaagagcatcttcaagctgacgtaccagaacaaggtggtccgggtgcagcgcccggccaagaacgggaccgtgatggacgtcatctcccggcgcgaccagcgcggcagcggccaggtgggcacctacggcctgaacaccttcacgaacatggaggcccagctcatccggcagatggagtccgaggggatcttcagcccctccgagctggagacccccaacctggcgggccgcgtgctcgactggctggagaagcacggggtcgagcggctgaagcgcatggccatcagcggcgacgactgcgtggtgaagcccatcgacgaccggttcgccaccgccctcaccgccctgaacgacatggggaaggtccgcaaggacatcccgcagtgggagccctccaagggctggaacgactggcagcaggtccccttctgcagccaccacttccaccagctgatcatgaaggacggccgggagatcgtggtcccctgccgcaaccaggacgagctcgtggggcgggcgcgcgtgagccagggcgccgggtggtccctgcgggagacggcctgcctgggcaagagctacgcccagatgtggcagctcatgtacttccaccgccgggacctgcgcctggcggccaacgccatctgctccgccgtcccggtggactgggtgcccaccagccggaccacctggtccatccacgcccaccaccagtggatgacgaccgaggacatgctcagcgtctggaaccgcgtgtggatcgaggagaacccctggatggaggacaagacccacatctccagctggggcgacgtgccctacctgggcaagcgggaggaccagtggtgcggctccctgatcgggctcaccgcgcgcgccacgtgggccaccaacatccaggtcgccatcaaccaggtgcggcgcctgatcggcaacgagaactacctggactacatgaccagcatgaagcgcttcaagaacgagatcgacccggagggggccctctggtga

SEQ ID NO: 8523 - RNA, 9879 nt, synthetic construct
  misc_feature 1..9879: note = derived and/or modified CDS sequence (opt1) from DENV-1__GQ199817__SS-prME
  source 1..9879: mol_type = other RNA
agcgtgaccatgctgctgatgctgatgcccaccgccctggccttccacctcacgacccggggcggggagccccacatgatcgtgagcaagcaggagcggggcaagagcctgctgttcaagaccagcgccggggtgaacatgtgcaccctcatcgccatggacctgggcgagttctgcgaggacaccatgacctacaagtgcccccggatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggaccagcggggcctccaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctcgtccagatcaagtacgagggcaccgacgccccctgcaagatccccttctccacccaggacgagaagggggtgacccagaacggccggctgatcacggccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacaccgcctgggacttcgggagcatcggcggcgtgttcacgtccgtcgggaagctggtgcaccagatcttcggcaccgcctacggggtgctgttcagcggcgtctcctggaccatgaagatcgggatcggcgtgctcctgacctggctgggcctcaacagccgctccacgagcctgtccatgacctgcatcgccgtggggctggtcaccctctacctgggcgtgatggtgcaggccgacagcgggtgcgtcatcaactggaagggccgggagctgaagtgcgggagcggcatcttcgtgaccaacgaggtgcacacgtggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagctgaccgtggtggtcggggacgtggcgggcatcctcgcccaggggaagaagatgatccggccccagcccatggagtacaagtactcctggaagtcctggggcaaggccaagatcatcggcgccgacgtgcagaacaccacgttcatcatcgacgggcccaacaccccggagtgccccgacgaccagcgcgcgtggaacatctgggaggtcgaggactacggcttcgggatcttcaccaccaacatctggctgaagctgcgggactcctacacccaggtgtgcgaccaccgcctcatgagcgccgccatcaaggactccaaggccgtgcacgccgacatgggctactggatcgagagcgagaagaacgagacctggaagctggcgcgggcctccttcatcgaggtcaagacctgcatctggcccaagagccacaccctgtggtccaacggcgtgctcgagagcgagatgatcatccccaagatctacgggggcccgatctcccagcacaactaccgccccgggtacttcacgcagaccgccggcccctggcacctggggaagctggagctcgacttcgacctgtgcgagggcaccaccgtggtcgtggacgagcactgcggcaaccgggggccgagcctgcgcacgaccaccgtgaccggcaagatcatccacgagtggtgctgccggtcctgcacgctgccgcccctccgcttcaagggggaggacggctgctggtacgggatggagatccggcccgtcaaggagaaggaggagaacctggtcaagagcatggtgagcgccggctccggcgaggtcgacagcttctccctcgggctgctgtgcatcagcatcatgatcgaggaggtgatgcgctcccggtggagccgcaagatgctcatgaccggcaccctggccgtgttcttcctgctcatcatggggcagctgacctggaacgacctgatccggctctgcatcatggtcggcgcgaacgcctccgaccgcatggggatgggcacgacctacctggccctgatggccaccttcaagatgcgcccgatgttcgccgtgggcctcctgttccggcgcctgaccagccgggaggtgctcctgctgacgatcgggctctccctggtcgcgagcgtggagctgcccaactccctcgaggagctgggcgacgggctggccatgggcatcatgatcctcaagctgctgaccgacttccagagccaccagctctgggccaccctgctgtccctcaccttcatccgcacgaccttcagcctgcactacgcctggaagaccatggcgatggtcctgtccatcgtgagcctcatccccctgtgcctgtccaccacgagccagaagaccacctggctccccgtgctgctgggctccctcgggtgcaagccgctgaccatgttcctgatcgccgagaacaagatctggggccgcaagagctggcccctcaacgaggggatcatggccgtcggcatcgtgagcatcctgctgtccagcctcctgaagaacgacgtgcccctggccgggcccctcatcgccggcggcatgctgatcgcgtgctacgtcatctccgggagctccgccgacctgagcctcgagaaggccgccgaggtgtcctgggaggaggaggccgagcacagcggcgcgtcccacaacatcctggtggaggtccaggacgacgggacgatgaagatcaaggacgaggagcgcgacgacaccctgaccatcctcctgaaggccaccctgctcgccgtgagcggcgtgtacccgctgtccatccccgccaccctgttcgtctggtgcttctggcagaagaagaagcagcggagcggggtgctctgggacacgcccagcccgcccgaggtggagcgcgccgtcctggacgacggcatctaccggatcatgcagcgcggcctgctggggcggagccaggtgggcgtgggggtcttccaggagaacgtgttccacaccatgtggcacgtgacccgcggcgcggtcctcatgtaccaggggaagcggctggagccctcctgggccagcgtgaagaaggacctgatctcctacggcggcgggtggcgcctccagggcagctggaacaccggggaggaggtgcaggtcatcgccgtggagcccggcaagaaccccaagaacgtgcagacggcccccgggaccttcaagacctccgagggcgaggtcggcgccatcgcgctggacttcaagcccgggaccagcggcagccccatcgtgaaccgggaggggaagatcgtgggcctgtacggcaacggggtcgtgacgacctccggcacctacgtgagcgccatcgcccaggccaaggcgtcccaggaggggcccctcccggagatcgaggacgaggtcttccgcaagcggaacctgaccatcatggacctgcaccccggcagcgggaagacgcgccggtacctccccgccatcgtgcgcgaggccatcaagcggcgcctgcgcaccctgatcctcgccccgacccgggtggtcgcctccgagatggcggaggccctgaagggcatgcccatccgctaccagaccacggccgtcaagagcgagcacaccggcaaggagatcgtggacctgatgtgccacgccaccttcaccatgcggctcctgtcccccgtccgcgtgcccaactacaacatgatcatcatggacgaggcccacttcacggacccgagctccatcgcggcccgggggtacatcagcacccgcgtgggcatgggggaggccgccgccatcttcatgaccgcgacgccgcccggctccgtcgaggccttcccccagagcaacgccgtgatccaggacgaggagcgggacatcccggagcgctcctggaacagcgggtacgagtggatcacggacttccccggcaagaccgtgtggttcgtcccctccatcaagagcggcaacgacatcgccaactgcctgcggaagaacgggaagcgcgtgatccagctctcccggaagaccttcgacaccgagtaccagaagacgaagaacaacgactgggactacgtggtcaccaccgacatcagcgagatgggcgcgaacttccgcgccgaccgggtgatcgacccccgccggtgcctgaagccggtgatcctgaaggacgggcccgagcgcgtcatcctcgccggccccatgcccgtgaccgtcgcctccgccgcgcagcggcgcgggcggatcggccgcaaccacaacaaggagggcgaccagtacatctacatggggcagccgctgaacaacgacgaggaccacgcccactggacggaggccaagatgctgctcgacaacatcaacacccccgagggcatcatccccgccctgttcgagcccgagcgcgagaagtccgccgcgatcgacggggagtaccggctgcgcggcgaggcccggaagaccttcgtggagctcatgcgccgcggggacctgccggtgtggctgagctacaaggtcgcctccgagggcttccagtacagcgaccgccggtggtgcttcgacggcgagcgcaacaaccaggtgctcgaggagaacatggacgtggagatctggaccaaggagggggagcggaagaagctgcgcccccggtggctggacgcccgcacgtactccgaccccctcgccctgcgggagttcaaggagttcgcggccggccgccggagcgtctccggggacctgatcctcgagatcggcaagctgccccagcacctgacccagcgcgcccagaacgccctcgacaacctggtgatgctgcacaacagcgagcagggcgggcgggcgtaccgccacgccatggaggagctcccggacaccatcgagaccctgatgctgctcgccctgatcgccgtgctgacgggcggggtcaccctcttcctgctgtccggccgggggctcggcaagaccagcatcggcctgctgtgcgtgatggcctccagcgtgctcctgtggatggcgtccgtcgagccccactggatcgccgccagcatcatcctggagttcttcctcatggtgctgctgatccccgagcccgaccgccagcggaccccgcaggacaaccagctcgcctacgtggtcatcgggctgctgttcatgatcctcaccgtggccgcgaacgagatgggcctgctggagacgaccaagaaggacctcgggatcggccacgtggccgtcgagaaccaccaccacgccgccatgctggacgtggacctgcaccccgcctccgcgtggaccctctacgccgtggccaccacgatcatcacccccatgatgcgccacaccatcgagaacaccacggccaacatcagcctgaccgccatcgcgaaccaggccgccatcctgatggggctcgacaagggctggccgatctccaagatggacatcggcgtccccctgctggccctcgggtgctacagccaggtgaaccccctgaccctgaccgcggccgtgctcatgctggtcgcccactacgccatcatcggccccgggctgcaggccaaggcgacgcgcgaggcccagaagcggaccgccgccggcatcatgaagaacccgaccgtggacgggatcgtggccatcgacctcgaccccgtcgtgtacgacgcgaagttcgagaagcagctgggccagatcatgctgctcatcctgtgcacctcccagatcctgctcatgcgcacgacctgggccctgtgcgagagcatcaccctggccaccggccccctcacgaccctgtgggaggggtcccccggcaagttctggaacaccaccatcgccgtgagcatggccaacatcttccgggggagctacctggcgggcgccggcctcgccttctccctgatgaagtccctcgggggcgggcgccgggggacgggggcccagggcgagaccctcggcgagaagtggaagcgccagctgaaccagctgtccaagagcgagttcaacacctacaagcggtccgggatcatggaggtcgaccgcagcgaggcgaaggagggcctcaagcgcggggagaccacgaagcacgccgtgtcccgcggcaccgccaagctgcggtggttcgtggagcgcaacctggtcaagccggaggggaaggtgatcgacctgggctgcggccgcggcgggtggagctactactgcgccgggctcaagaaggtgaccgaggtcaaggggtacaccaagggcgggcccggccacgaggagcccatccccatggccacgtacgggtggaacctggtgaagctgcactccggcaaggacgtgttcttcatcccgcccgagaagtgcgacaccctcctgtgcgacatcggggagagctcccccaaccccaccatcgaggagggccgcaccctgcgggtcctcaagatggtggagccgtggctgcgcgggaaccagttctgcatcaagatcctgaacccctacatgcccagcgtggtcgagacgctcgagcagatgcagcggaagcacggcggcatgctggtgcgcaaccccctgtcccggaacagcacccacgagatgtactgggtgtcctgcgggaccggcaacatcgtcagcgcggtgaacatgacctcccgcatgctcctgaaccgcttcaccatggcccaccggaagccgacgtacgagcgcgacgtggacctgggggccggcacccggcacgtcgccgtggagcccgaggtggccaacctcgacatcatcggccagcgcatcgagaacatcaagcacgagcacaagagcacctggcactacgacgaggacaacccctacaagacctgggcgtaccacgggtcctacgaggtcaagcccagcggcagcgcctccagcatggtgaacggggtcgtgaagctgctgacgaagccgtgggacgtgatccccatggtcacccagatcgccatgaccgacaccacgcccttcggccagcagcgggtgttcaaggagaaggtggacacccgcacccccaaggccaagcgggggaccgcccagatcatggaggtcacggcgaagtggctctggggcttcctgtcccgcaacaagaagccgcggatctgcacccgcgaggagttcacccggaaggtgcgcagcaacgccgccatcggcgccgtgttcgtcgacgagaaccagtggaactccgcgaaggaggccgtggaggacgagcggttctgggacctggtgcaccgcgagcgggagctccacaagcaggggaagtgcgcgacctgcgtctacaacatgatgggcaagcgcgagaagaagctgggggagttcggcaaggccaaggggagccgggccatctggtacatgtggctgggcgcgcgcttcctcgagttcgaggccctgggcttcatgaacgaggaccactggttctcccgggagaacagcctgtccggggtggagggcgaggggctccacaagctgggctacatcctgcgcgacatcagcaagatccccgggggcaacatgtacgccgacgacacggccggctgggacacccggatcaccgaggacgacctccagaacgaggccaagatcaccgacatcatggagcccgagcacgcgctgctggccaagtccatcttcaagctcacgtaccagaacaaggtggtccgcgtgcagcgcccggccaagaacgggaccgtgatggacgtcatcagccggcgcgaccagcggggctccggccaggtgggcacctacggcctgaacaccttcacgaacatggaggcccagctgatccgccagatggagagcgaggggatcttctcccccagcgagctcgagacccccaacctggccggccgggtgctggactggctcgagaagcacggggtcgagcgcctgaagcggatggcgatctccggcgacgactgcgtggtgaagcccatcgacgaccgcttcgccaccgccctgaccgccctcaacgacatggggaaggtccggaaggacatcccgcagtgggagcccagcaagggctggaacgactggcagcaggtccccttctgcagccaccacttccaccagctgatcatgaaggacggccgcgagatcgtggtcccctgccggaaccaggacgagctggtggggcgcgcccgggtgtcccagggcgcggggtggagcctccgcgagacggcctgcctgggcaagtcctacgcccagatgtggcagctgatgtacttccaccggcgcgacctccggctggccgcgaacgccatctgcagcgccgtcccggtggactgggtgcccacctcccgcaccacctggagcatccacgcccaccaccagtggatgacgaccgaggacatgctgtccgtctggaaccgggtgtggatcgaggagaacccctggatggaggacaagacccacgtgagctcctggggcgacgtcccctacctcggcaagcgcgaggaccagtggtgcggcagcctgatcgggctgaccgcccgcgcgacgtgggccaccaacatccaggtggccatcaaccaggtgcggcgcctcctgggcaacgagaactacctggactacatgacctccatgaagcggttcaagaacgagagcgacccggagggggccctctggtga

SEQ ID NO: 8524 - RNA, 9879 nt, synthetic construct
  misc_feature 1..9879: note = derived and/or modified CDS sequence (opt1) from DENV-1__FJ882550__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgccggggtgaacatgtgcaccctcatcgccatggacctgggcgagctgtgcgaggacaccatgacctacaagtgcccccggatcaccgaggccgagcccgacgacgtggactgctggtgcaacgccacggacacctgggtgacctacgggacctgcagccagacgggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcatgaccacgatcttcgccgggcacctgaagtgccgcctcaagatggacaagctgaccctgaagggcatgagctacgtgatgtgcaccgggtccttcaagctcgagaaggaggtcgcggagacccagcacggcacggtgctggtgcagatcaagtacgagggcaccgacgccccctgcaagatccccttcagcacccaggacgagaagggggtcacccagaacggccggctgatcacggccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacaccgcctgggacttcgggtccgtgggcggcgtgttcacgagcgtcgggaagctggtgcaccagatcttcggcaccgcctacggggtcctgttctccggcgtcagctggaccatgaagatcgggatcggcgtgctgctgacctggctcggcctgaactcccgcagcacgtccctgagcatgacctgcatcgccgtggggctcgtcaccctgtacctgggcgtgatggtgcaggccgactccgggtgcgtcatcaactggaagggccgggagctcaagtgcgggagcggcatcttcgtgaccaacgaggtgcacacgtggaccgagcagtacaagttccaggcggacagcccgaagcgcctgtccgccgccatcggcaaggcctgggaggagggggtctgcggcatccggagcgccacccgcctggagaacatcatgtggaagcagatctccaacgagctcaaccacatcctgctggagaacgacatgaagttcaccgtggtggtcggggacgtggtgggcatcctcgcgcaggggaagaagatgatccggccccagcccatggagcacaagtacagctggaagtcctggggcaaggccaagatcatcggcgccgacgtccagaacaccacgttcatcatcgacgggcccaacaccccggagtgccccgacgaccagcgcgcctggaacatctgggaggtggaggactacggcttcgggatcttcaccaccaacatctggctgaagctgcgggacagctacacccaggtgtgcgaccaccgcctcatgtccgcggccatcaaggacagcaaggccgtccacgccgacatgggctactggatcgagtccgagaagaacgagacctggaagctggcccgggcgagcttcatcgaggtgaagacctgcatctggcccaagtcccacaccctgtggagcaacggcgtgctcgagtccgagatgatcatccccaagatctacgggggcccgatcagccagcacaactaccgccccgggtacttcacgcagaccgccggcccctggcacctggggaagctggagctcgacttcgacctgtgcgagggcaccaccgtcgtggtggacgagcactgcggcaaccgggggccgtccctgcgcacgaccaccgtcaccggcaagatcatccacgagtggtgctgccggagctgcacgctgccgcccctccgcttcaagggggaggacggctgctggtacgggatggagatccggcccgtgaaggagaaggaggagaacctggtgaagtccatggtcagcgccggcagcggcgaggtggactccttcagcctcgggctgctgtgcatctccatcatgatcgaggaggtgatgcgcagccggtggtcccgcaagatgctcatgaccggcaccctggccgtcttcctgctcctgatcatggggcagctgacctggaacgacctcatccggctgtgcatcatggtgggcgccaacgcgagcgaccgcatggggatgggcacgacctacctggccctcatggccaccttcaagatgcgcccgatgttcgccgtggggctgctgttccggcgcctcacctcccgggaggtcctgctgctcacgatcgggctgagcctggtggcctccgtcgagctccccaacagcctggaggagctgggcgacgggctcgcgatgggcatcatgatcctgaagctgctcaccgacttccagtcccaccagctgtgggccaccctgctcagcctgaccttcatcaagacgaccctgtccctccactacgcctggaagaccatggccatggtgctgagcatcgtgtccctgttccccctctgcctgagcaccacgtcccagaagaccacctggctgcccgtcctcctgggcagcctggggtgcaagccgctcaccatgttcctgatcacggagaacaagatctggggccgcaagtcctggcccctgaacgaggggatcatggcggtgggcgtggtcagcatcctcctgagctccctgctcaagaacgacgtgcccctggccgggcccctgatcgccggcggcatgctcatcgcctgctacgtgatcagcgggtccagcgccgacctgtccctggagaaggcggccgaggtcagctgggaggaggaggccgagcactccggcgccagccacaacatcctcgtggaggtgcaggacgacgggaccatgaagatcaaggacgaggagcgggacgacaccctgaccatcctgctcaaggccaccctgctggcggtctccggcgtgtacccgctcagcatccccgccacgctgttcgtgtggtacttctggcagaagaagaagcagcgctccggggtcctgtgggacacccccagcccgcccgaggtggagcgggccgtgctggacgacggcatctaccgcatcatgcagcggggcctcctggggcgctcccaggtcggcgtgggggtgttccaggagaacgtcttccacaccatgtggcacgtgacccggggcgccgtgctgatgtaccaggggaagcgcctcgagcccagctgggcctccgtcaagaaggacctgatcagctacggcggcgggtggcggctgcagggctcctggaacacgggggaggaggtccaggtgatcgcggtcgagcccggcaagaaccccaagaacgtgcagaccgcccccgggaccttcaagacccccgagggcgaggtgggcgccatcgccctcgacttcaagcccgggacgagcggctcccccatcgtcaaccgcgaggggaagatcgtgggcctgtacggcaacggggtggtcaccaccagcggcacctacgtgagcgccatcgcgcaggccaaggcctcccaggaggggccgctgcccgagatcgaggacgaggtgttccggaagcgcaacctcacgatcatggacctgcaccccggcagcgggaagacccggcgctacctgccggccatcgtccgggaggcgatcaagcgcaagctccggaccctgatcctggcccccacccgcgtggtggcctccgagatggccgaggccctcaagggcatgcccatccgctaccagacgaccgcggtcaagagcgagcacaccggcaaggagatcgtggacctgatgtgccacgccaccttcacgatgcggctgctctcccccgtgcgcgtcccgaactacaacatgatcatcatggacgaggcccacttcaccgaccccagctccatcgccgcccgggggtacatcagcacccgcgtgggcatgggggaggcggccgccatcttcatgaccgccacgccgcccggctccgtggaggccttcccgcagagcaacgcggtcatccaggacgaggagcgggacatccccgagcgctcctggaacagcgggtacgagtggatcaccgacttccccggcaagaccgtgtggttcgtgccctccatcaagagcggcaacgacatcgccaactgcctgcggaagaacgggaagcgcgtcatccagctgtcccggaagaccttcgacacggagtaccagaagaccaagaacaacgactgggactacgtggtgaccaccgacatcagcgagatgggcgccaacttccgcgccgaccgggtcatcgacccgcgccggtgcctcaagcccgtgatcctgaaggacgggcccgagcgcgtcatcctggcgggccccatgccggtgacggtggcctccgccgcccagcggcgcgggcggatcggccgcaaccacaacaaggagggcgaccagtacatctacatggggcagcccctcaacaacgacgaggaccacgcccactggaccgaggcgaagatgctgctggacaacatcaacacccccgagggcatcatccccgccctcttcgagccggagcgggagaagtccgccgccatcgacggggagtaccgcctgcgcggcgaggcccggaagaccttcgtcgagctgatgcgccgcggggacctccccgtgtggctgtcctacaaggtggcgagcgagggcttccagtacagcgaccgccggtggtgcttcgacggcgagcgcaacaaccaggtcctggaggagaacatggacgtggagatctggacgaaggagggggagcggaagaagctccgcccccggtggctggacgcccgcacctactccgaccccctggccctccgggagttcaaggagttcgccgccggccgccggagcgtgtccggggacctgatcctggagatcggcaagctcccgcagcacctgacccagcgcgcgcagaacgccctggacaacctcgtcatgctgcacaacagcgagcagggcgggcgggcctaccgccacgccatggaggagctgcccgacaccatcgagacgctcatgctgctggcgctcatcgccgtgctgaccggcggggtgaccctgttcttcctctccggccgggggctgggcaagaccagcatcggcctgctctgcgtcatggcctccagcgtgctgctgtggatggcctccgtggagccccactggatcgccgcgagcatcatcctcgagttcttcctgatggtcctgctcatccccgagccggaccgccagcggacgccccaggacaaccagctggcctacgtggtgatcgggctcctcttcatgatcctgacggtcgccgccaacgagatgggcctgctcgagaccaccaagaaggacctggggatcggccacgtggccgtggagaaccaccaccacgcgaccatgctggacgtcgacctccaccccgcctccgcctggacgctgtacgccgtggccaccaccatcatcaccccgatgatgcgccacacgatcgagaacaccaccgcgaacatcagcctgaccgccatcgccaaccaggccgccatcctcatggggctggacaagggctggcccatctccaagatggacatcggcgtgcccctgctcgcgctggggtgctacagccaggtcaaccccctgacgctcaccgccgccgtgctgatgctggtggcccactacgcgatcatcggcccggggctccaggccaaggccacccgggaggcccagaagcgcaccgccgcgggcatcatgaagaaccccacggtcgacgggatcgtggccatcgacctggaccccgtggtctacgacgccaagttcgagaagcagctgggccagatcatgctcctgatcctgtgcacctcccagatcctcctgatgcgcaccacctgggccctgtgcgagagcatcacgctcgccaccggccccctgaccaccctgtgggaggggtccccgggcaagttctggaacacgaccatcgcggtgagcatggccaacatcttccgggggtcctacctcgccggcgccggcctggccttcagcctgatgaagtccctcgggggcgggcgccggggcaccggggcgcagggcgagaccctgggcgagaagtggaagcgccagctgaaccagctctccaagagcgagttcaacatctacaagcggtccgggatcatggaggtggaccgcagcgaggccaaggagggcctgaagcgcggggagacgacccgccacgccgtctcccggggcaccgccaagctgcgctggttcgtggagcggaacctggtgaagcccgaggggaaggtcatcgacctcggctgcggccgcgggggctggagctactactgcgcggggctgaagaaggtgaccgaggtgaagggctacacgaagggcgggcccggccacgaggagcccatcccgatggccacctacgggtggaacctggtcaagctccactccggcaaggacgtgttcttcacgccgcccgagaagtgcgacaccctgctgtgcgacatcggggagagctcccccaacccgacgatcgaggagggccggaccctccgcgtgctgaagatggtcgagccctggctgcgggggaaccagttctgcatcaagatcctcaacccctacatgcccagcgtggtggagaccctggagcagatgcagcgcaagcacggcggcatgctggtccggaacccgctctcccgcaacagcacccacgagatgtactgggtgtcctgcgggaccggcaacatcgtgagcgccgtcaacatgacgtcccggatgctgctgaaccgcttcaccatggcccaccgcaagcccacctacgagcgggacgtggacctcggggccggcacccgccacgtggcggtcgagcccgaggtggccaacctggacatcatcggccagcggatcgagaacatcaagcacgagcacaagagcacgtggcactacgacgaggacaacccctacaagacctgggcctaccacgggtcctacgaggtcaagccgagcggctccgccagcagcatggtgaacggggtggtcaagctgctcaccaagccctgggacgtgatccccatggtgacccagatcgccatgacggacaccacccccttcggccagcagcgcgtcttcaaggagaaggtggacacccggacgccgaaggcgaagcgcgggaccgcccagatcatggaggtgaccgcccggtggctgtggggcttcctgtcccgcaacaagaagccccggatctgcacccgcgaggagttcacgcggaaggtccgcagcaacgccgccatcggcgcggtgttcgtggacgagaaccagtggaactccgccaaggaggccgtcgaggacgagcggttctgggacctcgtgcagaaggagcgcgagctgcacaagcaggggaagtgcgcgacctgcgtgtacaacatgatgggcaagcgggagaagaagctgggggagttcggcaaggcgaaggggagccgcgccatctggtacatgtggctcggcgcccggttcctggagttcgaggccctgggcttcatgaacgaggaccactggttctcccgcgagaacagcctctccggggtcgagggcgaggggctgcacaagctgggctacatcctccgggacatcagcaagatccccgggggcaacatgtacgccgacgacaccgcgggctgggacacccgcatcacggaggacgacctgcagaacgaggccaagatcaccgacatcatggagccggagcacgccctgctcgccacctccatcttcaagctgacctaccagaacaaggtggtgcgggtccagcgccccgccaagaacgggacggtgatggacgtgatcagccgccgggaccagcgcggctccgggcaggtcggcacctacggcctgaacaccttcaccaacatggaggcgcagctcatccggcagatggagagcgaggggatcttcctgccctccgagctggagacgcccaacctcgccgagcgcgtgctggactggctggagaagtacggcgtggagcggctcaagcgcatggccatcagcggggacgactgcgtcgtgaagccgatcgacgaccggttcgccaccgccctgaccgcgctgaacgacatgggcaaggtgcgcaaggacatcccccagtgggagccctccaaggggtggaacgactggcagcaggtccccttctgcagccaccacttccaccagctcatcatgaaggacggccgggagatcgtggtgccgtgccgcaaccaggacgagctggtcggccgggcccgcgtgtcccagggggccggctggagcctgcgggagaccgcctgcctcggcaagagctacgcccagatgtggcagctgatgtacttccaccgccgggacctgcgcctcgcggccaacgccatctgctccgccgtgcccgtcgactgggtgcccacgagccggaccacctggtccatccacgcgcaccaccagtggatgaccacggaggacatgctgagcgtgtggaaccgcgtctggatcgaggagaacccctggatggaggacaagacccacgtgtccagctggggcgacgtgccgtacctggggaagcgggaggaccagtggtgcggctccctcatcggcctgaccgcccgcgccacctgggccagcaacatccaggtcgccatcaaccaggtgcgccggctgatcgggaacgagaactacctcgactacatgacctccatgaagcgcttcaagaacgagggcgaccccgagggggcgctgtggtga

SEQ ID NO: 8525 - RNA, 9879 nt, synthetic construct
  misc_feature 1..9879: note = derived and/or modified CDS sequence (opt1) from DENV-1__FJ882551__SS-prME
  source 1..9879: mol_type = other RNA
agcgtgaccatgctgctgatgctgatgcccaccgccctggccttccacctcacgacccgcggcggggagccccacatgatcgtgagcaagcaggagcggggcaagagcctgctgttcaagaccagcgcgggggtgaacatgtgcaccctcatcgccatggacctgggcgagttctgcgaggacacgatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggaccagcggggcctccaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctcgtccagatcaagtacgagggcaccgacgccccctgcaagatccccttctccacccaggacgagaagggggtgacccagaacggccggctgatcacggccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacaccgcctgggacttcgggagcatcggcggcgtgttcacgtccgtcgggaagctggtgcaccagatcttcggcaccgcctacggggtgctgttcagcggcgtctcctggaccatgaagatcgggatcggcgtgctcctgacctggctgggcctcaacagccgctccacgagcctgtccatgacctgcatcgccgtggggctggtcaccctctacctgggcgtgatggtgcaggccgacagcgggtgcgtcatcaactggaagggccgggagctgaagtgcgggagcggcatcttcgtgaccaacgaggtgcacacgtggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagctgaccgtggtggtcggggacgtggcgggcatcctcgcccaggggaagaagatgatccggccccagcccatggagtacaagtactcctggaagtcctggggcaaggccaagatcatcggcgccgacgtgcagaacaccacgttcatcatcgacgggcccaacaccccggagtgccccgacgaccagcgcgcgtggaacatctgggaggtcgaggactacggcttcgggatcttcaccaccaacatctggctgaagctgcgggactcctacacccaggtgtgcgaccaccgcctcatgagcgccgccatcaaggactccaaggccgtgcacgccgacatgggctactggatcgagagcgagaagaacgagacctggaagctggcgcgggcctccttcatcgaggtcaagacctgcatctggcccaagagccacaccctgtggtccaacggcgtgctcgagagcgagatgatcatccccaagatctacgggggcccgacgtcccagcacaactaccgccccgggtacttcacccagaccgccggcccctggcacctggggaagctggagctcgacttcgacctgtgcgagggcaccacggtggtcgtggacgagcactgcggcaaccgggggccgagcctgcgcaccaccaccgtgacgggcaagatcatccacgagtggtgctgccggtcctgcaccctgccgcccctccgcttcaagggggaggacggctgctggtacgggatggagatccggcccgtcaaggagaaggaggagaacctggtcaagagcatggtgagcgccggctccggcgaggtcgacagcttctccctcgggctgctgtgcatcagcatcatgatcgaggaggtgatgcgctcccggtggagccgcaagatgctcatgaccggcaccctggccgtgttcttcctgctcatcatcgggcagctgacgtggaacgacctgatccggctctgcatcatggtcggcgcgaacgcctccgaccgcatggggatgggcaccacctacctggccctgatggccaccttcaagatgcgcccgatgttcgccgtggggctcctgttccggcgcctgacgagccgggaggtgctcctgctgaccatcgggctctccctggtcgcgagcgtggagctgcccaactccctcgaggagctgggcgacgggctggccatgggcatcatgatcctcaagctgctgaccgacttccagagccaccagctctgggccaccctgctgtccctcacgttcatccgcaccaccttcagcctgcactacgcctggaagaccatggcgatggtcctgtccatcgtgagcctcttccccctgtgcctgtccacgaccagccagaagaccacctggctccccgtgctgctgggctccctcgggtgcaagccgctgacgatgttcctgatcgccgagaacaagatctggggccgcaagagctggcccctcaacgaggggatcatggccgtcggcatcgtgagcatcctgctgtccagcctcctgaagaacgacgtgcccctggccgggcccctcatcgccggcggcatgctgatcgcgtgctacgtcatctccgggagctccgccgacctgagcctcgagaaggccgccgtggtgtcctgggaggaggaggccgagcacagcggcgcgtcccacaacatcctggtcgaggtgcaggacgacgggaccatgaagatcaaggacgaggagcgcgacgacaccctgaccatcctcctgaaggccaccctgctcgccgtgagcggcgtctacccgctgtccatccccgccacgctgttcgtgtggtacttctggcagaagaagaagcagcggagcggggtgctctgggacacccccagcccgcccgaggtcgagcgcgccgtgctggacgacggcatctaccggatcatgcagcgcggcctgctggggcggagccaggtgggcgtcggggtgttccaggagaacgtgttccacaccatgtggcacgtcacccgcggcgcggtgctcatgtaccaggggaagcggctggagccctcctgggccagcgtgaagaaggacctgatctcctacggcggcgggtggcgcctccagggcagctggaacacgggggaggaggtccaggtgatcgccgtggagcccggcaagaaccccaagaacgtccagaccgcccccgggaccttcaagacctccgagggcgaggtgggcgccatcgcgctggacttcaagcccgggacgagcggcagccccatcgtgaaccgggaggggaagatcgtcggcctgtacggcaacggggtggtgaccacctccggcacctacgtcagcgccatcgcccaggccaaggcgtcccaggaggggcccctcccggagatcgaggacgaggtgttccgcaagcggaacctgacgatcatggacctgcaccccggcagcgggaagacccgccggtacctccccgccatcgtgcgcgaggccatcaagcggaagctgcgcaccctgatcctcgccccgacccgcgtcgtggcctccgagatggcggaggccctgaagggcatgcccatccggtaccagacgaccgccgtcaagagcgagcacaccggcaaggagatcgtcgacctgatgtgccacgccaccttcacgatgcgcctcctgtcccccgtgcgggtgcccaactacaacatgatcatcatggacgaggcccacttcaccgacccgagctccatcgcggcccgcgggtacatcagcacccgggtcggcatgggggaggccgccgccatcttcatgaccgcgacgccgcccggctccgtggaggccttcccccagagcaacgccgtgatccaggacgaggagcgcgacatcccggagcggtcctggaacagcgggtacgagtggatcaccgacttccccggcaagaccgtctggttcgtgccctccatcaagagcggcaacgacatcgccaactgcctgcgcaagaacgggaagcgggtgatccagctctcccgcaagaccttcgacacggagtaccagaagaccaagaacaacgactgggactacgtcgtgaccaccgacatcagcgagatgggcgcgaacttccgggccgaccgcgtgatcgacccccggcgctgcctgaagccggtcatcctgaaggacgggcccgagcgggtgatcctcgccggccccatgcccgtcacggtggcctccgccgcgcagcgccgggggcgcatcggccggaaccacaacaaggagggcgaccagtacatctacatggggcagccgctgaacaacgacgaggaccacgcccactggaccgaggccaagatgctgctcgacaacatcaacacccccgagggcatcatccccgccctgttcgagcccgagcgcgagaagtccgccgcgatcgacggggagtaccgcctgcggggcgaggcccgcaagaccttcgtggagctcatgcggcgcggggacctgccggtctggctgagccacaaggtggcctccgagggcttccagtacagcgaccggcgctggtgcttcgacggcgagcggaacaaccaggtgctcgaggagaacatggacgtcgagatctggacgaaggagggggagcgcaagaagctgcggccccgctggctggacgcccggacctactccgaccccctcgccctgcgcgagttcaaggagttcgcggccggccggcgcagcgtgtccggggacctgatcctcgagatcggcaagctgccccagcacctgacccagcgggcccagaacgccctcgacaacctggtgatgctgcacaacagcgagcagggcgggcgcgcgtaccggcacgccatggaggagctcccggacaccatcgagacgctgatgctgctcgccctgatcgccgtcctgaccggcggggtgaccctcttcttcctgtccggccgcgggctgggcaagaccagcatcggcctcctgtgcgtgatggcctccagcgtcctgctctggatggcgtccgtggagccccactggatcgccgccagcatcatcctggagttcttcctgatggtgctcctgatccccgagcccgaccggcagcgcaccccgcaggacaaccagctggcctacgtcgtgatcgggctcctgttcatgatcctgacggtggccgcgaacgagatgggcctcctggagaccaccaagaaggacctggggatcggccacgtcgccgtggagaaccaccaccacgccgccatgctcgacgtggacctgcaccccgcctccgcgtggaccctgtacgccgtcgccacgaccatcatcacccccatgatgcggcacaccatcgagaacacgaccgccaacatcagcctcaccgccatcgcgaaccaggccgccatcctgatggggctggacaagggctggccgatctccaagatggacatcggcgtgcccctcctggccctggggtgctacagccaggtgaaccccctcaccctgacggcggccgtcctgatgctcgtggcccactacgccatcatcggccccgggctgcaggccaaggcgacccgcgaggcccagaagcgcaccgccgccggcatcatgaagaacccgaccgtggacgggatcgtcgccatcgacctggaccccgtggtgtacgacgcgaagttcgagaagcagctcggccagatcatgctgctgatcctctgcacgtcccagatcctgctgatgcggaccacctgggccctctgcgagagcatcaccctggccacgggccccctgaccaccctctgggaggggtcccccggcaagttctggaacaccacgatcgccgtcagcatggccaacatcttccgcgggagctacctggcgggcgccggcctggccttctccctcatgaagtccctcgggggcgggcggcgcgggaccggggcccagggcgagaccctgggcgagaagtggaagcggcagctcaaccagctgtccaagagcgagttcaacacctacaagcgctccgggatcatggaggtggaccggagcgaggcgaaggagggcctgaagcgcggggagacgaccaagcacgccgtgtcccggggcaccgccaagctccgctggttcgtcgagcggaacctggtgaagccggaggggaaggtgatcgacctgggctgcggccgcgggggctggagctactactgcgccgggctgaagaaggtcaccgaggtgaagggctacacgaagggcgggcccggccacgaggagcccatccccatggccacctacgggtggaacctcgtgaagctgcactccggcaaggacgtcttcttcatcccgcccgagaagtgcgacaccctgctctgcgacatcggggagagctcccccaaccccaccatcgaggagggccggacgctgcgcgtgctgaagatggtggagccgtggctccgggggaaccagttctgcatcaagatcctgaacccctacatgcccagcgtcgtggagaccctggagcagatgcagcgcaagcacggcggcatgctcgtgcggaaccccctgtcccgcaacagcacccacgagatgtactgggtctcctgcgggaccggcaacatcgtgagcgcggtgaacatgacctcccggatgctgctcaaccgcttcacgatggcccaccgcaagccgacctacgagcgggacgtcgacctgggggccggcacccgccacgtggccgtggagcccgaggtcgccaacctggacatcatcggccagcggatcgagaacatcaagcaggagcacaagagcacctggcactacgacgaggacaacccctacaagacgtgggcgtaccacgggtcctacgaggtgaagcccagcggcagcgcctccagcatggtcaacggggtggtgaagctcctgaccaagccgtgggacgtcatccccatggtgacccagatcgccatgaccgacacgacccccttcggccagcagcgcgtgttcaaggagaaggtcgacacccggacccccaaggccaagcgcgggacggcccagatcatggaggtgaccgcgaagtggctgtggggcttcctctcccggaacaagaagccgcgcatctgcacccgggaggagttcacccgcaaggtgcggagcaacgccgccatcggcgccgtcttcgtggacgagaaccagtggaactccgcgaaggaggccgtggaggacgagcgcttctgggacctggtccaccgggagcgcgagctgcacaagcaggggaagtgcgccacgtgcgtgtacaacatgatgggcaagcgggagaagaagctcggggagttcggcaaggccaaggggagccgcgccatctggtacatgtggctgggcgcgcggttcctggagttcgaggccctcggcttcatgaacgaggaccactggttctcccgcgagaacagcctgtccggggtggagggcgaggggctgcacaagctcggctacatcctgcgggacatcagcaagatccccgggggcaacatgtacgccgacgacaccgccggctgggacacccgcatcaccgaggacgacctgcagaacgaggccaagatcacggacatcatggagcccgagcacgcgctcctggccaagtccatcttcaagctgacctaccagaacaaggtcgtgcgggtgcagcgcccggccaagaacgggaccgtcatggacgtgatcagccgccgggaccagcgcggctccggccaggtgggcacctacggcctcaacacgttcaccaacatggaggcccagctgatccggcagatggagagcgaggggatcttctcccccagcgagctggagacccccaacctcgccggccgcgtcctggactggctgaagaagcacggggtggagcggctcaagcgcatggcgatctccggcgacgactgcgtggtcaagcccatcgacgaccggttcgccaccgccctgacggccctgaacgacatggggaaggtgcgcaaggacatcccgcagtgggagcccagcaagggctggaacgactggcagcaggtccccttctgcagccaccacttccaccagctcatcatgaaggacggccgggagctggtcgtgccctgccgcaaccaggacgagctggtggggcgggcccgcgtctcccagggcgcggggtggagcctccgggagaccgcctgcctgggcaagtcctacgcccagatgtggcagctgatgtacttccaccgccgggacctccgcctggccgcgaacgccatctgcagcgccgtgccggtggactgggtccccacctcccggaccacgtggagcatccacgcccaccaccagtggatgaccaccgaggacatgctgtccgtgtggaaccgcgtgtggatcgaggagaacccctggatggaggacaagacccacatcagctcctggggcgacgtcccctacctcggcaagcgggaggaccagtggtgcggcagcctgatcgggctgacggcccgcgcgacctgggccaccaacatccaggtggccatcaaccaggtgcgccggctcctgggcaacgagaactacctggactacatgacctccatgaagcgcttcaagaacgagagcgacccggagggggccctctggtga

SEQ ID NO: 8526 - RNA, 9879 nt, synthetic construct
  misc_feature 1..9879: note = derived and/or modified CDS sequence (opt1) from DENV-1__FJ882552__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagaccagcgcgggggtgaacatgtgcaccctcatcgccatggacctgggcgagttctgcgaggacacgatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtcgagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagaccgtccagtacgagaacctgaagtacagcgtgatcgtgaccgtccacacgggcgaccagcaccaggtggggaacgagtccaccgagcacggcaccaccgcgaccatcacgccccaggcccccagcaccgagatccagctgaccgactacggggccctcaccctggactgcagcccccggacgggcctggacttcaacgagatggtcctcctgaccatgaaggagaagtcctggctggtgcacaagcagtggttcctcgacctgccgctgccctggaccagcggggcctccaccagccaggagacgtggaaccggaaggacctcctggtgaccttcaagaccgcccacgcgaagaagcaggaggtcgtggtgctgggctcccaggagggcgccatgcacaccgccctcacgggggccaccgagatccagaccagcggcaccacgaccatcttcgccgggcacctgaagtgccgcctgaagatggacaagctcaccctgaagggcatgtcctacgtcatgtgcaccgggagcttcaagctggagaaggaggtggcggagacgcagcacggcaccgtgctcgtccagatcaagtacgagggcaccgacgccccctgcaagatccccttctccacccaggacgagaagggggtgacgcagaacggccggctgatcaccgccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacacggcctgggacttcgggagcatcggcggcgtgttcacctccgtcgggaagctggtgcaccagatcttcggcaccgcctacggggtgctgttcagcggcgtctcctggaccatgaagatcgggatcggcgtgctcctgacgtggctgggcctcaacagccgctccaccagcctgtccatgacctgcatcgccgtggggctggtcaccctctacctgggcgtgatggtgcaggccgacagcgggtgcgtcatcaactggaagggccgggagctgaagtgcgggagcggcatcttcgtgacgaacgaggtgcacacctggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagttcaccgtggtggtcggggacgtggcgggcatcctggcccaggggaagaagatgatccggccccagcccatggagtacaagtactcctggaagtcctggggcaaggccaagatcatcggcgccgacgtgcagaacacgaccttcatcatcgacgggcccaacaccccggagtgccccgacgaccagcgcgcgtggaacatctgggaggtcgaggactacggcttcgggatcttcaccacgaacatctggctcaagctgcgggactcctacacccaggtgtgcgaccaccgcctgatgagcgccgccatcaaggactccaaggccgtgcacgccgacatgggctactggatcgagagcgagaagaacgagacctggaagctcgcgcgggcctccttcatcgaggtcaagacctgcatctggcccaagagccacacgctgtggtccaacggcgtgctggagagcgagatgatcatccccaagatctacgggggcccgatctcccagcacaactaccgccccgggtacttcacccagaccgccggcccctggcacctcgggaagctggagctggacttcgacctctgcgagggcaccacggtggtcgtggacgagcactgcggcaaccgggggccgagcctgcgcaccaccaccgtgacgggcaagatcatccacgagtggtgctgccggtcctgcaccctgccgcccctgcgcttcaagggggaggacggctgctggtacgggatggagatccggcccgtcaaggagaaggaggagaacctggtcaagagcatggtgagcgccggctccggcgaggtcgacagcttctccctggggctcctgtgcatcagcatcatgatcgaggaggtgatgcgctcccggtggagccgcaagatgctgatgaccggcaccctcgccgtgttcttcctgctgatcatggggcagctcacgtggaacgacctgatccggctgtgcatcatggtcggcgcgaacgcctccgaccgcatggggatgggcaccacctacctcgccctgatggccaccttcaagatgcgcccgatgttcgccgtggggctcctgttccggcgcctgacgagccgggaggtgctgctcctgaccatcgggctgtccctcgtcgcgagcgtggagctgcccaactccctggaggagctcggcgacgggctggccatgggcatcatgatcctgaagctcctgaccgacttccagagccaccagctgtgggccaccctcctgtccctgacgttcatcaagaccaccagctccctccactacgcctggaagaccatggcgatggtcctgagcatcgtgtccctgttccccctctgcctgagcacgacctcccagaagaccacctggctgcccgtgctcctgggcagcctggggtgcaagccgctcacgatgttcctgatcgccgagaacaagatctggggccgcaagagctggcccctgaacgaggggatcatggccgtcggcatcgtgtccatcctcctgagctccctgctcaagaacgacgtgcccctggccgggcccctgatcgccggcggcatgctcatcgcgtgctacgtcatcagcgggtccagcgccgacctgtccctggagaaggccgccgaggtgagctgggaggaggaggccgagcactccggcgcgagccacaacatcctcgtggaggtccaggacgacgggaccatgaagatcaaggacgaggagcgggacgacaccctgaccatcctgctcaaggccaccctgctggccgtgtccggcgtgtacccgctcagcatccccgccacgctgttcgtctggtacttctggcagaagaagaagcagcgctccggggtgctgtgggacacccccagcccgcccgaggtggagcgggccgtcctcgacgacggcatctaccgcatcatgcagcggggcctgctggggcgctcccaggtgggcgtgggggtcttccaggagaacgtgttccacaccatgtggcacgtgacccggggcgcggtcctgatgtaccaggggaagcgcctcgagcccagctgggcctccgtgaagaaggacctgatcagctacggcggcgggtggcggctgcagggctcctggaacacgggggaggaggtgcaggtcatcgccgtggagcccggcaagaaccccaagaacgtgcagaccgcccccgggaccttcaagaccagcgagggcgaggtcggcgccatcgcgctcgacttcaagcccgggacgagcggctcccccatcgtgaaccgcgaggggaagatcgtgggcctgtacggcaacggggtcgtgaccaccagcggcacctacgtgtccgccatcgcccaggccaaggcgagccaggaggggcccctgccggagatcgaggacgaggtcttccggaagcgcaacctcacgatcatggacctgcaccccggctccgggaagacccggcgctacctgcccgccatcgtgcgggaggccatcaagcgcaagctccggaccctgatcctggccccgacccgcgtggtcgccagcgagatggcggaggccctcaagggcatgcccatccgctaccagacgaccgccgtgaagtccgagcacaccggcaaggagatcgtggacctgatgtgccacgccaccttcacgatgcggctgctcagccccgtccgcgtgcccaactacaacatgatcatcatggacgaggcccacttcaccgacccgtccagcatcgcggcccgggggtacatctccacccgcgtgggcatgggggaggccgccgccatcttcatgaccgcgacgccgcccggcagcgtcgaggccttcccccagtccaacgccgtgatccaggacgaggagcgggacatcccggagcgcagctggaactccgggtacgagtggatcaccgacttccccggcaagaccgtgtggttcgtccccagcatcaagtccggcaacgacatcgccaactgcctgcggaagaacgggaagcgcgtgatccagctgagccggaagaccttcgacacggagtaccagaagaccaagaacaacgactgggactacgtggtcaccaccgacatctccgagatgggcgcgaacttccgcgccgaccgggtgatcgacccccgccggtgcctcaagccggtgatcctgaaggacgggcccgagcgcgtcatcctggccggccccatgcccgtgacggtcgccagcgccgcgcagcggcgcgggcggatcggccgcaaccacaacaaggagggcgaccagtacatctacatggggcagccgctcaacaacgacgaggaccacgcccactggaccgaggccaagatgctgctggacaacatcaacacccccgagggcatcatccccgccctcttcgagcccgagcgggagaagtccgccgcgatcgacggggagtaccgcctgcgcggcgaggcccggaagaccttcgtggagctgatgcgccgcggggacctcccggtgtggctgtcctacaaggtcgccagcgagggcttccagtactccgaccgccggtggtgcttcgacggcgagcgcaacaaccaggtgctggaggagaacatggacgtggagatctggacgaaggagggggagcggaagaagctccgcccccggtggctggacgcccgcacctacagcgaccccctggccctccgggagttcaaggagttcgcggccggccgccggtccgtcagcggggacctgatcctggagatcggcaagctcccccagcacctgacccagcgcgcccagaacgccctggacaacctcgtgatgctgcacaactccgagcagggcgggcgggcgtaccgccacgccatggaggagctgccggacaccatcgagacgctcatgctgctggccctcatcgccgtgctgaccggcggggtcaccctgttcttcctcagcggccgggggctgggcaagacctccatcggcctgctctgcgtgatggccagctccgtgctgctgtggatggcgagcgtcgagccccactggatcgccgcctccatcatcctcgagttcttcctgatggtgctgctcatccccgagcccgaccgccagcggaccccgcaggacaaccagctggcctacgtggtcatcgggctcctcttcatgatcctgacggtggccgcgaacgagatgggcctgctcgagaccaccaagaaggacctggggatcggccacgtggccgtcgagaaccaccaccacgccgccatgctggacgtggacctccaccccgccagcgcgtggaccctgtacgccgtggccacgaccatcatcacccccatgatgcgccacaccatcgagaacacgaccgccaacatctccctgaccgccatcgcgaaccaggccgccatcctcatggggctggacaagggctggccgatcagcaagatggacatcggcgtccccctgctcgccctggggtgctactcccaggtgaaccccctgaccctcacggcggccgtgctgatgctggtcgcccactacgccatcatcggccccgggctccaggccaaggcgacccgggaggcccagaagcgcaccgccgccggcatcatgaagaacccgaccgtggacgggatcgtggccatcgacctggaccccgtcgtgtacgacgcgaagttcgagaagcagctgggccagatcatgctcctgatcctgtgcacgagccagatcctcctgatgcgcaccacctgggccctgtgcgagtccatcaccctcgccacgggccccctgaccaccctgtgggaggggagccccggcaagttctggaacaccacgatcgccgtgagcatggccaacatcttccgggggtcctacctcgcgggcgccggcctggccttcagcctgatgaagtccctcgggggcgggcgccggggcaccggggcccagggcgagaccctgggcgagaagtggaagcgccagctgaaccagctcagcaagtccgagttcaacacctacaagcggagcgggatcatggaggtcgaccgctccgaggcgaaggagggcctgaagcgcggggagacgaccaaccacgccgtgagccgcggcaccgccaagctgcggtggttcgtggagcgcaacctcgtcaagccggaggggaaggtgatcgacctgggctgcggccgcggcgggtggtcctactactgcgccgggctgaagaaggtgaccgaggtcaaggggtacacgaagggcgggcccggccacgaggagcccatccccatggccacctacgggtggaacctggtgaagctccacagcggcaaggacgtgttcttcatcccgcccgagaagtgcgacaccctgctgtgcgacatcggggagtccagccccaaccccaccatcgaggagggccgcacgctccgggtcctgaagatggtggagccgtggctgcgcgggaaccagttctgcatcaagatcctcaacccctacatgccctccgtggtcgagaccctggagcagatgcagcggaagcacggcggcatgctggtgcgcaaccccctcagccggaactccacccacgagatgtactgggtgagctgcgggaccggcaacatcgtctccgcggtgaacatgaccagccgcatgctgctgaaccggttcacgatggcccaccgcaagccgacctacgagcgcgacgtggacctcggggccggcacccggcacgtcgccgtggagcccgaggtggccaacctggacatcatcggccagcgcatcgagaacatcaagcacgagcacaagtccacctggcactacgacgaggacaacccctacaagacgtgggcgtaccacgggagctacgaggtcaagcccagcggctccgccagctccatggtgaacggggtcgtgaagctgctcaccaagccgtgggacgtgatccccatggtcacccagatcgccatgaccgacacgacccccttcggccagcagcgggtgttcaaggagaaggtggacacccgcacccccaaggccaagcgggggacggcccagatcatggaggtcaccgcgaagtggctgtggggcttcctgagccgcaacaagaagccgcggatctgcacccgcgaggagttcacccggaaggtgcgctccaacgccgccatcggcgccgtgttcgtcgacgagaaccagtggaacagcgcgaaggaggccgtggaggacgagcggttctgggacctcgtgcaccgcgagcgggagctgcacaagcaggggaagtgcgccacgtgcgtctacaacatgatgggcaagcgcgagaagaagctgggggagttcggcaaggccaaggggtcccgggccatctggtacatgtggctcggcgcgcgcttcctggagttcgaggccctgggcttcatgaacgaggaccactggttcagccgggagaactccctcagcggggtggagggcgaggggctgcacaagctgggctacatcctccgcgacatctccaagatccccgggggcaacatgtacgccgacgacaccgccggctgggacacccggatcaccgaggacgacctgcagaacgaggccaagatcacggacatcatggagcccgagcacgcgctgctcgccaagagcatcttcaagctgacctaccagaacaaggtggtccgcgtgcagcggccggccaagaacgggaccgtgatggacgtcatctcccgccgcgaccagcggggcagcggccaggtgggcacctacggcctgaacacgttcaccaacatggaggcccagctcatccgccagatggagtccgaggggatcttcagcccctccgagctggagacccccaacctggcccggcgcgtgctcgactggctggagaagcacggcgtcgagcggctgaagcgcatggcgatcagcggggacgactgcgtggtgaagcccatcgacgaccggttcgccaccgccctcacggccctgaacgacatgggcaaggtccgcaaggacatcccgcagtgggagcccagcaaggggtggaacgactggcagcaggtccccttctgctcccaccacttccaccagctgatcatgaaggacggccgggagatcgtggtcccctgccgcaaccaggacgagctcgtgggccgggcccgcgtgagccagggggcgggctggtccctgcgggagaccgcctgcctgggcaagagctacgcccagatgtggcagctcatgtacttccaccgccgggacctgcgcctggccgcgaacgccatctgctccgccgtcccggtggactgggtgcccaccagccggaccacgtggtccatccacgcccaccaccagtggatgaccaccgaggacatgctcagcgtctggaaccgcgtgtggatcgaggagaacccctggatggaggacaagacccacatctccagctggggcgacgtgccctacctggggaagcgggaggaccagtggtgcggctccctgatcggcctcacggcccgcgcgacctgggccaccaacatccaggtcgccatcaaccaggtgcgccggctgatcgggaacgagaactacctggactacatgaccagcatgaagcgcttcaagaacgagtccgacccggagggcgccctctggtga

SEQ ID NO: 8527 - RNA, 9879 nt, synthetic construct
  misc_feature 1..9879: note = derived and/or modified CDS sequence (opt1) from DENV-1__FJ882553__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgagaccgagcccgacgacgtggactgctggtgcaacgccacggacacctgggtgacctacgggacctgcagccagacgggcgagcaccggcgcgacaagcggtccgtggccctcgcgccccacgtgggcctggggctggagacccgcaccgagacctggatgagctccgagggcgcctggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcgtgatcggcgccggcgagaaggcgctgaagctcagctggttccgcaaggggtccagcatcggcaagatgttcgaggccacggcccgcggggcccgccgcatggccatcctgggcgacaccgcgtgggacttcgggtccatcggcggcgtgttcaccagcgtcgggaagctggtgcaccagatcttcggcaccgcctacggggtgctgttctccggcgtcagctggacgatgaagatcgggatcggcgtgctgctgacctggctcggcctgaactcccggagcacctccctgagcatgacctgcatcgccgtggggctcgtcacgctgtacctgggcgtgatggtgcaggccgactccgggtgcgtcatcaactggaagggccgcgagctcaagtgcgggagcggcatcttcgtgaccaacgaggtgcacacctggaccgagcagtacaagttccaggccgacagcccgaagcggctgtccgcggccatcggcaaggcctgggaggagggggtctgcggcatccgcagcgccacccggctggagaacatcatgtggaagcagatctccaacgagctcaaccacatcctgctggagaacgacatgaagttcacggtggtggtcggggacgtggccggcatcctcgcgcaggggaagaagatgatccgcccccagcccatggagtacaagtacagctggaagtcctggggcaaggccaagatcatcggcgccgacgtgcagaacaccaccttcatcatcgacgggcccaacaccccggagtgccccgacgaccagcgggcctggaacatctgggaggtcgaggactacggcttcgggatcttcacgaccaacatctggctgaagctgcgcgacagctacacccaggtgtgcgaccaccggctcatgtccgcggccatcaaggacagcaaggccgtgcacgccgacatgggctactggatcgagtccgagaagaacgagacctggaagctggcccgcgcgagcttcatcgaggtcaagacgtgcatctggcccaagtcccacaccctgtggagcaacggcgtgctcgagtccgagatgatcatccccaagatctacgggggcccgatcagccagcacaactaccggcccgggtacttcacccagaccgccggcccctggcacctggggaagctggagctcgacttcgacctgtgcgagggcacgaccgtggtcgtggacgagcactgcggcaaccgcgggccgtccctgcggaccaccacggtgaccggcaagatcatccacgagtggtgctgccgcagctgcaccctgccgcccctccggttccgcggggaggacggctgctggtacgggatggagatccggcccgtcaaggagaaggaggagaacctggtgaagtccatggtgagcgccggcagcggcgaggtcgactccttcagcctcgggctgctgtgcatctccatcatgatcgaggaggtgatgcgcagccggtggtcccgcaagatgctcatgaccggcacgctggccgtgttcttcctgctcatcatggggcagctgacctggaacgacctgatccgcctctgcatcatggtcggcgccaacgcgagcgaccggatggggatgggcaccacctacctggccctgatggccacgttcaagatgcgcccgatgttcgccgtgggcctcctgttccggcgcctgacctcccgggaggtgctcctgctgaccatcgggctcagcctggtcgcctccgtggagctgcccaacagcctcgaggagctgggcgacgggctggcgatgggcatcatgatcctcaagctgctgaccgacttccagtcccaccagctctgggccacgctgctgagcctcaccttcatcaagaccaccttctccctgcactacgcctggaagacgatggccatggtcctgagcatcgtgtccctcttccccctgtgcctgagcaccacctcccagaagaccacgtggctccccgtgctgctgggcagcctcgggtgcaagccgctgaccatgttcctgatcgcggagaacaagatctggggccgccggtcctggcccctcaacgaggggatcatggccgtcggcatcgtgagcatcctgctgagctccctcctgaagaacgacgtgcccctggccgggcccctcatcgccggcggcatgctgatcgcctgctacgtcatcagcgggtccagcgcggacctgtccctcgagaaggccgccgaggtgagctgggaggaggaggccgagcactccggcgccagccacaacatcctggtggaggtccaggacgacgggaccatgaagatcaaggacgaggagcgcgacgacaccctgaccatcctcctgaaggcgacgctgctcgccgtgtccggcgtgtacccgctgagcatccccgccaccctgttcgtctggtacttctggcagaagaagaagcagcggtccggggtgctctgggacacccccagcccgcccgaggtggagcgcgccgtcctggacgacggcatctaccggatcatgcagcgcggcctgctggggcggtcccaggtgggcgtgggggtcttccaggagaacgtgttccacaccatgtggcacgtgacgcgcggcgccgtcctcatgtaccaggggaagcggctggagcccagctgggcgtccgtgaagaaggacctgatcagctacggcggcgggtggcgcctccagggctcctggaacaccggggaggaggtgcaggtcatcgccgtggagcccggcaagaaccccaagaacgtgcagaccgcccccgggaccttcaagacgcccgagggcgaggtcggcgccatcgccctggacttcaagcccgggaccagcggctcccccatcgtgaaccgggaggggaagatcgtgggcctgtacggcaacggggtcgtgaccaccagcggcacgtacgtgagcgcgatcgcccaggccaaggcctcccaggaggggccgctccccgagatcgaggacgaggtcttccgcaagcggaacctgaccatcatggacctgcaccccggcagcgggaagacccgccggtacctcccggcgatcgtgcgcgaggccatcaagcgcaagctgcggaccctgatcctcgcccccacgcgcgtggtcgcctccgagatggccgaggcgctgaagggcatgcccatccggtaccagaccaccgccgtcaagagcgagcacaccggcaaggagatcgtggacctgatgtgccacgccacgttcaccatgcgcctcctgtcccccgtccgggtgccgaactacaacatgatcatcatggacgaggcccacttcaccgaccccagctccatcgccgcgcgcgggtacatcagcacccgggtgggcatgggggaggccgccgccatcttcatgacggccacgccgcccggctccgtcgaggcgttcccgcagagcaacgccgtgatccaggacgaggagcgcgacatccccgagcggtcctggaacagcgggtacgagtggatcaccgacttccccggcaagaccgtgtggttcgtcccctccatcaagagcggcaacgacatcgccaactgcctgcgcaagaacgggaagcgggtgatccagctctcccgcaagacgttcgacaccgagtaccagaagaccaagaacaacgactgggactacgtggtcaccacggacatcagcgagatgggcgccaacttccgggcggaccgcgtgatcgacccgcggcgctgcctgaagcccgtgatcctgaaggacgggcccgagcgggtcatcctcgccggccccatgccggtgaccgtcgcctccgccgcccagcgccgggggcgcatcggccgcaaccacaacaaggagggcgaccagtacatctacatggggcagcccctgaacaacgacgaggaccacgcgcactggaccgaggccaagatgctgctcgacaacatcaacacccccgagggcatcatccccgccctgttcgagccggagcgggagaagtccgccgccatcgacggggagtaccgcctgcggggcgaggcgcgcaagacgttcgtggagctcatgcggcgcggggacctgcccgtgtggctgtcctacaaggtcgccagcgagggcttccagtacagcgaccggcgctggtgcttcgacggcgagcggaacaaccaggtgctcgaggagaacatggacgtggagatctggaccaaggagggggagcgcaagaagctgcggccccgctggctggacgcccggacctactccgaccccctcgccctgcgcgagttcaaggagttcgccgcgggccggcgcagcgtctccggggacctgatcctcgagatcggcaagctgccgcagcacctgacccagcgggcccagaacgccctcgacaacctggtgatgctgcacaacagcgagcagggcgggcgcgcctaccggcacgcgatggaggagctccccgacacgatcgagaccctgatgctgctcgccctgatcgccgtgctgaccggcggggtcaccctcttcttcctgtccggccgcgggctgggcaagaccagcatcggcctcctgtgcgtgatggcctccagcgtgctgctctggatggcctccgtcgagccccactggatcgcggccagcatcatcctggagttcttcctgatggtgctcctgatccccgagccggaccggcagcgcacgccccaggacaaccagctggcctacgtggtcatcgggctcctgttcatgatcctgaccgtggccgccaacgagatgggcctcctggagaccaccaagaaggacctggggatcggccacgtggcggtcgagaaccaccaccacgccgccatgctcgacgtggacctgcaccccgcctccgcctggacgctgtacgcggtggccaccaccatcatcaccccgatgatgcgccacacgatcgagaacaccaccgccaacatcagcctcaccgccatcgccaaccaggcggccatcctgatggggctggacaagggctggcccatctccaagatggacatcggcgtccccctcctggccctggggtgctacagccaggtgaaccccctcacgctgaccgccgcggtgctgatgctcgtcgcccactacgccatcatcggcccggggctgcaggccaaggccacccgggaggcgcagaagcgcaccgccgccggcatcatgaagaaccccacggtggacgggatcgtggccatcgacctggaccccgtcgtgtacgacgccaagttcgagaagcagctcggccagatcatgctgctgatcctctgcacctcccagatcctgctgatgcggaccacctgggcgctctgcgagagcatcacgctggccaccggccccctgaccaccctctgggaggggtccccgggcaagttctggaacacgaccatcgccgtgagcatggccaacatcttccgcgggtcctacctggccggcgcgggcctggccttcagcctcatgaagtccctcgggggcgggcggcgcgggaccggggcccagggcgagaccctgggcgagaagtggaagcggcagctcaaccagctgtccaagagcgagttcaacacgtacaagcgctccgggatcatggaggtcgaccggagcgaggccaaggagggcctgaagcgcggggagaccaccaagcacgcggtgtcccggggcaccgccaagctccgctggttcgtggagcggaacctggtcaagcccgaggggaaggtgatcgacctgggctgcggccgcgggggctggagctactactgcgccgggctgaagaaggtgacggaggtcaagggctacaccaagggcgggcccggccacgaggagcccatcccgatggccacctacgggtggaacctcgtgaagctgcactccggcaaggacgtgttcttcatcccgcccgagaagtgcgacaccctgctctgcgacatcggggagagctcccccaacccgacgatcgaggagggccggaccctgcgcgtcctgaagatggtggagccctggctccgggggaaccagttctgcatcaagatcctgaacccctacatgcccagcgtggtcgagaccctggagcagatgcagcgcaagcacggcggcatgctcgtgcggaacccgctgtcccgcaacagcacccacgagatgtactgggtgtcctgcgggaccggcaacatcgtcagcgccgtgaacatgacgtcccgcatgctgctcaaccggttcaccatggcgcaccgcaagcccacctacgagcgggacgtggacctgggggccggcacccgccacgtcgccgtggagcccgaggtggccaacctggacatcatcggccagcggatcgagaacatcaagcacgagcacaagagcacgtggcactacgacgaggacaacccctacaagacctgggcctaccacgggtcctacgaggtcaagccgagcggctccgcgagcagcatggtgaacggggtcgtgaagctcctgaccaagccctgggacgtgatccccatggtcacccagatcgccatgacggacaccacccccttcggccagcagcgcgtgttcaaggagaaggtggacacccggacgccgaaggccaagcgcgggaccgcccagatcatggaggtcaccgccaagtggctgtggggcttcctctcccggaacaagaagccccgcatctgcacccgggaggagttcacgcgcaaggtgcggagcaacgcggccatcggcgccgtgttcgtcgacgagaaccagtggaactccgccaaggaggcggtggaggacgagcgcttctgggacctggtgcaccgggagcgcgagctgcacaagcaggggaagtgcgcgacctgcgtctacaacatgatgggcaagcgggagaagaagctcggggagttcggcaaggccaaggggagccgcgccatctggtacatgtggctgggcgcccggttcctggagttcgaggcgctcggcttcatgaacgaggaccactggttctcccgcgagaacagcctgtccggggtggagggcgaggggctgcacaagctcggctacatcctgcgggacatcagcaagatccccgggggcaacatgtacgccgacgacaccgccggctgggacacccgcatcacggaggacgacctgcagaacgaggcccgcatcaccgacatcatggagccggagcacgccctcctggcgaagtccatcttcaagctgacctaccagaacaaggtggtccgggtgcagcgccccgccaagaacgggaccgtgatggacgtcatcagccggcgcgaccagcggggctccggccaggtgggcacgtacggcctcaacaccttcaccaacatggaggcccagctgatccgccagatggagagcgaggggatcttctcccccagcgagctggagacccccaacctcgccgagcgggtgctggactggctggagaagtacggcgtcgagcgcctcaagcggatggccatctccggggacgactgcgtggtgaagccgatcgacgaccgcttcgcgacggccctgaccgccctgaacgacatgggcaaggtccggaaggacatcccccagtgggagcccagcaaggggtggaacgactggcagcaggtccccttctgctcccaccacttccaccagctcatcatgaaggacggccgcgagatcgtggtcccgtgccggaaccaggacgagctggtgggccgcgcccgggtgagccagggggccggctggagcctgcgcgagaccgcgtgcctcgggaagtcctacgcccagatgtggcagctgatgtacttccaccggcgcgacctgcggctcgccgccaacgcgatctgcagcgccgtccccgtggactggatccccacctcccgcacgacctggagcatccacgcccaccaccagtggatgaccaccgaggacatgctgtccgtgtggaaccgcgtctggatcgaggagaacccctggatggaggacaagacgcacatcagctcctggggcgacgtgccgtacctggggaagcgggaggaccagtggtgcggcagcctcatcggcctgaccgcccgcgccacctgggcgaccaacatccaggtggccatcaaccaggtccggcgcctgatcgggaacgagaactacctcgactacatgacctccatgaagcggttcaagaacgagagcgagcccgagggcgccctgtggtga

SEQ ID NO: 8528 - RNA, 9879 nt, synthetic construct
  misc_feature 1..9879: note = derived and/or modified CDS sequence (opt1) from DENV-1__FJ882554__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagacctccgccggggtgaacatgtgcaccctcatcgccatggacctgggcgagctgtgcgaggacacgatgacctacaagtgcccccgcatcaccgagaccgagcccgacgacgtggactgctggtgcaacgccacggacacctgggtgacctacgggacctgcagccagacgggcgagcaccggcgcgacaagcggtccgtggccctcgcgccccacgtgggcctggggctggagacccgcaccgagacctggatgagctccgagggcgcgtggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcctgacgcaggacgagaagggggtgacccagaacggccggctgatcaccgccaacccgatcgtgaccgacaaggagaagcccgtcaacatcgaggccgagccgcccttcggggagagctacatcgtgatcggcgccggcgagaaggcgctcaagctgtcctggttcaagaaggggagctccatcggcaagatgttcgaggccacggcccgcggggcccggcgcatggccatcctgggcgacaccgcgtgggacttcgggagcatcggcggcgtgttcacctccgtcgggaagctcgtgcaccagatcttcggcaccgcctacggggtgctgttcagcggcgtctcctggacgatgaagatcgggatcggcgtgctgctcacctggctgggcctgaacagccgctccaccagcctctccatgacctgcatcgccgtggggctggtcacgctgtacctcggcgtgatggtgcaggccgacagcgggtgcgtcatcaactggaagggccgggagctgaagtgcgggtccggcatcttcgtgaccaacgaggtgcacacctggaccgagcagtacaagttccaggccgacagcccgaagcgcctgagcgcggccatcggcaaggcctgggaggagggggtctgcggcatccggtccgccacccgcctcgagaacatcatgtggaagcagatcagcaacgagctgaaccacatcctgctcgagaacgacatgaagttcacggtggtggtcggggacgtggccggcatcctggcgcaggggaagaagatgatccggccccagcccatggagtacaagtactcctggaagtcctggggcaaggccaagatcatcggcgccgacgtgcagaacaccaccttcatcatcgacgggcccaacaccccggagtgccccgacgaccagcgcgcctggaacatctgggaggtcgaggactacggcttcgggatcttcacgaccaacatctggctgaagctccgggactcctacacccaggtgtgcgaccaccgcctgatgagcgcggccatcaaggactccaaggccgtgcacgccgacatgggctactggatcgagagcgagaagaacgagacctggaagctggcccgggcgtccttcatcgaggtcaagacgtgcatctggcccaagagccacaccctctggtccaacggcgtgctggagagcgagatgatcatccccaagatctacgggggcccgatctcccagcacaactaccgccccgggtacttcacccaggccgccggcccctggcacctggggaagctcgagctggacttcgacctgtgcgagggcaccacggtggtcgtggacgagcactgcggcaaccgggggccgagcctccgcaccaccaccgtgacgggcaagatcatccacgagtggtgctgccggtcctgcaccctgccgcccctgcgcttccgcggggaggacggctgctggtacgggatggagatccgccccgtcaaggagaaggaggagaacctcgtcaagagcatggtgtccgccggcagcggcgaggtcgacagcttctccctggggctgctctgcatcagcatcatgatcgaggaggtgatgcggtcccgctggagccggcgcatgctgatgaccggcaccctggccgtgttcttcctcctgatcatggggcagctgacgtggaacgacctcatccgcctgtgcatcatggtcggcgcgaacgcctccgaccggatggggatgggcaccacctacctggccctcatggccaccttcaagatgcgcccgatgttcgccgtgggcctgctgttccggcgcctcacgagccgggaggtgctgctgctcaccatcgggctgtccctggtcgcgagcgtggagctccccaactccctggaggagctgggcgacgggctcgccatgggcatcatgatcctgaagctgctcaccgacttccagagccaccagctgtgggccaccctgctctccctgacgttcatcaagaccaccttcagcctgcactacgcctggaagaccatggcgatggtcctctccatcgtgagcctgttccccctgtgcctctccacgaccagccagaagaccacctggctgcccgtgctgctcggctccctggggtgcaagccgctgacgatgttcctcatcgccgagaacaagatctggggccgccggagctggcccctgaacgaggggatcatggccgtcggcatcgtgtccatcctgctcagcagcctgctgaagaacgacgtgcccctcgccgggcccctgatcgccggcggcatgctgatcgcgtgctacgtcatctccgggagctccgccgacctcagcctggagaaggccgccgaggtgtcctgggaggaggaggccgagcacagcggcgcgtcccacaacatcctggtggaggtccaggacgacgggaccatgaagatcaaggacgaggagcgcgacgacaccctcaccatcctgctgaaggccaccctcctggccgtgagcggcgtgtacccgctgtccatccccgccaccctgttcgtctggtacttctggcagaagaagaagcagcggagcggggtgctgtgggacacccccagcccgcccgaggtggagcgcgccgtcctggacgacggcatctaccggatcatgcagcgcggcctgctcgggcggagccaggtgggcgtgggggtcttccaggagaacgtgttccacaccatgtggcacgtgacccgcggcgcggtcctgatgtaccaggggaagcggctggagccctcctgggccagcgtgaagaaggacctcatctcctacggcggcgggtggcgcctgcagggcagctggaacacgggggaggaggtgcaggtcatcgccgtggagcccggcaagaaccccaagaacgtgcagaccgcccccgggaccttcaagacccccgagggcgaggtcggcgccatcgcgctggacttcaagcccgggacgtccggcagccccatcgtgaaccgggaggggaagatcgtgggcctctacggcaacggggtcgtgaccacctccggcacctacgtgagcgccatcgcccaggccaaggcgagccaggaggggccgctgcccgagatcgaggacgaggtcttccgcaagcggaacctgacgatcatggacctccaccccggctccgggaagacccgccggtacctgccggccatcgtgcgcgaggccatcaagcgcaagctgcggaccctcatcctggcccccacccgcgtggtcgccagcgagatggcggaggccctgaagggcatgcccatccggtaccagacgaccgccgtgaagtccgagcacaccggcaaggagatcgtggacctcatgtgccacgccaccttcacgatgcgcctgctgagccccgtccgggtgccgaactacaacatgatcatcatggacgaggcccacttcaccgacccctactccatcgcggcccgcgggtacatcagcacccgggtgggcatgggggaggccgccgccatcttcatgaccgcgacgccgcccggctccgtcgaggccttcccgcagagcaacgccgtgatcaaggacgaggagcgcgacatccccgagcggtcctggaacagcgggtacgagtggatcaccgacttccccggcaagaccgtgtggttcgtcccctccatcaagagcggcaacgacatcgccaactgcctccgcaagaacgggaagcgggtgatccagctgtcccgcaagaccttcgacacggagtaccagaagaccaagaacaacgactgggactacgtggtcaccaccgacatcagcgagatgggcgcgaacttccgggccgaccgcgtgatcgacccgcggcgctgcctgaagcccgtgatcctcaaggacgggcccgagcgggtcatcctggccggccccatgccggtgacggtcgcctccgccgcgcagcgccgggggcgcatcggccgcaaccacaacaaggagggcgaccagtacatctacatggggcagcccctgaacaacgacgaggaccacgcccactggaccgaggccaagatgctcctggacaacatcaacacccccgagggcatcatccccgccctgttcgagccggagcgggagaagtccgccgcgatcgacggggagtaccgcctccggggcgaggcccgcaagaccttcgtggagctgatgcggcgcggggacctgcccgtgtggctctcctacaaggtcgccagcgagggcttccagtactccgaccggcgctggtgcttcgacggcgagcggaacaaccaggtgctggaggagaacatggacgtggagatctggacgaaggagggggagcgcaagaagctgcggccccgctggctcgacgcccggacctacagcgaccccctggccctgcgcgagttcaaggagttcgcggccggccggcgcagcgtctccggggacctcatcctggagatcggcaagctgccgcagcacctcacccagcgggcccagaacgccctggacaacctggtgatgctccacaacagcgagcagggcgggcgcgcgtaccggcacgccatggaggagctgcccgacaccatcgagacgctgatgctcctggccctgatcgccgtgctcaccggcggggtcaccctgttcttcctgtccggccgcgggctcggcaagaccagcatcggcctgctgtgcgtgatggcctccagcgtgctcctgtggatggcgtccgtcgagccccactggatcgccgccagcatcatcctggagttcttcctcatggtgctgctgatccccgagccggaccggcagcgcacgccccaggacaaccagctcgcctacgtggtcatcgggctgctgttcatgatcctcacggtggccgcgaacgagatgggcctgctggagaccaccaagaaggacctcgggatcggccacgtggccgtcgagaaccaccaccacgccgccatgctggacgtggacctgcaccccgcctccgcgtggaccctctacgccgtggccacgaccatcatcaccccgatgatgcgccacaccatcgagaacacgaccgccaacatcagcctgaccgccatcgcgaaccaggccgccatcctgatggggctcgacaagggctggcccatctccaagatggacatcggcgtccccctgctggccctcgggtgctacagccaggtgaaccccctgaccctgacggcggccgtgctcatgctggtcgcccactacgccatcatcggcccggggctgcaggccaaggcgacccgggaggcccagaagcgcaccgccgccggcatcatgaagaaccccaccgtggacgggatcgtggccatcgacctcgaccccgtcgtgtacgacgcgaagttcgagaagcagctgggccagatcatgctgctcatcctgtgcacgtcccagatcctgctcatgcggaccacctgggccctgtgcgagagcatcaccctggccacgggccccctcaccaccctgtgggaggggtccccgggcaagttctggaacaccacgatcgccgtgagcatggccaacatcttccgcgggtcctacctggcgggcgccggcctcgccttcagcctgatgaagtccctcgggggcgggcggcgcgggaccggggcccagggcgagaccctcggcgagaagtggaagcggcagctgaaccagctgagcaagagcgagttcaacacctacaagcgctccgggatcatggaggtcgaccggagcgaggcgaaggagggcctcaagcgcggggagacgaccaagcacgccgtgtcccggggcaccgccaagctgcgctggttcgtggagcggaacctggtcaagcccgaggggaaggtgatcgacctgggctgcggccgcgggggctggagctactactgcgccgggctcaagaaggtgaccgaggtcaagggctacacgaagggcgggcccggccacgaggagcccatcccgatggccacctacgggtggaacctggtgaagctgcactccggcaaggacgtgttcttcatcccgcccgagaagtgcgacaccctcctgtgcgacatcggggagagctcccccaacccgaccatcgaggagggccggacgctgcgcgtcctcaagatggtggagccctggctgcgggggaaccagttctgcatcaagatcctgaacccctacatgcccagcgtggtcgagaccctcgagcagatgcagcgcaagcacggcggcatgctggtgcggaacccgctgtcccgcaacagcacccacgagatgtactgggtgtcctgcgggaccggcaacatcgtcagcgcggtgaacatgacctcccgcatgctcctgaaccggttcacgatggcccaccgcaagcccacctacgagcgggacgtggacctgggggccggcacccgccacgtcgccgtggagcccgaggtggccaacctcgacatcatcggccagcggatcgagaacatcaagcacgagcacaagagcacctggcactacgacgaggacaacccctacaagacgtgggcgtaccacgggtcctacgaggtcaagccgagcggctccgccagctccatggtgaacggggtcgtgaagctgctgaccaagccctgggacgtgatccccatggtcacccagatcgccatgaccgacacgacccccttcggccagcagcgcgtgttcaaggagaaggtggacacccggaccccgaaggccaagcgcgggacggcccagatcatggaggtcaccgcgaagtggctctggggcttcctgagccggaacaagaagccccgcatctgcacccgggaggagttcacccgcaaggtgcggagcaacgccgccatcggcgccgtgttcgtcgacgagaaccagtggaactccgcgaaggaggccgtggaggacgagcgcttctgggacctggtgcaccgggagcgcgagctccacaagcaggggaagtgcgccacgtgcgtctacaacatgatgggcaagcgggagaagaagctgggggagttcggcaaggccaaggggagccgcgccatctggtacatgtggctgggcgcgcggttcctcgagttcgaggccctgggcttcatgaacgaggaccactggttctcccgcgagaacagcctgtccggggtggagggcgaggggctccacaagctgggctacatcctgcgggacatcagcaagatccccgggggcaacatgtacgccgacgacaccgccggctgggacacccgcatcaccgaggacgacctccagaacgaggcccgcatcacggacatcatggagccggagcacgcgctgctggccaagtccatcttcaagctcacctaccagaacaaggtggtccgggtgcagcgccccgccaagaacgggaccgtgatggacgtcatcagccggcgcgaccagcggggctccggccaggtggggacctacggcctgaacacgttcaccaacatggaggcccagctgatccgccagatggagagcgaggggatcttctcccccagcgagctcgagacccccaacctggccgagcgggtgctggactggctcgagaagtacggcgtcgagcgcctgaagcggatggcgatctccggggacgactgcgtggtgaagccgatcgacgaccgcttcgccaccgccctgacggccctcaacgacatgggcaaggtccggaaggacatcccccagtgggagcccagcaaggggtggaacgactggcagcaggtccccttctgctcccaccacttccaccagctgatcatgaaggacggccgcgagatcgtggtcccgtgccggaaccaggacgagctggtgggccgcgcccgggtgagccagggggcgggctggtccctccgcgagaccgcctgcctgggcaagagctacgcccagatgtggcagctgatgtacttccaccggcgcgacctccggctggccgcgaacgccatctgcagcgccgtccccgtggactggatccccacctcccgcaccacgtggagcatccacgcccaccaccagtggatgaccaccgaggacatgctgtccgtgtggaaccgcgtctggatcgaggagaacccctggatggaggacaagacccacatcagctcctggggcgacgtgccgtacctcgggaagcgggaggaccagtggtgcggcagcctgatcggcctgacggcccgcgcgacctgggccaccaacatccaggtggccatcaaccaggtccggcgcctcatcgggaacgagaactacctggactacatgacctccatgaagcggttcaagaacgagagcgaccccgagggcgccctgtggtga

SEQ ID NO: 8529 - RNA, 9879 nt, synthetic construct
  misc_feature 1..9879: note = derived and/or modified CDS sequence (opt1) from DENV-1__GQ868610__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgcgggggtgaacatgtgcaccctcatcgccatggacctgggcgagctgtgcgaggacaccatgacctacaagtgcccccggatcaccgaggccgagcccgacgacgtggactgctggtgcaacgccacggacacctgggtgacctacgggacctgcagccagacgggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtggggaagctggtccaccagatcttcggcaccgcctacggggtgctgttctccggcgtgagctggaccatgaagatcgggatcggcgtcctgctgacgtggctcggcctgaactcccgcagcacctccctgagcatgacctgcatcgccgtggggctcatcaccctgtacctgggcgtgatggtccaggccgactccgggtgcgtgatcaactggaagggccgggagctcaagtgcgggagcggcatcttcgtgacgaacgaggtccacacctggaccgagcagtacaagttccaggcggacagcccgaagcgcctgtccgccgccatcggcaaggcctgggaggagggggtgtgcggcatccggagcgccacccgcctggagaacatcatgtggaagcagatctccaacgagctcaaccacatcctgctggagaacgacatgaagttcaccgtggtcgtgggggacgtggtcggcatcctcgcgcaggggaagaagatgatccggccccagcccatggagcacaagtacagctggaagtcctggggcaaggccaagatcatcggcgccgacgtgcagaacacgaccttcatcatcgacgggcccaacaccccggagtgccccgacgaccagcgcgcctggaacatctgggaggtggaggactacggcttcgggatcttcaccacgaacatctggctgaagctgcgggacagctacacccaggtctgcgaccaccgcctcatgtccgcggccatcaaggacagcaaggccgtgcacgccgacatgggctactggatcgagtccgagaagaacgagacctggaagctggcccgggcgagcttcatcgaggtgaagacctgcatctggcccaagtcccacacgctgtggagcaacggcgtcctcgagtccgagatgatcatccccaagatctacgggggcccgatcagccagcacaactaccgccccgggtacttcacccagaccgccggcccctggcacctggggaagctggagctcgacttcgacctgtgcgagggcaccacggtggtggtcgacgagcactgcggcaaccgggggccgtccctgcgcaccaccaccgtgacgggcaagatcatccacgagtggtgctgccggagctgcaccctgccgcccctccgcttcaagggggaggacggctgctggtacgggatggagatccggcccgtgaaggagaaggaggagaacctggtcaagtccatggtgagcgccggcagcggcgaggtggactccttcagcctcgggctgctgtgcatctccatcatgatcgaggaggtcatgcgcagccggtggtcccgcaagatgctcatgaccggcaccctggccgtgttcctgctcctgatcatggggcagctgacgtggaacgacctcatccggctgtgcatcatggtgggcgccaacgcgagcgaccgcatggggatgggcaccacctacctggccctcatcgccaccttcaagatgcgcccgatgttcgccgtcgggctgctgttccggcgcctcacgtcccgggaggtgctgctgctcaccatcgggctgagcctggtggcctccgtcgagctccccaacagcctggaggagctgggcgacgggctcgcgatgggcatcatgatcctgaagctgctcaccgacttccagtcccaccagctgtgggccaccctgctcagcttcacgttcatcaagaccaccctgtccctgcactacgcctggaagaccatggccatggtgctcagcatcgtctccctgttccccctgtgcctcagcacgacctcccagaagaccacctggctgcccgtgctgctcggcagcctggggtgcaagccgctgacgatgttcctcatcgcggagaacaagatctggggccgcaagtcctggcccctgaacgaggggatcatggccgtgggcgtcgtgagcatcctgctcagctccctgctgaagaacgacgtgcccctcgccgggcccctgatcgccggcggcatgctgatcgcctgctacgtcatcagcgggtccagcgcggacctctccctggagaaggccgccgaggtgagctgggaggaggaggccgagcactccggcgccagccacaacatcctggtggaggtccaggacgacgggaccatgaagatcaaggacgaggagcgggacgacaccctcaccatcctgctgaaggcgaccctcctggccgtgtccggcgtgtacccgctgagcatccccgccaccctcttcgtctggtacttctggcagaagaagaagcagcgctccggggtgctgtgggacacccccagcccgcccgaggtggagcgggccgtcctggacgacggcatctaccgcatcatgcagcggggcctgctcgggcgctcccaggtgggcgtgggggtcttccaggagaacgtgttccacaccatgtggcacgtgacccggggcgccgtcctgatgtaccaggggaagcgcctggagcccagctgggcgtccgtgaagaaggacctcatcagctacggcggcgggtggcggctgcagggctcctggaacacgggggaggaggtgcaggtcatcgccgtggagcccggcaagaaccccaagaacgtgcagaccgcccccgggaccttcaagacccccgagggcgaggtcggcgccatcgccctggacttcaagcccgggacgagcggctcccccatcgtgaaccgcgaggggaagatcgtgggcctctacggcaacggggtcgtgaccaccagcggcacctacgtgagcgcgatcgcccaggccaaggcctcccaggaggggccgctgcccgagatcgaggacgaggtcttccggaagcgcaacctgacgatcatggacctccaccccggcagcgggaagacccggcgctacctgccggcgatcgtgcgggaggccatcaagcgcaagctgcggaccctcatcctggcccccacccgcgtggtcgcctccgagatggccgaggcgctgaagggcatgcccatccgctaccagacgaccgccgtcaagagcgagcacaccggcaaggagatcgtggacctcatgtgccacgccaccttcacgatgcggctgctgtcccccgtccgcgtgccgaactacaacatgatcatcatggacgaggcccacttcaccgaccccagctccatcgccgcgcgggggtacatcagcacccgcgtgggcatgggggaggccgccgccatcttcatgaccgccacgccgcccggctccgtcgaggcgttcccgcagagcaacgccgtgatccaggacgaggagcgggacatccccgagcgctcctggaacagcgggtacgagtggatcaccgacttccccggcaagaccgtgtggttcgtcccctccatcaagagcggcaacgacatcgccaactgcctccggaagaacgggaagcgcgtgatccagctgtcccggaagaccttcgacacggagtaccagaagaccaagaacaacgactgggactacgtggtcaccaccgacatcagcgagatgggcgccaacttccgcgcggaccgggtgatcgacccgcgccggtgcctgaagcccgtgatcctcaaggacgggcccgagcgcgtcatcctggccggccccatgccggtgacggtcgcctccgccgcccagcggcgcgggcggatcggccgcaaccacaacaaggagggcgaccagtacatctacatggggcagcccctgaacaacgacgaggaccacgcgcactggaccgaggccaagatgctcctggacaacatcaacacccccgagggcatcatccccgccctgttcgagccggagcgggagaagtccgccgccatcgacggggagtaccgcctccgcggcgaggcgcggaagaccttcgtggagctgatgcgccgcggggacctgcccgtgtggctctcctacaaggtcgccagcgagggcttccagtacagcgaccgccggtggtgcttcgacggcgagcgcaacaaccaggtgctggaggagaacatggacgtggagatctggacgaaggagggggagcggaagaagctgcgcccccggtggctcgacgcccgcacctactccgaccccctggccctgcgggagttcaaggagttcgccgcgggccgccggagcgtctccggggacctcatcctggagatcggcaagctgccgcagcacctcacccagcgcgcccagaacgccctggacaacctggtgatgctccacaacagcgagcagggcgggcgggcctaccgccacgcgatggaggagctgcccgacaccatcgagacgctgatgctcctggccctgatcgccgtgctcaccggcggggtcaccctgttcttcctgtccggccgggggctcggcaagaccagcatcggcctgctgtgcgtgatggcctccagcgtgctcctgtggatggcctccgtcgagccccactggatcgcggccagcatcatcctggagttcttcctcatggtgctgctgatccccgagccggaccgccagcggacgccccaggacaaccagctcgcctacgtggtcatcgggctgctgttcatgatcctcacggtggccgccaacgagatgggcctgctggagaccaccaagaaggacctcgggatcggccacgtggcggtcgagaaccaccaccacgccaccatgctggacgtggacctgcaccccgcctccgcctggacgctctacgccgtggcgaccaccatcatcaccccgatgatgcgccacacgatcgagaacaccaccgccaacatcagcctgaccgccatcgccaaccaggccgcgatcctgatggggctcgacaagggctggcccatctccaagatggacatcggcgtccccctgctggccctcgggtgctacagccaggtgaaccccctgacgctgaccgccgccgtgctcatgctggtcgcgcactacgccatcatcggcccggggctgcaggccaaggccacccgggaggcccagaagcgcaccgcggccggcatcatgaagaaccccacggtggacgggatcgtggccatcgacctcgaccccgtcgtgtacgacgccaagttcgagaagcagctgggccagatcatgctgctcatcctgtgcacctcccagatcctgctcatgcgcaccacctgggccctgtgcgagagcatcacgctggcgaccggccccctcaccaccctgtgggaggggtccccgggcaagttctggaacacgaccatcgccgtgagcatggccaacatcttccgggggtcctacctggccggcgccggcctcgcgttcagcctgatgaagtccctcgggggcgggcgccgggggaccggggcccagggcgagaccctcggcgagaagtggaagcgccagctgaaccagctgtccaagagcgagttcaacacgtacaagcggtccgggatcatggaggtcgaccgcagcgaggccaaggagggcctcaagcgcggggagaccacccgccacgccgtgtcccggggcaccgcgaagctgcgctggttcgtggagcggaacctggtcaagcccgaggggaaggtgatcgacctgggctgcggccgcgggggctggagctactactgcgccgggctcaagaaggtgacggaggtcaagggctacaccaagggcgggcccggccacgaggagcccatcccgatggccacctacgggtggaacctggtgaagctgcactccggcaaggacgtgttcttcacgccgcccgagaagtgcgacacgctcctgtgcgacatcggggagagctcccccaacccgaccatcgaggagggccggaccctgcgcgtcctcaagatggtggagccctggctgcgggggaaccagttctgcatcaagatcctgaacccctacatgcccagcgtggtcgagaccctcgagcagatgcagcgcaagcacggcggcatgctggtgcggaacccgctgtcccgcaacagcacccacgagatgtactgggtgtcctgcgggacgggcaacatcgtcagcgccgtgaacatgacctcccggatgctcctgaaccgcttcaccatggcccaccgcaagcccacctacgagcgggacgtggacctgggggcgggcacgcgccacgtcgccgtggagcccgaggtggccaacctcgacatcatcggccagcggatcgagaacatcaagcacgagcacaagagcacctggcactacgacgaggacaacccctacaagacctgggcctaccacgggtcctacgaggtcaagccgagcggctccgccagcagcatggtgaacggggtcgtgaagctgctgaccaagccctgggacgtgatccccatggtcacgcagatcgcgatgaccgacaccacccccttcggccagcagcgcgtgttcaaggagaaggtggacacgcggaccccgaaggccaagcgcgggaccgcccagatcatggaggtcaccgccaagtggctctggggcttcctgtcccggaacaagaagccccgcatctgcacgcgggaggagttcacccgcaaggtgcggagcaacgccgcgatcggcgccgtgttcgtcgacgagaaccagtggaactccgccaaggaggccgtggaggacgagcgcttctgggacctggtgcagaaggagcgggagctccacaagcaggggaagtgcgcgacctgcgtctacaacatgatgggcaagcgcgagaagaagctgggggagttcggcaaggccaaggggagccgggccatctggtacatgtggctgggcgcccgcttcctcgagttcgaggccctgggcttcatgaacgaggaccactggttctcccgggagaacagcctgtccggggtggagggcgaggggctccacaagctgggctacatcctgcgcgacatcagcaagatccccgggggcaacatgtacgcggacgacaccgccggctgggacacgcggatcaccgaggacgacctccagaacgaggccaagatcaccgacatcatggagccggagcacgccctgctggccacctccatcttcaagctcacgtaccagaacaaggtggtccgcgtgcagcggcccgcgaagaacgggaccgtgatggacgtcatcagccgccgcgaccagcggggctccggccaggtgggcacctacggcctgaacaccttcacgaacatggaggcccagctgatccgccagatggagagcgaggggatcttcctcccctccgagctggagacccccaacctggccgagcgggtgctcgactggctggagaagtacggcgtcgagcgcctgaagcggatggccatcagcggggacgactgcgtggtgaagccgatcgacgaccgcttcgccaccgcgctcaccgccctgaacgacatgggcaaggtccggaaggacatcccccagtgggagccctccaaggggtggaacgactggcagcaggtccccttctgcagccaccacttccaccagctgatcatgaaggacggccgcgagatcgtggtcccgtgccggaaccaggacgagctcgtgggccgcgcccgggtgtcccagggggccggctggagcctgcgcgagacggcctgcctgggcaagagctacgcgcagatgtggcagctcatgtacttccaccggcgcgacctgcggctggccgccaacgccatctgctccgcggtccccgtggactgggtgcccaccagccgcaccacctggtccatccacgcccaccaccagtggatgacgaccgaggacatgctcagcgtctggaaccgggtgtggatcgaggagaacccctggatggaggacaagacccacgtgtccagctggggcgacgtcccgtacctggggaagcgcgaggaccagtggtgcggctccctgatcggcctcaccgcccgggccacctgggccagcaacatccaggtggcgatcaaccaggtgcgccgcctgatcgggaacgagaactacctggactacatgacgtccatgaagcggttcaagaacgagggcgaccccgagggggccctctggtga

SEQ ID NO: 8530 - RNA, 9879 nt, synthetic construct
  misc_feature 1..9879: note = derived and/or modified CDS sequence (opt1) from DENV-1__GQ868611__SS-prME
  source 1..9879: mol_type = other RNA
agcgtgaccatgttcctgatgctcatgcccaccgccctggccttccacctgaccacccggggcggggagccccacatgatcgtgagcaagcaggagcggggcaagagcctcctgttcaagaccagcgccggggtgaacatgtgcaccctgatcgccatggacctcggcgagctgtgcgaggacaccatgacctacaagtgcccccgcatcaccgagaccgagcccgacgacgtggactgctggtgcaacgccacggacacctgggtcacctacgggacctgcagccagacgggcgagcaccggcgcgacaagcggtccgtggccctggcgccccacgtgggcctcgggctggagacccgcaccgagacctggatgagctccgagggcgcctggaagcagatccagcgggtcgagacgtgggccctgcgccaccccgggttcaccgtgatcgccctcttcctggcccacgcgatcggcaccagcatcacccagaaggggatcatcttcatcctgctcatgctggtgacgccctccatggccatgcggtgcgtcggcatcggcagccgcgacttcgtggaggggctgtccggcgccacctgggtggacgtcgtgctcgagcacgggagctgcgtgaccaccatggccaaggacaagcccacgctggacatcgagctgctcaagaccgaggtcaccaaccccgccgtgctgcggaagctgtgcatcgaggcgaagatctccaacaccacgaccgacagccgctgcccgacccagggcgaggccaccctcgtggaggagcaggacgccaacttcgtctgccggcgcacgttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctgaccgactacggggccctcacgctggactgcagcccccgcaccggcctggacttcaacgagatggtcctcctgaccatgaaggagaagtcctggctggtgcacaagcagtggttcctcgacctgcccctgccctggaccagcggggccagcacgtcccaggagacctggaaccggcaggacctcctggtgaccttcaagaccgcccacgccaagaagcaggaggtcgtggtgctgggcagccaggagggcgcgatgcacacggccctcaccggggccaccgagatccagacctccggcacgaccaccatcttcgccgggcacctgaagtgccgcctgaagatggacaagctcaccctgaagggcatgagctacgtcatgtgcacggggtccttcaagctggagaaggagctcgccgagacccagcacggcaccgtgctggtgcagatcaagtacgagggcaccgacgcgccctgcaagatccccttcagcacgcaggacgagaagggggtcacccagaacggccggctgatcaccgccaacccgatcgtgaccgacaaggagaagcccgtgaacatcgaggccgagccgcccttcggggagtcctacatcgtcatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtggggaagctggtccaccagatcttcggcaccgcctacggggtgctgttctccggcgtgagctggacgatgaagatcgggatcggcgtcctgctgacctggctcggcctgaactcccgcagcacctccctgagcatgacctgcatcgccgtggggctcgtgacgctgtacctgggcgtcatggtgcaggccgactccgggtgcgtgatcaactggaagggccgggagctcaagtgcgggagcggcatcttcgtcaccaacgaggtgcacacctggaccgagcagtacaagttccaggccgacagcccgaagcgcctgtccgcggccatcggcaaggcctgggaggagggggtgtgcggcatccggagcgccacccgcctggagaacatcatgtggaagcagatctccaacgagctcaaccacatcctgctggagaacgacatgaagttcacggtcgtggtgggggacgtcgccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctgaagctgcgggacagctacacccaggtctgcgaccaccgcctcatgtccgcggccatcaaggacagcaaggccgtgcacgccgacatgggctactggatcgagtccgagaagaacgagacctggaagctggcccgggcgagcttcatcgaggtgaagacgtgcatctggcccaagtcccacaccctgtggagcaacggcgtcctcgagtccgagatgatcatccccaagatctacgggggcccgatcagccagcacaactaccgccccgggtacttcacccagaccgccggcccctggcacctggggaagctggagctcgacttcgacctgtgcgagggcacgaccgtggtggtcgacgagcactgcggcaaccgggggccgtccctgcgcaccaccacggtgaccggcaagatcatccacgagtggtgctgccggagctgcaccctgccgcccctccgcttccgcggggaggacggctgctggtacgggatggagatccgccccgtgaaggagaaggaggagaacctggtcaagtccatggtgagcgccggcagcggcgaggtggactccttcagcctcgggctgctgtgcatctccatcatgatcgaggaggtcatgcggagccgctggtcccggaagatgctcatgaccggcacgctggccgtgttcttcctgctcatcatggggcagctgacctggaacgacctgatccgcctctgcatcatggtgggcgccaacgcgagcgaccgcatggggatgggcaccacctacctggccctgatggccacgttcaagatgcggccgatgttcgccgtcggcctcctgttccgccggctgacctcccgcgaggtgctcctgctgaccatcgggctcagcctggtggcctccgtcgagctgcccaacagcctcgaggagctgggcgacgggctggcgatgggcatcatgatcctcaagctgctgaccgacttccagtcccaccagctctgggccacgctgctgagcctcaccttcatcaagaccaccttctccctgcactacgcctggaagacgatggccatggtgctgagcatcgtctccctcttccccctgtgcctgagcaccacctcccagaagaccacgtggctccccgtgctgctgggcagcctcgggtgcaagccgctgaccatgttcctgatcgcggagaacaagatctggggccggcgctcctggcccctcaacgaggggatcatggccgtgggcatcgtcagcatcctgctgagctccctcctgaagaacgacgtgcccctggccgggcccctcatcgccggcggcatgctgatcgcctgctacgtgatcagcgggtccagcgcggacctgtccctcgagaaggccgccgaggtcagctgggaggaggaggccgagcactccggcgccagccacaacatcctggtggaggtgcaggacgacgggaccatgaagatcaaggacgaggagcgggacgacaccctgaccatcctcctgaaggcgacgctgctcgccgtctccggcgtgtacccgctgagcatccccgccaccctgttcgtgtggtacttctggcagaagaagaagcagcgctccggggtcctctgggacacccccagcccgcccgaggtggagcgggccgtgctggacgacggcatctaccgcatcatgcagcggggcctgctggggcgctcccaggtcggcgtgggggtgttccaggagaacgtcttccacaccatgtggcacgtgacgcggggcgccgtgctcatgtaccaggggaagcgcctggagcccagctgggcgtccgtcaagaaggacctgatcagctacggcggcgggtggcggctccagggctcctggaacaccggggaggaggtccaggtgatcgccgtcgagcccggcaagaaccccaagaacgtgcagaccgcccccgggaccttcaagacgcccgagggcgaggtgggcgccatcgccctggacttcaagcccgggaccagcggctcccccatcgtcaaccgcgaggggaagatcgtgggcctgtacggcaacggggtggtcaccaccagcggcacgtacgtgagcgcgatcgcccaggcccgggcctcccaggaggggccgctccccgagatcgaggacgaggtgttccgcaagcggaacctgaccatcatggacctgcaccccggcagcgggaagacccgccggtacctcccggcgatcgtccgcgaggccatcaagcgcaagctgcggaccctgatcctcgcccccacgcgcgtggtggcctccgagatggccgaggcgctgaagggcatgcccatccggtaccagaccaccgccgtcaagagcgagcacaccggcaaggagatcgtggacctgatgtgccacgccacgttcaccatgcgcctcctgtcccccgtgcgggtcccgaactacaacatgatcatcatggacgaggcccacttcaccgaccccagctccatcgccgcgcgcgggtacatcagcacccgggtgggcatgggggaggccgccgccatcttcatgacggccacgccgcccggctccgtggaggcgttcccgcagagcaacgccgtcatccaggacgaggagcgcgacatccccgagcggtcctggaacagcgggtacgagtggatcaccgacttccccggcaagaccgtgtggttcgtgccctccatcaagagcggcaacgacatcgccaactgcctgcgcaagaacgggaagcgggtcatccagctctcccgcaagacgttcgacaccgagtaccagaagaccaagaacaacgactgggactacgtggtgaccacggacatcagcgagatgggcgccaacttccgggcggaccgcgtcatcgacccgcggcgctgcctgaagcccgtgatcctgaaggacgggcccgagcgggtgatcctcgccggccccatgccggtcaccgtggcctccgccgcccagcgccgggggcgcatcggccgcaaccacaacaaggagggcgaccagtacatctacatggggcagcccctgaacaacgacgaggaccacgcgcactggaccgaggccaagatgctgctcgacaacatcaacacccccgagggcatcatccccgccctgttcgagccggagcgggagaagtccgccgccatcgacggggagtaccgcctgcggggcgaggcgcgcaagacgttcgtcgagctcatgcggcgcggggacctgcccgtgtggctgtcctacaaggtggccagcgagggcttccagtacagcgaccggcgctggtgcttcgacggcgagcggaacaaccaggtcctcgaggagaacatggacgtggagatctggaccaaggagggggagcgcaagaagctgcggccccgctggctggacgcccggacctactccgaccccctcgccctgcgcgagttcaaggagttcgccgcgggccggcgcagcgtgtccggggacctgatcctcgagatcggcaagctgccgcagcacctgacccagcgggcccagaacgccctcgacaacctggtcatgctgcacaacagcgagcagggcgggcgcgcctaccggcacgcgatggaggagctccccgacacgatcgagaccctgatgctgctcgccctgatcgccgtgctgaccggcggggtgaccctcttcttcctgtccggccgcgggctgggcaagaccagcatcggcctcctgtgcgtcatggcctccagcgtgctgctctggatggcctccgtggagccccactggatcgcggccagcatcatcctggagttcttcctgatggtcctcctgatccccgagccggaccggcagcgcacgccccaggacaaccagctggcctacgtggtgatcgggctcctgttcatgatcctgaccgtcgccgccaacgagatgggcctcctggagaccaccaagaaggacctggggatcggccacgtggcggtggagaaccaccaccacgccgccatgctcgacgtcgacctgcaccccgcctccgcctggacgctgtacgcggtggccaccaccatcatcaccccgatgatgcgccacacgatcgagaacaccaccgccaacatcagcctcaccgccatcgccaaccaggcggccatcctgatggggctggacaagggctggcccatctccaagatggacatcggcgtgcccctcctggccctggggtgctacagccaggtcaaccccctcacgctgaccgccgcggtgctgatgctcgtggcccactacgccatcatcggcccggggctgcaggccaaggccacccgggaggcgcagaagcgcaccgccgccggcatcatgaagaaccccacggtcgacgggatcgtggccatcgacctggaccccgtggtctacgacgccaagttcgagaagcagctcggccagatcatgctgctgatcctctgcacctcccagatcctgctgatgcggaccacctgggcgctctgcgagagcatcacgctggccaccggccccctgaccaccctctgggaggggtccccgggcaagttctggaacacgaccatcgccgtgagcatggccaacatcttccgcgggtcctacctggccggcgcgggcctggccttcagcctcatgaagtccctcgggggcgggcggcgcgggaccggggcccagggcgagaccctgggcgagaagtggaagcggcagctcaaccagctgtccaagagcgagttcaacacgtacaagcgctccgggatcatggaggtggaccggagcgaggccaaggagggcctgaagcgcggggagaccaccaagcacgcggtctcccggggcaccgccaagctccgctggttcgtggagcggaacctggtgaagcccgaggggaaggtcatcgacctgggctgcggccgcgggggctggagctactactgcgccgggctgaagaaggtgacggaggtgaagggctacaccaagggcggccccggccacgaggagcccatcccgatggccacctacgggtggaacctcgtcaagctgcactccggcaaggacgtgttcttcatcccgcccgagaagtgcgacaccctgctctgcgacatcggggagagctcccccaacccgacgatcgaggagggccggaccctgcgcgtgctgaagatggtcgagccctggctccgggggaaccagttctgcatcaagatcctgaacccctacatgcccagcgtggtggagaccctggagcagatgcagcgcaagcacggcggcatgctcgtccggaacccgctgtcccgcaacagcacccacgagatgtactgggtgtcctgcgggaccggcaacatcgtgagcgccgtcaacatgacgtcccgcatgctgctcaaccggttcaccatggcgcaccgcaagcccacctacgagcgggacgtggacctgggggccggcacccgccacgtggccgtcgagcccgaggtggccaacctggacatcatcggccagcggatcgagaacatcaagcacgagcacaagagcacgtggcactacgacgaggacaacccctacaagacctgggcctaccacgggtcctacgaggtgaagccgagcggctccgcgagcagcatggtcaacggggtggtcaagctcctgaccaagccctgggacgtgatccccatggtgacccagatcgccatgacggacaccacccccttcggccagcagcgcgtcttcaaggagaaggtggacacccggacgccgaaggccaagcgcgggaccgcccagatcatggaggtgaccgccaagtggctgtggggcttcctctcccggaacaagaagccccgcatctgcacccgggaggagttcacgcgcaaggtccggagcaacgcggccatcggcgccgtgttcgtggacgagaaccagtggaactccgccaaggaggcggtcgaggacgagcgcttctgggacctggtgcaccgggagcgcgagctgcacaagcaggggaagtgcgcgacctgcgtgtacaacatgatgggcaagcgggagaagaagctcggggagttcggcaaggccaaggggagccgcgccatctggtacatgtggctgggcgcccggttcctggagttcgaggcgctcggcttcatgaacgaggaccactggttctcccgcgagaacagcctgtccggggtcgagggcgaggggctgcacaagctcggctacatcctgcgggacatcagcaagatccccgggggcaacatgtacgccgacgacaccgccggctgggacacccgcatcacggaggacgacctgcagaacgaggcccgcatcaccgacatcatggagccggagcacgccctcctggcgaagtccatcttcaagctgacctaccagaacaaggtggtgcgggtccagcgccccgccaagaacgggaccgtgatggacgtgatcagccggcgcgaccagcggggctccgggcaggtcggcacgtacggcctcaacaccttcaccaacatggaggcccagctgatccgccagatggagagcgaggggatcttctcccccagcgagctggagacccccaacctcgccgagcgggtgctggactggctggagaagtacggcgtggagcgcctcaagcggatggccatctccggggacgactgcgtcgtgaagccgatcgacgaccgcttcgcgacggccctgaccgccctgaacgacatgggcaaggtgcggaaggacatcccccagtgggagcccagcaaggggtggaacgactggcagcaggtccccttctgctcccaccacttccaccagctcatcatgaaggacggccgcgagatcgtggtgccgtgccggaaccaggacgagctggtcggccgcgcccgggtgagccagggggccggctggagcctgcgcgagaccgcgtgcctcgggaagtcctacgcccagatgtggcagctgatgtacttccaccggcgcgacctgcggctcgccgccaacgcgatctgcagcgccgtgcccgtcgactggatccccacctcccgcacgacctggagcatccacgcccaccaccagtggatgaccaccgaggacatgctgtccgtgtggaaccgcgtgtggatcgaggagaacccctggatggaggacaagacgcacatcagctcctggggcgacgtcccgtacctggggaagcgggaggaccagtggtgcggcagcctcatcggcctgaccgcccgcgccacctgggcgaccaacatccaggtggccatcaaccaggtgcggcgcctgatcgggaacgagaactacctcgactacatgacctccatgaagcggttcaagaacgagagcgaccccgagggcgccctgtggtga

SEQ ID NO: 8531 - RNA, 9879 nt, synthetic construct
  misc_feature 1..9879: note = derived and/or modified CDS sequence (opt1) from DENV-1__FJ882555__SS-prME
  source 1..9879: mol_type = other RNA
agcgtgaccatgctgctcatgctgatgcccaccgccctggccttccacctcaccacccgcggcggggagccgcacatgatcgtgagcaagcaggagcggggcaagagcctgctgttcaagaccagcgccggggtgaacatgtgcaccctcatcgccatggacctgggcgagttctgcgaggacaccatgacctacaagtgcccccgcatcaccgaggccgagcccgacgacgtggactgctggtgcaacgccaccgacacgtgggtcacctacgggacctgcagccagaccggcgagcaccggcgcgacaagcggtccgtggccctggcgccccacgtgggcctcgggctggagacgcgcaccgagacctggatgagctccgagggcgcctggaagcagatccagcgggtcgagacctgggccctgcgccacccggggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggaccagcggggcctccgccagccaggagacctggaaccggcaggacctcctggtgaccttcaagacggcgcacgccaagaagcaggaggtcgtggtgctgggctcccaggagggcgccatgcacaccgccctcaccggggccaccgagatccagacgagcggcaccaccaccatcttcgcggggcacctgaagtgccgcctgaagatggacaagctcacgctgaagggcatgtcctacgtcatgtgcaccgggagcttcaagctggagaaggaggtggccgagacccagcacggcaccgtgctcgtccagatcaagtacgagggcacggacgccccctgcaagatccccttctccacccaggacgagaagggggtgacccagaacggccggctgatcaccgccaacccgatcgtgacggacaaggagaagcccgtcaacatcgaggcggagccgcccttcggggagagctacatcgtgatcggcgccggcgagaaggccctgaagctgtcctggttcaagaaggggagctccatcggcaagatgttcgaggccaccgcccgcggggcgcggcgcatggccatcctcggcgacaccgcctgggacttcgggagcatcggcggcgtgttcacctccgtcgggaagctggtgcaccagatcttcggcacggcctacggggtgctgttcagcggcgtctcctggaccatgaagatcgggatcggcgtgctcctgacctggctgggcctcaacagccgctccaccagcctgtccatgacgtgcatcgccgtggggctggtcaccctctacctgggcgtgatggtgcaggcggacagcgggtgcgtcatcaactggaagggccgggagctgaagtgcgggagcggcatcttcgtgaccaacgaggtgcacacctggacggagcagtacaagttccaggccgactccccgaagcgcctcagcgccgccatcggcaaggcctgggaggagggggtctgcggcatccggtccgcgacccgcctggagaacatcatgtggaagcagatcagcaacgagctgaaccacatcctcctggagaacgacatgaagctgaccgtggtggtcggggacgtggccggcatcctcgcccaggggaagaagatgatccggccccagcccatggagtacaagtactcctggaagtcctggggcaaggccaagatcatcggcgcggacgtgcagaacaccaccttcatcatcgacgggcagaacacgcccgagtgcccggacgaccagcgcgcctggaacatctgggaggtcgaggactacggcttcgggatcttcaccaccaacatctggctgaagctgcgggacagctacacccaggtgtgcgaccaccgcctcatgagcgccgccatcaaggactccaaggccgtgcacgcggacatgggctactggatcgagagcgagaagaacgagacgtggaagctggcccgggcctccttcatcgaggtcaagacctgcatctggcccaagagccacaccctgtggtccaacggcgtgctcgagagcgagatgatcatccccaagatctacgggggccccatctcccagcacaactaccgcccggggtacttcacccagacggccggcccctggcacctggggaagctggagctcgacttcgacctgtgcgagggcaccaccgtggtcgtggacgagcactgcggcaaccgggggcccagcctgcgcaccacgaccgtgaccggcaagatcatccacgagtggtgctgccggtcctgcaccctcccgcccctgcgcttcaagggggaggacggctgctggtacgggatggagatccggcccgtcaaggagaaggaggagaacctggtgaagtccatggtgagcgccggctccggcgaggtcgacagcttctccctcgggctgctgtgcatcagcatcatgatcgaggaggtgatgcgctcccggtggagccgcaagatgctcatgacgggcaccctggcggtgttcttcctgctcatcatggggcagctgacctggaacgacctgatccggctctgcatcatggtcggcgccaacgcctccgaccgcatggggatgggcaccacgtacctggccctgatggccaccttcaagatgcgccccatgttcgcggtgggcctcctgttccggcgcctgaccagccgggaggtgctcctgctgaccatcgggctctccctggtcgccagcgtggagctgccgaactccctcgaggagctgggcgacgggctggccatgggcatcatgatcctcaagctgctgacggacttccagagccaccagctctgggccaccctgctgtccatgaccttcatccgcaccacgttcagcctccactacgcgtggaagaccatggccatggtcctgtccatcgtgagcctgttccccctctgcctgtccaccaccagccagaagacgacctggctgcccgtgctcctgggctccctggggtgcaagcccctcaccatgttcctgatcgccgagaacaagatctggggccgcaagagctggccgctgaacgaggggatcatggccgtcggcatcgtgagcatcctcctgtccagcctgctcaagaacgacgtgcccctggccgggcccctgatcgcgggcggcatgctcatcgcctgctacgtcatctccgggagctccgccgacctgagcctggagaaggccgccgtggtgtcctgggaggaggaggcggagcacagcggcgcctcccacaacatcctcgtcgaggtgcaggacgacgggaccatgaagatcaaggacgaggagcgcgacgacacgctgaccatcctgctcaaggccaccctgctggccgtgagcggcgtctaccccctctccatcccggccaccctgttcgtgtggtacttctggcagaagaagaagcagcggagcggggtgctgtgggacacccccagcccgcccgaggtcgagcgcgcggtgctcgacgacggcatctaccggatcatgcagcgcggcctgctggggcggagccaggtgggcgtcggggtgttccaggagaacgtgttccacacgatgtggcacgtcacccgcggcgccgtgctgatgtaccaggggaagcggctcgagccgtcctgggccagcgtgaagaaggacctgatctcctacggcggcgggtggcgcctgcagggcagctggaacaccggggaggaggtccaggtgatcgccgtggagcccggcaagaaccccaagaacgtccagaccgcccccgggacgttcaagacctccgagggcgaggtgggcgcgatcgccctcgacttcaagccggggaccagcggcagccccatcgtgaaccgggaggggaaggtcgtgggcctgtacggcaacggggtggtcaccacgtccggcacctacgtgagcgccatcgcccaggcgaaggcctcccaggaggggcccctgcccgagatcgaggacgaggtgttccgcaagcggaacctcaccatcatggacctgcacccgggcagcgggaagacccgccggtacctgcccgccatcgtccgcgaggccatcaagcggaagctccgcacgctgatcctggcccccacccgcgtggtggcgtccgagatggccgaggccctcaagggcatgccgatccggtaccagaccaccgccgtcaagagcgagcacacgggcaaggagatcgtggacctgatgtgccacgccaccttcaccatgcgcctgctctcccccgtgcgggtccccaactacaacatgatcatcatggacgaggcgcacttcaccgaccccagctccatcgccgcccgcgggtacatcagcacgcgggtgggcatgggggaggccgccgcgatcttcatgaccgccaccccgcccggctccgtggaggccttcccccagagcaacgccgtcatccaggacgaggagcgcgacatccccgagcggtcctggaacagcgggtacgagtggatcaccgacttcccgggcaagacggtgtggttcgtgccctccatcaagagcggcaacgacatcgcgaactgcctgcgcaagaacgggaagcgggtcatccagctgtcccgcaagaccttcgacaccgagtaccagaagaccaagaacaacgactgggactacgtggtgacgaccgacatcagcgagatgggcgccaacttccgggccgaccgcgtcatcgacccccggcgctgcctcaagcccgtgatcctgaaggacgggccggagcgggtcatcctggccggccccatgcccgtgaccgtggcctccgcggcccagcgccgggggcgcatcggccggaaccacaacaaggagggcgaccagtacatctacatggggcagcccctcaacaacgacgaggaccacgcccactggaccgaggccaagatgctgctggacaacatcaacacgccggagggcatcatccccgccctcttcgagcccgagcgcgagaagtccgcggccatcgacggggagtaccgcctgcggggcgaggcccgcaagaccttcgtcgagctgatgcggcgcggggacctccccgtgtggctgagctacaaggtggcctccgagggcttccagtacagcgaccggcgctggtgcttcgacggcgagcggaacaaccaggtcctggaggagaacatggacgtggagatctggaccaaggagggggagcgcaagaagctccggccgcgctggctggacgcccggacctactccgaccccctggcgctccgcgagttcaaggagttcgccgccggccggcgcagcgtgtccggggacctgatcctggagatcggcaagctcccccagcacctgacgcagcgggcccagaacgcgctggacaacctcgtcatgctgcacaacagcgagcagggcgggcgcgcctaccggcacgccatggaggagctgcccgacaccatcgagaccctcatgctgctggccctcatcgccgtgctgaccggcggggtgacgctgttcttcctctccggccgcgggctgggcaagaccagcatcggcctgctctgcgtcatggcgtccagcgtgctgctgtggatggcctccgtggagccgcactggatcgccgccagcatcatcctcgagttcttcctgatggtcctgctcatccccgagcccgaccggcagcgcacgccccaggacaaccagctggcctacgtggtgatcgggctcctgttcatgatcctgaccgtcgcggccaacgagatgggcctgctcgagaccacgaagaaggacctggggatcggccacgtggccgtggagaaccaccaccacgccgccatgctggacgtcgacctccacccggcgtccgcctggaccctgtacgccgtggccaccaccatcatcacgcccatgatgcggcacaccatcgagaacaccaccgccaacatcagcctgacggcgatcgccaaccaggccgccatcctcatggggctggacaagggctggcccatctccaagatggacatcggcgtgccgctgctcgcgctggggtgctacagccaggtcaaccccctgaccctcaccgccgccgtgctgatgctggtggcccactacgccatcatcggccccgggctccaggcgaaggccacccgcgaggcccagaagcgcacggccgccggcatcatgaagaaccccaccgtcgacgggatcgtggcgatcgacctggacccggtggtctacgacgccaagttcgagaagcagctgggccagatcatgctcctgatcctgtgcacctcccagatcctcctgatgcggaccacgtgggccctgtgcgagagcatcaccctcgccaccggccccctgaccacgctgtgggaggggtcccccggcaagttctggaacaccaccatcgccgtgagcatggcgaacatcttccgcgggagctacctcgccggcgccggcctggccttctccctgatgaagtccctcgggggcgggcggcgcggcaccggggcgcagggcgagacgctgggcgagaagtggaagcggcagctgaaccagctctccaagagcgagttcaacacctacaagcgctccgggatcatggaggtggaccggagcgaggccaaggagggcctgaagcgcggggagaccaccaagcacgccgtctcccggggcacggccaagctgcgctggttcgtggagcggaacctcgtgaagcccgaggggaaggtcatcgacctgggctgcggccgcgggggctggagctactactgcgccgggctgaagaaggtgaccgaggtgaagggctacaccaagggcgggccgggccacgaggagcccatccccatggcgacctacgggtggaacctggtcaagctccactccggcaaggacgtgttcttcatcccgcccgagaagtgcgacacgctgctgtgcgacatcggggagagctcccccaaccccaccatcgaggagggccggaccctccgcgtgctgaagatggtcgagccctggctgcgggggaaccagttctgcatcaagatcctcaacccctacatgcccagcgtggtggagaccctggagcagatgcagcgcaagcacggcggcatgctggtccggaaccccctctcccgcaacagcacgcacgagatgtactgggtgtcctgcgggaccggcaacatcgtgagcgccgtcaacatgacctcccggatgctgctgaaccgcttcaccatggcccaccgcaagcccacctacgagcgggacgtggacctcggggccggcacgcgccacgtggccgtcgagccggaggtggcgaacctggacatcatcggccagcggatcgagaacatcaagcacgagcacaagagcacctggcactacgacgaggacaacccctacaagacctgggcctaccacgggtcctacgaggtcaagcccagcggcagcgcctccagcatggtgaacggggtggtcaagctgctcaccaagccctgggacgtgatcccgatggtgacgcagatcgccatgaccgacaccacccccttcggccagcagcgcgtcttcaaggagaaggtggacacgcggacccccaaggccaagcgcgggaccgcgcagatcatggaggtgaccgccaagtggctgtggggcttcctgtcccggaacaagaagccccgcatctgcacgcgggaggagttcacccgcaaggtccggagcaacgccgccatcggcgcggtgttcgtggacgagaaccagtggaactccgccaaggaggccgtcgaggacgagcgcttctgggacctcgtgcaccgggagcgcgagctgcacaagcaggggaagtgcgcgacctgcgtgtacaacatgatgggcaagcgggagaagaagctgggggagttcggcaaggccaaggggagccgcgcgatctggtacatgtggctcggcgcccggttcctggagttcgaggccctgggcttcatgaacgaggaccactggttctcccgcgagaacagcctctccggggtcgagggcgaggggctgcacaagctgggctacatcctccgggacatcagcaagatccccggcgggaacatgtacgccgacgacaccgccgggtgggacacgcgcatcaccgaggacgacctgcagaacgaggcgaagatcaccgacatcatggagcccgagcacgccctgctcgccaagtccatcttcaagctgacctaccagaacaaggtggtgcgggtccagcgccccgccaagaacgggacggtgatggacgtgatcagccgccgggaccagcgcggctccgggcaggtcggcacctacggcctgaacaccttcaccaacatggaggcccagctcatccggcagatggagagcgaggggatcttctccccgagcgagctggagacgcccaacctggcgggccgcgccctcgactggctggagaagcacggggtggagcggctgaagcgcatggccatctccggcgacgactgcgtggtcaagcccatcgacgaccggttcgccaccgccctcaccgcgctgaacgacatggggaaggtgcgcaaggacatcccccagtgggagccgagcaagggctggaacgactggcagcaggtccccttctgcagccaccacttccaccagctgatcatgaaggacggccgggagatcgtcgtgccctgccgcaaccaggacgagctcgtggggcgggcccgcgtctcccagggcgccgggtggagcctgcgggagaccgcctgcctgggcaagtcctacgcgcagatgtggcagctcatgtacttccaccgccgggacctgcgcctggccgccaacgccatctgcagcgccgtgcccgtggactgggtcccgacgtcccggaccacctggagcatccacgcgcaccaccagtggatgaccacggaggacatgctctccgtgtggaaccgcgtgtggatcgaggagaacccctggatggaggacaagacccacatcagctcctggggcgacgtcccctacctgggcaagcgggaggaccagtggtgcggcagcctgatcgggctcaccgcccgcgccacctgggccacgaacatccaggtggccatcaaccaggtgcgccggctgctgggcaacgagaactacctcgactacatgacctccatgaagcgcttcaagaacgagagcgaccccgagggggcgctgtggtga

SEQ ID NO: 8532 - RNA, 9879 nt, synthetic construct
  misc_feature 1..9879: note = derived and/or modified CDS sequence (opt1) from DENV-1__GQ199821__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagaccagcgcgggggtgaacatgtgcaccctcatcgccatggacctgggcgagttctgcgaggacacgatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagaccgtccagtacgagaacctgaagtacagcgtgatcgtgaccgtccacacgggcgaccagcaccaggtggggaacgagtccaccgagcacggcaccaccgcgaccatcacgccccaggcccccagcaccgagatccagctgaccgactacggggccctcaccctggactgcagcccccggacgggcctggacttcaacgagatggtcctcctgaccatgaaggagaagtcctggctggtgcacaagcagtggttcctcgacctgccgctgccctggaccagcggggcctccaccagccaggagacgtggaaccggaaggacctcctggtgaccttcaagaccgcccacgcgaagaagcaggaggtcgtggtgctgggctcccaggagggcgccatgcacaccgccctcacgggggccaccgagatccagaccagcggcaccacgaccatcttcgccgggcacctgaagtgccgcctgaagatggacaagctcaccctgaagggcatgtcctacgtcatgtgcaccgggagcttcaagctggagaaggaggtggcggagacgcagcacggcaccgtgctcgtccagatcaagtacgagggcaccgacgccccctgcaagatccccttctccacccaggacgagaagggggtgacgcagaacggccggctgatcaccgccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacacggcctgggacttcgggagcatcggcggcgtgttcacctccgtcgggaagctggtgcaccagatcttcggcaccgcctacggggtgctgttcagcggcgtctcctggaccatgaagatcgggatcggcgtgctcctgacgtggctgggcctcaacagccgctccaccagcctgtccatgacctgcatcgtggtcgggctggtgaccctctacctgggcgtgatggtccaggccgacagcgggtgcgtgatcaactggaagggccgggagctgaagtgcgggagcggcatcttcgtgacgaacgaggtccacacctggaccgagcagtacaagttccaggccgactccccgaagcgcctcagcgcggccatcggcaaggcctgggaggagggggtgtgcggcatccggtccgccacccgcctggagaacatcatgtggaagcagatcagcaacgagctgaaccacatcctcctggagaacgacatgaagttcaccgtggtcgtgggggacgtggccggcatcctggcgcaggggaagaagatgatccggccccagcccatggagtacaagtactcctggaagtcctggggcaaggccaagatcatcggcgccgacgtccagaacacgaccttcatcatcgacgggcccaacaccccggagtgccccgacgaccagcgcgcctggaacatctgggaggtggaggactacggcttcgggatcttcaccacgaacatctggctcaagctgcgggactcctacacccaggtgtgcgaccaccgcctgatgagcgcggccatcaaggactccaaggccgtccacgccgacatgggctactggatcgagagcgagaagaacgagacctggaagctcgcccgggcgtccttcatcgaggtgaagacctgcatctggcccaagagccacacgctgtggtccaacggcgtgctggagagcgagatgatcatccccaagatctacgggggcccgatctcccagcacaactaccgccccgggtacttcacccagaccgccggcccctggcacctcgggaagctggagctggacttcgacctctgcgagggcaccacggtcgtggtggacgagcactgcggcaaccgggggccgagcctgcgcaccaccaccgtcacgggcaagatcatccacgagtggtgctgccggtcctgcaccctgccgcccctgcgcttcaagggggaggacggctgctggtacgggatggagatccggcccgtgaaggagaaggaggagaacctggtcaagagcatggtcagcgccggctccggcgaggtggacagcttctccctggggctcctgtgcatcagcatcatgatcgaggaggtgatgcgctcccggtggagccgcaagatgctgatgaccggcaccctcgccgtcttcttcctgctgatcatggggcagctcacgtggaacgacctgatccggctgtgcatcatggtgggcgccaacgcgtccgaccgcatggggatgggcaccacctacctcgccctgatggccaccttcaagatgcgcccgatgttcgccgtggggctcctgttccggcgcctgacgagccgggaggtcctgctcctgaccatcgggctgtccctcgtggccagcgtcgagctgcccaactccctggaggagctcggcgacgggctggcgatgggcatcatgatcctgaagctcctgaccgacttccagagccaccagctgtgggccaccctcctgtccctgacgttcatcaagaccaccttcagcctccactacgcctggaagaccatggccatggtgctgtccatcgtgagcctgttccccctctgcctgtccacgaccagccagaagaccacctggctgcccgtcctcctgggctccctggggtgcaagccgctcacgatgttcctgatcgcggagaacaagatctggggccgcaagagctggcccctgaacgaggggatcatggccgtgggcatcgtgagcatcctcctgtccagcctgctcaagaacgacgtccccctggccgggcccctgatcgccggcggcatgctcatcgcctgctacgtgatctccgggagctccgcggacctgagcctggagaaggccgccgaggtgtcctgggaggaggaggccgagcacagcggcgcctcccacaacatcctcgtcgaggtgcaggacgacgggaccatgaagatcaaggacgaggagcgggacgacaccctgaccatcctgctcaaggcgaccctgctggccgtgagcggcgtctacccgctctccatccccgccacgctgttcgtgtggtacttctggcagaagaagaagcagcgcagcggggtgctgtgggacacccccagcccgcccgaggtcgagcgggccgtgctcgacgacggcatctaccgcatcatgcagcggggcctgctggggcgcagccaggtgggcgtcggggtgttccaggagaacgtgttccacaccatgtggcacgtcacccggggcgccgtgctgatgtaccaggggaagcgcctcgagccctcctgggcgagcgtgaagaaggacctgatctcctacggcggcgggtggcggctgcagggcagctggaacacgggggaggaggtccaggtgatcgccgtggagcccggcaagaaccccaagaacgtccagaccgcccccgggaccttcaagacctccgagggcgaggtgggcgccatcgccctcgacttcaagcccgggacgagcggcagccccatcgtgaaccgcgaggggaagatcgtcggcctgtacggcaacggggtggtgaccacctccggcacctacgtcagcgcgatcgcccaggccaaggcctcccaggaggggcccctgccggagatcgaggacgaggtgttccggaagcgcaacctcacgatcatggacctgcaccccggcagcgggaagacccggcgctacctgcccgcgatcgtgcgggaggccatcaagcgcaagctccggaccctgatcctggccccgacccgcgtcgtggcctccgagatggccgaggcgctcaagggcatgcccatccgctaccagacgaccgccgtcaagagcgagcacaccggcaaggagatcgtcgacctgatgtgccacgccaccttcacgatgcggctgctctcccccgtgcgcgtgcccaactacaacatgatcatcatggacgaggcccacttcaccgacccgagctccatcgccgcgcgggggtacatcagcacccgcgtcggcatgggggaggccgccgccatcttcatgaccgccacgccgcccggctccgtggaggcgttcccccagagcaacgccgtgatccaggacgaggagcgggacatcccggagcgctcctggaacagcgggtacgagtggatcaccgacttccccggcaagaccgtctggttcgtgccctccatcaagagcggcaacgacatcgccaactgcctgcggaagaacgggaagcgcgtgatccagctgtcccggaagaccttcgacacggagtaccagaagaccaagaacaacgactgggactacgtcgtgaccaccgacatcagcgagatgggcgccaacttccgcgcggaccgggtgatcgacccccgccggtgcctcaagccggtcatcctgaaggacgggcccgagcgcgtgatcctggccggccccatgcccgtcacggtggcctccgccgcccagcggcgcgggcggatcggccgcaaccacaacaaggagggcgaccagtacatctacatggggcagccgctcaacaacgacgaggaccacgcgcactggaccgaggccaagatgctgctggacaacatcaacacccccgagggcatcatccccgccctcttcgagcccgagcgggagaagtccgccgccatcgacggggagtaccgcctgcgcggcgaggcgcggaagaccttcgtggagctgatgcgccgcggggacctcccggtctggctgagctacaaggtggcctccgagggcttccagtacagcgaccgccggtggtgcttcgacggcgagcgcaacaaccaggtgctggaggagaacatggacgtcgagatctggacgaaggagggggagcggaagaagctccgcccccggtggctggacgcccgcacctactccgaccccctggccctccgggagttcaaggagttcgccgcgggccgccggagcgtgtccggggacctgatcctggagatcggcaagctcccccagcacctgacccagcgcgcccagaacgccctggacaacctcgtgatgctgcacaacagcgagcagggcgggcgggcctaccgccacgcgatggaggagctgccggacaccatcgagacgctcatgctgctggccctcatcgccgtcctgaccggcggggtgaccctgttcttcctctccggccgggggctgggcaagaccagcatcggcctgctctgcgtgatggcctccagcgccctgctgtggatcgcgtccgtcgagccccactggatcgccgccagcatcatcctcgagttcttcctgatggtgctgctcatccccgagcccgaccgccagcggaccccgcaggacaaccagctggcctacgtggtcatcgggctcctcttcatgatcctgacggtggccgcgaacgagatgggcctgctcgagaccaccaagaaggacctggggatcggccacgtggccgtcgagaaccaccaccacgccgccatgctggacgtggacctccaccccgcctccgcgtggaccctgtacgccgtggccacgaccatcatcacccccatgatgcgccacaccatcgagaacacgaccgccaacatcagcctgaccgccatcgcgaaccaggccgccatcctcatggggctggacaagggctggccgatctccaagatggacatcggcgtccccctgctcgccctggggtgctacagccaggtgaaccccctgaccctcacggcggccgtgctgatgctggtcgcccactacgccatcatcggccccgggctccaggccaaggcgacccgggaggcccagaagcgcaccgccgccggcatcatgaagaacccgaccgtggacgggatcgtggccatcgacctggaccccgtcgtgtacgacgcgaagttcgagaagcagctgggccagatcatgctcctgatcctgtgcacgtcccagatcctcctgatgcgcaccacctgggccctgtgcgagagcatcaccctcgccacgggccccctgaccaccctgtgggaggggtcccccggcaagttctggaacaccacgatcgccgtgagcatggccaacatcttccgggggagctacctcgcgggcgccggcctggccttctccctgatgaagtccctcgggggcgggcgccggggcaccggggcccagggcgagaccctgggcgagaagtggaagcgccagctgaaccagctctccaagagcgagttcaacacctacaagcggtccgggatcatggaggtcgaccgcagcgaggcgaaggagggcctgaagcgcggggagacgaccaagcacgccgtgtcccgcggcaccgccaagctgcggtggttcgtggagcgcaacctcgtcaagccggaggggaaggtgatcgacctgggctgcggccgcggcgggtggagctactactgcgccgggctgaagaaggtgaccgaggtcaaggggtacacgaagggcgggcccggccacgaggagcccatccccatggccacctacgggtggaacctggtgaagctccactccggcaaggacgtgttcttcatcccgcccgagaagtgcgacaccctgctgtgcgacatcggggagagctcccccaaccccaccatcgaggagggccgcacgctccgggtcctgaagatggtggagccgtggctgcgcgggaaccagttctgcatcaagatcctcaacccctacatgcccagcgtggtcgagaccctggagcagatgcagcggaagcacggcggcatgctggtgcgcaaccccctctcccggaacagcacccacgagatgtactgggtgtcctgcgggaccggcaacatcgtcagcgcggtgaacatgacctcccgcatgctgctgaaccggttcacgatggcccaccgcaagccgacctacgagcgcgacgtggacctcggggccggcacccggcacgtcgccgtggagcccgaggtggccaacctggacatcatcggccagcgcatcgagaacatcaagcacgagcacaagagcacctggcactacgacgaggacaacccctacaagacgtgggcgtaccacgggtcctacgaggtcaagcccagcggcagcgcctccagcatggtgaacggggtcgtgaagctgctcaccaagccgtgggacgtgatccccatggtcacccagatcgccatgaccgacacgacccccttcggccagcagcgggtgttcaaggagaaggtggacacccgcacccccaaggccaagcgggggacggcccagatcatggaggtcaccgcgaagtggctgtggggcttcctgtcccgcaacaagaagccgcggatctgcacccgcgaggagttcacccggaaggtgcgcagcaacgccgccatcggcgccgtgttcgtcgacgagaaccagtggaactccgcgaaggaggccgtggaggacgagcggttctgggacctcgtgcaccgcgagcgggagctgcacaagcaggggaagtgcgccacgtgcgtctacaacatgatgggcaagcgcgagaagaagctgggggagttcggcaaggccaaggggagccgggccatctggtacatgtggctcggcgcgcgcttcctggagttcgaggccctgggcttcatgaacgaggaccactggttctcccgggagaacagcctctccggggtggagggcgaggggctgcacaagctgggctacatcctccgcgacatcagcaagatccccgggggcaacatgtacgccgacgacaccgccggctgggacacccggatcaccgaggacgacctgcagaacgaggccaagatcacggacatcatggagcccgagcacgcgctgctcgccaagtccatcttcaagctgacctaccagaacaaggtggtccgcgtgcagcggccggccaagaacgggaccgtgatggacgtcatcagccgccgcgaccagcggggctccggccaggtgggcacctacggcctgaacacgttcaccaacatggaggcccagctcatccgccagatggagagcgaggggatcttctcccccagcgagctggagacccccaacctggccggccgggtgctcgactggctggagaagcacggggtcgagcgcctgaagcggatggcgatctccggcgacgactgcgtggtgaagcccatcgacgaccgcttcgccaccgccctcacggccctgaacgacatggggaaggtccggaaggacatcccgcagtgggagcccagcaagggctggaacgactggcagcaggtccccttctgcagccaccacttccaccagctgatcatgaaggacggccgcgagatcgtggtcccctgccggaaccaggacgagctcgtggggcgcgcccgggtgtcccagggcgcggggtggagcctgcgcgagaccgcctgcctgggcaagtcctacgcccagatgtggcagctcatgtacttccaccggcgcgacctgcggctggccgcgaacgccatctgcagcgccgtcccggtggactgggtgcccacctcccgcaccacgtggagcatccacgcccaccaccagtggatgaccaccgaggacatgctctccgtctggaaccgggtgtggatcgaggagaacccctggatggaggacaagacccacatcagctcctggggcgacgtgccctacctgggcaagcgcgaggaccagtggtgcggcagcctgatcgggctcacggcccgggcgacctgggccaccaacatccaggtcgccatcaaccaggtgcgccgcctgatcggcaacgagaactacctggactacatgacctccatgaagcggttcaagaacgagagcgacccggagggggccctctggtga

SEQ ID NO: 8533 - RNA, 9879 nt, synthetic construct
  misc_feature 1..9879: note = derived and/or modified CDS sequence (opt1) from DENV-1__FJ882556__SS-prME
  source 1..9879: mol_type = other RNA
agcgtgaccatgctgctcatgctgatgcccaccgccctggccttccacctcaccacccggggcggggagccccacatgatcgtgtccaagcaggagcggggcaagagcctgctgttcaagacctccgccggggtgaacatgtgcaccctcatcgccatggacctgggcgagctgtgcgaggacaccatgacctacaagtgcccccgcatcaccgagaccgagcccgacgacgtggactgctggtgcaacgccaccgacacctgggtgacctacgggacctgcagccagacgggcgagcaccggcgcgacaagcggtccgtggccctcgcgccccacgtgggcctggggctggagacccgcaccgagacctggatgagctccgagggcgcctggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgtccgacaaggagaagcccgtcaacatcgaggccgagccgcccttcggggagagctacatcgtgatcggcgccggcgagaaggcgctgaagctctcctggttcaagaaggggagctccatcggcaagatgttcgaggccaccgcccgcggggcccggcgcatggccatcctgggcgacacggcgtgggacttcgggagcatcggcggcgtgttcacctccgtcgggaagctggtgcaccagatcttcggcaccgcctacggggtgctgttcagcggcgtctcctggaccatgaagatcgggatcggcgtgctgctgacgtggctcggcctgaacagccgctccaccagcctgtccatgacctgcatcgccgtggggctcgtcaccctgtacctgggcgtgatggtgcaggccgacagcgggtgcgtcatcaactggaagggccgggagctcaagtgcgggagcggcatcttcgtgacgaacgaggtgcacacctggaccgagcagtacaagttccaggccgactccccgaagcgcctgagcgcggccatcggcaaggcctgggaggagggggtctgcggcatccggtccgccacccgcctggagaacatcatgtggaagcagatcagcaacgagctcaaccacatcctgctggagaacgacatgaagttcaccgtggtggtcggggacgtggccggcatcctcgcgcaggggaagaagatgatccggccccagcccatggagtacaagtactcctggaagtcctggggcaaggccaagatcatcggcgccgacgtgcagaacacgaccttcatcatcgacgggcccaacaccccggagtgccccgacgaccagcgcgcctggaacatctgggaggtcgaggactacggcttcgggatcttcaccacgaacatctggctgaagctgcgggactcctacacccaggtgtgcgaccaccgcctcatgagcgcggccatcaaggactccaaggccgtgcacgccgacatgggctactggatcgagagcgagaagaacgagacctggaagctggcccgggcgtccttcatcgaggtcaagacctgcatctggcccaagagccacacgctgtggtccaacggcgtgctcgagagcgagatgatcatccccaagatctacgggggcccgatctcccagcacaactaccgccccgggtacttcacccaggccgccggcccctggcacctggggaagctggagctcgacttcgacctgtgcgagggcaccaccgtggtcgtggacgagcactgcggcaaccgggggccgagcctgcgcacgaccaccgtgaccggcaagatcatccacgagtggtgctgccggtcctgcacgctgccgcccctccgcttccgcggggaggacggctgctggtacgggatggagatccgccccgtcaaggagaaggaggagaacctggtcaagagcatggtgagcgccggctccggcgaggtcgacagcttctccctcgggctgctgtgcatcagcatcatgatcgaggaggtgatgcggtcccgctggagccggcgcatgctcatgaccggcaccctggccgtgttcttcctgctcatcatggggcagctgacctggaacgacctgatccgcctctgcatcatggtcggcgcgaacgcctccgaccggatggggatgggcacgacctacctggccctgatggccaccttcaagatgcgcccgatgttcgccgtgggcctcctgttccggcgcctgaccagccgggaggtgctcctgctgacgatcgggctctccctggtcgcgagcgtggagctgcccaactccctcgaggagctgggcgacgggctggccatgggcatcatgatcctcaagctgctgaccgacttccagagccaccagctctgggccaccctgctgtccctcaccttcatcaagacgaccttcagcctgcactacgcctggaagaccatggcgatggtcctgtccatcgtgagcctcttccccctgtgcctgtccaccacgagccagaagaccacctggctccccgtgctgctgggctccctcgggtgcaagccgctgaccatgttcctgatcgccgagaacaagatctggggccgccggagctggcccctcaacgaggggatcatggccgtcggcatcgtgagcatcctgctgtccagcctcctgaagaacgacgtgcccctggccgggcccctcatcgccggcggcatgctgatcgcgtgctacgtcatctccgggagctccgccgacctgagcctcgagaaggccgccgaggtgtcctgggaggaggaggccgagcacagcggcgcgtcccacaacatcctggtggaggtccaggacgacgggacgatgaagatcaaggacgaggagcgcgacgacaccctgaccatcctcctgaaggccaccctgctcgccgtgagcggcgtgtacccgctgtccatccccgccaccctgttcgtctggtacttctggcagaagaagaagcagcggagcggggtgctctgggacacgcccagcccgcccgaggtggagcgcgccgtcctggacgacggcatctaccggatcatgcagcgcggcctgctggggcggagccaggtgggcgtgggggtcttccaggagaacgtgttccacaccatgtggcacgtgacccgcggcgcggtcctcatgtaccaggggaagcggctggagccctcctgggccagcgtgaagaaggacctgatctcctacggcggcgggtggcgcctccagggcagctggaacaccggggaggaggtgcaggtcatcgccgtggagcccggcaagaaccccaagaacgtgcagacggcccccgggaccttcaagacccccgagggcgaggtcggcgccatcgcgctggacttcaagcccgggacctccggcagccccatcgtgaaccgggaggggaagatcgtgggcctgtacggcaacggggtcgtgacgaccagcggcacctacgtgtccgccatcgcccaggccaaggcgagccaggaggggccgctccccgagatcgaggacgaggtcttccgcaagcggaacctgaccatcatggacctgcaccccggctccgggaagacgcgccggtacctcccggccatcgtgcgcgaggccatcaagcgcaagctgcggaccctgatcctcgcccccacccgcgtggtcgccagcgagatggcggaggccctgaagggcatgcccatccggtaccagaccacggccgtgaagtccgagcacaccggcaaggagatcgtggacctgatgtgccacgccaccttcaccatgcgcctcctgagccccgtccgggtgccgaactacaacatgatcatcatggacgaggcccacttcacggacccctccagcatcgcggcccgcgggtacatctccacccgggtgggcatgggggaggccgccgccatcttcatgaccgcgacgccgcccggcagcgtcgaggccttcccgcagtccaacgccgtgatccaggacgaggagcgcgacatccccgagcggagctggaactccgggtacgagtggatcacggacttccccggcaagaccgtgtggttcgtccccagcatcaagtccggcaacgacatcgccaactgcctgcgcaagaacgggaagcgggtgatccagctcagccgcaagaccttcgacaccgagtaccagaagacgaagaacaacgactgggactacgtggtcaccaccgacatctccgagatgggcgcgaacttccgggccgaccgcgtgatcgacccgcggcgctgcctgaagcccgtgatcctgaaggacgggcccgagcgggtcatcctcgccggccccatgccggtgaccgtcgccagcgccgcgcagcgccgggggcgcatcggccgcaaccacaacaaggagggcgaccagtacatctacatggggcagcccctgaacaacgacgaggaccacgcccactggacggaggccaagatgctgctcgacaacatcaacacccccgagggcatcatccccgccctgttcgagccggagcgggagaagtccgccgcgatcgacggggagtaccgcctgcggggcgaggcccgcaagaccttcgtggagctcatgcggcgcggggacctgcccgtgtggctgagctacaaggtcgccagcgagggcttccagtactccgaccggcgctggtgcttcgacggcgagcggaacaaccaggtgctcgaggagaacatggacgtggagatctggaccaaggagggggagcgcaagaagctgcggccccgctggctggacgcccggacgtacagcgaccccctcgccctgcgcgagttcaaggagttcgcggccggccggcgctccgtcagcggggacctgatcctcgagatcggcaagctgccgcagcacctgacccagcgggcccagaacgccctcgacaacctggtgatgctgcacaactccgagcagggcgggcgcgcgtaccggcacgccatggaggagctccccgacaccatcgagaccctgatgctgctcgccctgatcgccgtgctgacgggcggggtcaccctcttcttcctgagcggccgcgggctgggcaagacctccatcggcctcctgtgcgtgatggccagctccgtgctgctctggatggcgagcgtcgagccccactggatcgccgcctccatcatcctggagttcttcctgatggtgctcctgatccccgagccggaccggcagcgcacgccccaggacaaccagctggcctacgtggtcatcgggctcctgttcatgatcctgaccgtggccgcgaacgagatgggcctcctggagacgaccaagaaggacctggggatcggccacgtggccgtcgagaaccaccaccacgccgccatgctcgacgtggacctgcaccccgccagcgcgtggaccctgtacgccgtggccaccacgatcatcaccccgatgatgcgccacaccatcgagaacaccacggccaacatctccctcaccgccatcgcgaaccaggccgccatcctgatggggctggacaagggctggcccatcagcaagatggacatcggcgtccccctcctggccctggggtgctactcccaggtgaaccccctcaccctgaccgcggccgtgctgatgctcgtcgcccactacgccatcatcggcccggggctgcaggccaaggcgacgcgggaggcccagaagcgcaccgccgccggcatcatgaagaaccccaccgtggacgggatcgtggccatcgacctggaccccgtcgtgtacgacgcgaagttcgagaagcagctcggccagatcatgctgctgatcctctgcaccagccagatcctgctgatgcggacgacctgggccctctgcgagtccatcaccctggccaccggccccctgacgaccctctgggaggggagcccgggcaagttctggaacaccaccatcgccgtgtccatggccaacatcttccgcgggagctacctggcgggcgccggcctggccttcagcctcatgaagtccctcgggggcgggcggcgcgggacgggggcccagggcgagaccctgggcgagaagtggaagcggcagctcaaccagctgagcaagtccgagttcaacacctacaagcgcagcgggatcatggaggtcgaccggtccgaggcgaaggagggcctgaagcgcggggagaccacgaagcacgccgtgagccggggcaccgccaagctccgctggttcgtggagcggaacctggtcaagcccgaggggaaggtgatcgacctgggctgcggccgcgggggctggtcctactactgcgccgggctgaagaaggtgaccgaggtcaagggctacaccaagggcgggcccggccacgaggagcccatcccgatggccacgtacgggtggaacctcgtgaagctgcacagcggcaaggacgtgttcttcatcccgcccgagaagtgcgacaccctgctctgcgacatcggggagtccagccccaacccgaccatcgaggagggccggaccctgcgcgtcctgaagatggtggagccctggctccgggggaaccagttctgcatcaagatcctgaacccctacatgccctccgtggtcgagacgctggagcagatgcagcgcaagcacggcggcatgctcgtgcggaacccgctgagccgcaactccacccacgagatgtactgggtgagctgcgggaccggcaacatcgtctccgcggtgaacatgaccagccgcatgctgctcaaccggttcaccatggcccaccgcaagcccacgtacgagcgggacgtggacctgggggccggcacccgccacgtcgccgtggagcccgaggtggccaacctggacatcatcggccagcggatcgagaacatcaagcacgagcacaagtccacctggcactacgacgaggacaacccctacaagacctgggcgtaccacgggagctacgaggtcaagccgtccggcagcgccagctccatggtgaacggggtcgtgaagctcctgacgaagccctgggacgtgatccccatggtcacccagatcgccatgaccgacaccacgcccttcggccagcagcgcgtgttcaaggagaaggtggacacccggaccccgaaggccaagcgcgggaccgcccagatcatggaggtcacggcgaagtggctgtggggcttcctcagccggaacaagaagccccgcatctgcacccgggaggagttcacccgcaaggtgcggtccaacgccgccatcggcgccgtgttcgtcgacgagaaccagtggaacagcgcgaaggaggccgtggaggacgagcgcttctgggacctggtgcaccgggagcgcgagctgcacaagcaggggaagtgcgcgacctgcgtctacaacatgatgggcaagcgggagaagaagctcggggagttcggcaaggccaaggggtcccgcgccatctggtacatgtggctgggcgcgcggttcctggagttcgaggccctcggcttcatgaacgaggaccactggttcagccgcgagaactccctgagcggggtggagggcgaggggctgcacaagctcggctacatcctgcgggacatctccaagatccccgggggcaacatgtacgccgacgacacggccggctgggacacccgcatcaccgaggacgacctgcagaacgaggcccgcatcaccgacatcatggagccggagcacgcgctcctggccaagagcatcttcaagctgacgtaccagaacaaggtggtccgggtgcagcgccccgccaagaacgggaccgtgatggacgtcatctcccggcgcgaccagcggggcagcggccaggtggggacctacggcctcaacaccttcacgaacatggaggcccagctgatccgccagatggagtccgaggggatcttcagcccctccgagctggagacccccaacctcgccgagcgggtgctggactggctggagaagtacggcgtcgagcgcctcaagcggatggcgatcagcggggacgactgcgtggtgaagccgatcgacgaccgcttcgccaccgccctgaccgccctgaacgacatgggcaaggtccggaaggacatcccccagtgggagccctccaaggggtggaacgactggcagcaggtccccttctgcagccaccacttccaccagctcatcatgaaggacggccgcgagatcgtggtcccgtgccggaaccaggacgagctggtgggccgcgcccgggtgagccagggggcgggctggtccctgcgcgagacggcctgcctcggcaagagctacgcccagatgtggcagctgatgtacttccaccggcgcgacctgcggctcgccgcgaacgccatctgctccgccgtccccgtggactggatccccaccagccgcaccacctggtccatccacgcccaccaccagtggatgacgaccgaggacatgctgagcgtgtggaaccgcgtctggatcgaggagaacccctggatggaggacaagacccacatctccagctggggcgacgtgccgtacctggggaagcgggaggaccagtggtgcggctccctcatcggcctgaccgcccgcgcgacgtgggccaccaacatccaggtggccatcaaccaggtccggcgcctgatcgggaacgagaactacctcgactacatgaccagcatgaagcggttcaagaacgagtccgaccccgagggcgccctgtggtga

SEQ ID NO: 8534 - RNA, 9879 nt, synthetic construct
  misc_feature 1..9879: note = derived and/or modified CDS sequence (opt1) from DENV-1__GQ199822__SS-prME
  source 1..9879: mol_type = other RNA
agcgtgaccatgctgctcatgctgatgcccaccgccctggccttccacctcaccacccgcggcggggagccccacatgatcgtgaccaagcaggagcggggcaagagcctgctgttcaagaccagcgccggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtcacctacgggacctgcagccagacgggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccgtgggcggcgtgttcaccagcgtcgggaagctggtgcaccagatcttcggcaccgcctacggggtgctgttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggccgactccgggtgcgtcatcaactggaagggccgggagctcaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctggagaacatcatgtggaagcagatctccaacgagctcaaccacatcctgctggagaacgacatgaagttcaccgtggtggtcggggacgtggtgggcatcctcgcgcaggggaagaagatgatccggccccagcccatggagcacaagtacagctggaagtcctggggccgcgccaagatcatcggcgccgacgtccagaacacgaccttcatcatcgacgggcccaacaccccggagtgccccgacgaccagcgggcctggaacatctgggaggtggaggactacggcttcgggatcttcaccacgaacatctggctgaagctgcgcgacagctacacccaggtgtgcgaccaccggctcatgtccgcggccatcaaggacagcaaggccgtccacgccgacatgggctactggatcgagtccgagaagaacgagacctggaagctggcccgcgcgagcttcatcgaggtgaagacctgcatctggcccaagtcccacacgctgtggagcaacggcgtgctcgagtccgagatgatcatccccaagatctacgggggcccgatcagccagcacaactaccggcccgggtacttcacccagaccgccggcccctggcacctggggaagctggagctcgacttcgacctgtgcgagggcaccacggtcgtggtggacgagcactgcggcaaccgcgggccgtccctgcggaccaccaccgtcacgggcaagatcatccacgagtggtgctgccgcagctgcaccctgccgcccctccggttcaagggggaggacggctgctggtacgggatggagatccgccccgtgaaggagaaggaggagaacctggtgaagtccatggtcagcgccggcagcggcgaggtggactccttcagcctcgggctgctgtgcatctccatcatgatcgaggaggtgatgcggagccgctggtcccggaagatgctcatgaccggcaccctggccgtcttcctgctcctgatcatggggcagctgacgtggaacgacctcatccgcctgtgcatcatggtgggcgccaacgcgagcgaccgcatggggatgggcaccacctacctggccctcatggccaccttcaagatgcggccgatgttcgccgtgggcctgctgttccgccggctcacgtcccgcgaggtcctgctgctcaccatcgggctgagcctggtggcctccgtcgagctccccaacagcctggaggagctgggcgacgggctcgcgatgggcatcatgatcctgaagctgctcaccgacttccagtcccaccagctgtgggccaccctgctcagcctgacgttcatcaagaccaccctgtccctccactacgcctggaagaccatggccatggtgctgagcatcgtgtccctgttccccctctgcctgagcacgacctcccagaagaccacctggctgcccgtcctcctgggcagcctggggtgcaagccgctcacgatgttcctgatcaccgagaacaagatctggggccggaagtcctggcccctgaacgaggggatcatggcggtgggcgtggtcagcatcctcctgagctccctgctcaagaacgacgtgcccctggccgggcccctgatcgccggcggcatgctcatcgcctgctacgtgatcagcgggtccagcgccgacctgtccctggagaaggcggccgaggtcagctgggaggaggaggccgagcactccggcgccagccacaacatcctcgtggaggtgcaggacgacgggaccatgaagatcaaggacgaggagcgcgacgacaccctgaccatcctgctcaaggccacgctgctggcggtctccggcgtgtacccgctcagcatccccgccaccctgttcgtgtggtacttctggcagaagaagaagcagcggtccggggtcctgtgggacacccccagcccgcccgaggtggagcgcgccgtgctggacgacggcatctaccggatcatgcagcgcggcctcctggggcggtcccaggtcggcgtgggggtgttccaggagaacgtcttccacaccatgtggcacgtgacgcgcggcgccgtgctgatgtaccaggggaagcggctcgagcccagctgggcctccgtcaagaaggacctgatcagctacggcggcgggtggcgcctgcagggctcctggaacaccggggaggaggtccaggtgatcgcggtcgagcccggcaagaaccccaagaacgtgcagaccgcccccgggaccttcaagacgcccgagggcgaggtgggcgccatcgccctcgacttcaagcccgggaccagcggctcccccatcgtcaaccgggaggggaagatcgtgggcctgtacggcaacggggtggtcaccaccagcggcacgtacgtgagcgccatcgcgcaggccaaggcctcccaggaggggccgctgcccgagatcgaggacgaggtgttccgcaagcggaacctcaccatcatggacctgcaccccggcagcgggaagacccgccggtacctgccggccctcgtccgcgaggcgatcaagcggaagctgcgcaccctgatcctcgcccccacgcgcgtggtggcctccgagatggccgaggccctgaagggcatgcccatccggtaccagaccaccgcggtcaagagcgagcacaccggcaaggagatcgtggacctgatgtgccacgccacgttcaccatgcgcctcctgtcccccgtgcgggtcccgaactacaacatgatcatcatggacgaggcccacttcaccgaccccagctccatcgccgcccgcgggtacatcagcacccgggtgggcatgggggaggcggccgccatcttcatgacggccacgccgcccggctccgtggaggccttcccgcagagcaacgcggtcatccaggacgaggagcgcgacatccccgagcggtcctggaacagcgggtacgagtggatcaccgacttccccggcaagaccgtgtggttcgtgccctccatcaagagcggcaacgacatcgccaactgcctgcgcaagaacgggaagcgggtcatccagctctcccgcaagacgttcgacaccgagtaccagaagaccaagaacaacgactgggactacgtggtgaccacggacatcagcgagatgggcgccaacttccgggccgaccgcgtcatcgacccgcggcgctgcctgaagcccgtgatcctgaaggacgggcccgagcgggtcatcctcgcgggccccatgccggtgaccgtggcctccgccgcccagcgccgggggcgcatcggccggaaccacaacaaggagggcgaccagtacatctacatggggcagcccctgaacaacgacgaggaccacgcccactggaccgaggcgaagatgctgctcgacaacatcaacacccccgagggcatcatccccgccctgttcgagccggagcgcgagaagtccgccgccatcgacggggagtaccgcctgcggggcgaggcccgcaagacgttcgtcgagctcatgcggcgcggggacctgcccgtgtggctgtcctacaaggtggcgagcgagggcttccagtacagcgaccggcgctggtgcttcgacggcgagcggaacaaccaggtcctcgaggagaacatggacgtggagatctggaccaaggagggggagcgcaagaagctgcggccccgctggctggacgcccggacctactccgaccccctcgccctgcgcgagttcaaggagttcgccgccggccggcgcagcgtgtccggggacctgatcctcgagatcggcaagctgccgcagcacctgacccagcgggcgcagaacgccctcgacaacctggtcatgctgcacaacagcgagcagggcgggcgcgcctaccggcacgccatggaggagctccccgacacgatcgagaccctgatgctgctcgcgctgatcgccgtgctgaccggcggggtgaccctcttcttcctgtccggccgcgggctgggcaagaccagcatcggcctcctgtgcgtcatggcctccagcgtgctgctctggatggcctccgtggagccccactggatcgccgcgagcatcatcctggagttcttcctgatggtcctcctgatccccgagccggaccggcagcgcacgccccaggacaaccagctggcctacgtggtgatcgggctcctgttcatgatcctgaccgtcgccgccaacgagatgggcctcctggagaccaccaagaaggacctggggatcggccacgtggccgtggagaaccaccaccacgcgacgatgctcgacgtcgacctgcaccccgcctccgcctggaccctgtacgccgtggccaccaccatcatcacgccgatgatgcggcacaccatcgagaacaccaccgcgaacatcagcctcacggccatcgccaaccaggccgccatcctgatggggctggacaagggctggcccatctccaagatggacatcggcgtgcccctcctggcgctggggtgctacagccaggtcaaccccctcaccctgaccgccgccgtgctgatgctcgtggcccactacgcgatcatcggcccggggctgcaggccaaggccacccgcgaggcccagaagcgcacggccgcgggcatcatgaagaaccccaccgtcgacgggatcgtggccatcgacctggaccccgtggtctacgacgccaagttcgagaagcagctcggccagatcatgctgctgatcctctgcacctcccagatcctgctgatgcggaccacgtgggccctctgcgagagcatcaccctggccaccggccccctgaccacgctctgggaggggtccccgggcaagttctggaacaccaccatcgcggtgagcatggccaacatcttccgcgggtcctacctggccggcgccggcctggccttcagcctcatgaagtccctcgggggcgggcggcgcgggaccggggcgcagggcgagacgctgggcgagaagtggaagcggcagctcaaccagctgtccaagagcgagttcaacatctacaagcgctccgggatcatggaggtggaccggagcgaggccaaggagggcctgaagcgcggggagaccacccggcacgccgtctcccgcggcaccgccaagctgcggtggttcgtggagcgcaacctcgtgaagcccgaggggaaggtcatcgacctgggctgcggccgcggcgggtggagctactactgcgcggggctgaagaaggtgacggaggtgaaggggtacaccaagggcggccccggccacgaggagcccatcccgatggccacctacgggtggaacctcgtcaagctgcactccggcaaggacgtgttcttcacgccgcccgagaagtgcgacacgctgctctgcgacatcggggagagctcccccaacccgaccatcgaggagggccgcaccctgcgggtgctgaagatggtcgagccctggctccgcgggaaccagttctgcatcaagatcctgaacccctacatgcccagcgtggtggagaccctggagcagatgcagcggaagcacggcggcatgctcgtccgcaacccgctgtcccggaacagcacccacgagatgtactgggtgtcctgcgggacgggcaacatcgtgagcgccgtcaacatgacctcccgcatgctgctcaaccgcttcaccatggcccaccggaagcccacctacgagcgcgacgtggacctgggggccggcacgcggcacgtggcggtcgagcccgaggtggccaacctggacatcatcggccagcgcatcgagaacatcaagcacgagcacaagagcacctggcactacgacgaggacaacccctacaagacctgggcctaccacgggtcctacgaggtcaagccgagcggctccgccagcagcatggtgaacggggtggtcaagctcctgaccaagccctgggacgtgatccccatggtgacgcagatcgccatgaccgacaccacccccttcggccagcagcgggtcttcaaggagaaggtggacacgcgcaccccgaaggcgaagcgggggaccgcccagatcatggaggtgaccgcccgctggctgtggggcttcctctcccggaacaagaagccccgcatctgcacgcgggaggagttcacccgcaaggtccggagcaacgccgccatcggcgcggtgttcgtggacgagaaccagtggaactccgccaaggaggccgtcgaggacgagcgcttctgggacctggtgcagaaggagcgggagctgcacaagcaggggaagtgcgcgacctgcgtgtacaacatgatgggcaagcgcgagaagaagctcggggagttcggcaaggcgaaggggagccgggccatctggtacatgtggctgggcgcccgcttcctggagttcgaggccctcggcttcatgaacgaggaccactggttctcccgggagaacagcctgtccggggtcgagggcgaggggctgcacaagctcggctacatcctgcgcgacatcagcaagatccccgggggcaacatgtacgccgacgacaccgcgggctgggacacgcggatcaccgaggacgacctgcagaacgaggccaagatcaccgacatcatggagccggagcacgccctcctggccacctccatcttcaagctgacgtaccagaacaaggtggtgcgcgtccagcgccccgccaagaacgggaccgtgatggacgtgatcagccggcgcgaccagcggggctccgggcaggtcggcacctacggcctcaacaccttcacgaacatggaggcgcagctgatccgccagatggagagcgaggggatcttcctgccctccgagctcgagacccccaacctggccgagcgggtgctggactggctcgagaagtacggcgtggagcgcctgaagcggatggccatcagcggggacgactgcgtcgtgaagccgatcgacgaccgcttcgccaccgccctgaccgcgctcaacgacatgggcaaggtgcggaaggacatcccccagtgggagccctccaaggggtggaacgactggcagcaggtccccttctgcagccaccacttccaccagctgatcatgaaggacggccgcgagatcgtggtgccgtgccggaaccaggacgagctggtcggccgcgcccgggtgtcccagggggccggctggagcctccgcgagacggcctgcctgggcaagagctacgcccagatgtggcagctgatgtacttccaccggcgcgacctccggctggcggccaacgccatctgctccgccgtgcccgtcgactgggtgcccaccagccgcaccacctggtccatccacgcgcaccaccagtggatgacgaccgaggacatgctgagcgtgtggaaccgggtctggatcgaggagaacccctggatggaggacaagacccacgtgtccagctggggcgacgtgccgtacctcgggaagcgcgaggaccagtggtgcggctccctgatcggcctgaccgcccgcgccacctgggccagcaacatccaggtcgccatcaaccaggtgcggcgcctcatcgggaacgagaactacctggactacatgacgtccatgaagcggttcaagaacgagggcgaccccgagggggcgctgtggtga

SEQ ID NO: 8535 - RNA, 9879 nt, synthetic construct
  misc_feature 1..9879: note = derived and/or modified CDS sequence (opt1) from DENV-1__FJ882557__SS-prME
  source 1..9879: mol_type = other RNA
agcgtgaccatgctgctcatgctgatgcccaccgccctggccttccacctcaccacccgcggcggggagccccacatgatcgtgagcaagcaggagcggggcaagagcctgctgttcaagacctccgccggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctgatccaccagatcttcggcaccgcctacggggtcctcttctccggcgtgagctggaccatgaagatcgggatcggcgtcctgctgacgtggctcggcctgaactcccgcagcacctccctgagcatgacctgcatcgccgtggggctcgtgaccctgtacctgggcgtcatggtgcaggccgactccgggtgcgtgatcaactggaagggccgggagctcaagtgcgggagcggcatcttcgtcacgaacgaggtgcacacctggaccgagcagtacaagttccaggcggacagcccgaagcgcctgtccgccgccatcggcaaggcctgggaggagggggtgtgcggcatccggagcgccacccgcctggagaacatcatgtggaagcagatctccaacgagctcaaccacatcctgctggagaacgacatgaagctcaccgtcgtggtgggggacgtcgcgggcatcctggggcagggcaagaagatgatccggccccagcccatggagtacaagtacagctggaagtcctggggcaaggccaagatcatcggggccgacgcccagaacacgaccttcatcatcgacggccccaacaccccggagtgccccgacgaccagcgcgcgtggaacatctgggaggtggaggactacgggttcggcatcttcaccacgaacatctggctgaagctccgggacagctacacccaggtgtgcgaccaccgcctgatgtccgccgccatcaaggacagcaaggccgtccacgccgacatgggctactggatcgagtccgagaagaacgagacctggaagctggcgcgggccagcttcatcgaggtgaagacctgcatctggcccaagtcccacacgctctggagcaacggggtgctggagtccgagatgatcatccccaagatctacggcgggccgatcagccagcacaactaccgccccggctacttcacccagaccgccgggccctggcacctgggcaagctcgagctggacttcgacctgtgcgagggcaccacggtcgtggtggacgagcactgcgggaaccggggcccgtccctccgcaccaccaccgtcacggggaagatcatccacgagtggtgctgccggagctgcaccctgccgcccctgcgcttccggggcgaggacgggtgctggtacggcatggagatccgccccgtgaaggagaaggaggagaacctcgtgaagtccatggtcagcgccggcagcggggaggtggactccttcagcctgggcctgctctgcatctccatcatgatcgaggaggtgatgcggagccgctggtcccggaagatgctgatgaccgggaccctggccgtcttcttcctcctgatcatgggccagctgacgtggaacgacctcatccgcctgtgcatcatggtgggggcgaacgccttcgaccgcatgggcatgggcaccacctacctggccctcatggccaccttcaagatgcggccgatgttcgccgtggggctgctgttccgccggctcacgagccgcgaggtcctgctgctcaccatcggcctgtccctggtggcgagcgtggagctccccaactccctggaggagctgggggacggcctcgccatgggcatcatgatcctgaagctgctcaccgacttccagagccaccagctgtgggccaccctgctctccctgacgttcatcaagaccaccttcagcctgcactacgcctggaagaccatggcgatggtcctctccatcgtgagcctgttccccctgtgcctctccacgaccagccagaagaccacctggctgcccgtcctgctcgggtccctgggctgcaagccgctgacgatgttcctcatcgccgagaacaagatctgggggcggaagtcctggcccctgaacgagggcatcatggccgtggggatcgtgtccatcctgctcagcagcctgctgaagaacgacgtccccctcgccggccccctgatcgccggcgggatgctgatcgcgtgctacgtgatctccggcagctccgccgacctcagcctggagaaggccgccgaggtgtcctgggaggaggaggccgagcacagcggggcgtcccacaacatcctggtcgaggtgcaggacgacggcaccatgaagatcaaggacgaggagcgcgacgacaccctcaccatcctgctgaaggccaccctcctggccgtgagcggggtctacccgctgtccatccccgccaccctcttcgtgtggtacttctggcagaagaagaagcagcggagcggcgtgctgtgggacacccccagcccgcccgaggtcgagcgcgccgtgctggacgacggcatctaccggatcatgcagcgcgggctgctcggccggagccaggtgggggtcggcgtgttccaggagaacgtgttccacaccatgtggcacgtcacccgcggggcggtgctgatgtaccagggcaagcggctggagccctcctgggccagcgtgaagaaggacctcatctcctacggcgggggctggcgcctgcgggggagctggaacacgggcgaggaggtccaggtgatcgccgtggagcccgggaagaaccccaagaacgtccagaccgcccccggcaccttcaagacccccgagggcgaggtgggggccatcgcgctggacttcaagcccggcacgtccgggagccccatcgtgaaccgcgagggcaagatcgtcggcctctacgggaacggcgtggtgaccacctccgggacctacgtcagcgccatcgcccaggccaaggcgagccaggagggcccgctgcccgagatcgaggacgaggtgttccggaagcgcaacctgacgatcatggacctccaccccgggtccggcaagacccggcgctacctgccggccatcgtgcgggaggccatcaagcgcaagctgcgcaccctcatcctggcccccacccgggtcgtggccagcgagatggcggaggccctgaagggcatgcccatccgctaccagacgaccgccgtgaagtccgagcacaccgggaaggagatcgtcgacctcatgtgccacgccaccttcacgatgcggctgctgagccccgtgcgcgtgccgaactacaacatgatcatcatggacgaggcccacttcaccgacccctccagcatcgcggcccggggctacatctccacccgcgtcgggatgggcgaggccgccgccatcttcatgaccgcgacgccgcccgggagcgtggaggccttcccgcagtccaacgccgtgatccaggacgaggagcgggacatccccgagcgcagctggaactccggccacgagtggatcaccgacttccccggcaagaccgtctggttcgtgcccagcatcaagtccgggaacgacatcgccaactgcctccggaagaacggcaagcgcgtgatccagctgagccggaagaccttcgacacggagtaccagaagaccaagaacaacgactgggactacgtcgtgaccaccgacatctccgagatgggggcgaacttccgcgccgaccgggtgatcgacccgcgccggtgcctgaagcccgtcatcctcaaggacggccccgagcgcgtgatcctggccgggcccatgccggtgacggtcgccagcgccgcgcagcggcgcggccggatcggccgcaaccacaacaaggagggggaccagtacatctacatgggccagcccctgaacaacgacgaggaccacgcccactggaccgaggccaagatgctcctggacaacatcaacacccccgaggggatcatccccgccctgttcgagccggagcgcgagaagtccgccgcggtggacggcgagtaccggctccgcggggaggcccggaagaccttcgtcgagctgatgcgccggggcgacctgcccgtgtggctcagctacaaggtggcctccgagggcttccagtacagcgaccgccggtggtgcttcgacggggagcgcaacaaccaggtcctggaggagaacatggacgtggagatctggacgaaggagggcgagcggaagaagctgcgcccccggtggctcgacgcccgcacctacagcgaccccctggccctgcgggagttcaaggagttcgcggccgggcgccggtccgtgagcggcgacctcatcctggagatcggcaagctgccgcagcacctcacccagcgcgcccagaacgccctggacaacctggtcatgctccacaactccgagcagggcgggcgggcgtaccgccacgccatggaggagctgcccgacaccatcgagacgctgatgctcctggccctgatcgccgtgctcaccgggggcgtgaccctgttcttcctgagcgggcggggcctcggcaagacctccatcgggctgctgtgcgtcatggccagctccgtgctcctgtggatggcgagcgtggagccccactggatcgccgcctccatcatcctggagttcttcctcatggtcctgctgatccccgagccggaccgccagcggacgccccaggacaaccagctcgcctacgtggtgatcggcctgctgttcatgatcctcacggtcgccgcgaacgagatggggctgctggagaccaccaagaaggacctcggcatcgggcacgtggccgtggagaaccaccaccacgccgccatgctggacgtcgacctgcaccccgccagcgcgtggaccctctacgccgtggccacgaccatcatcaccccgatgatgcgccacaccatcgagaacacgaccgccaacatctccctgaccgccatcgcgaaccaggccgccatcctgatgggcctcgacaagggctggcccatcagcaagatggacatcggggtgcccctgctggccctcggctgctactcccaggtcaaccccctgaccatgacggcggccgtgctgatgctcgtggcccactacgccatcatcgggccgggcctgcaggccaaggcgacccgcgaggcccagaagcggaccgccgccgggatcatgaagaaccccaccgtcgacggcatcgtggccatcgacctggaccccgtggtctacgacgcgaagttcgagaagcagctcggccagatcatgctgctgatcctctgcacgagccagatcctgctgatgcgcaccacctgggccctctgcgagtccatcaccctggccacggggcccctgaccaccctctgggagggcagcccggggaagttctggaacaccacgatcgccgtgtccatggccaacatcttccggggcagctacctggcgggcgccgggctggccttctccctcatgaagtccctgggcgggggccgccgggggaccggcgcccagggcgagaccctgggggagaagtggaagcgccagctcaaccagctgagcaagtccgagttcaacacctacaagcggagcggcatcatggaggtggaccgctccgaggcgaaggaggggctgaagcggggcgagacgaccaagcacgccgtcagccgcgggaccgccaagctccggtggttcgtggagcgcaacctggtgaagcccgagggcaaggtcatcgacctgggctgcgggcggggcgggtggtcctactactgcgccggcctgaagaaggtgaccgaggtgaaggggtacacgaagggcggccccgggcacgaggagcccatcccgatggccacctacggctggaacctcgtcaagctgcacagcgggaaggacgtgttcttcatcccgcccgagaagtgcgacaccctgctctgcgacatcggcgagtccagccccaacccgaccatcgaggaggggcgcacgctgcgggtgctgaagatggtcgagccctggctccgcggcaaccagttctgcatcaagatcctgaacccctacatgccctccgtggtggagaccctggagcagatgcagcggaagcacggcgggatgctcgtccgcaacccgctgagccggaactccacccacgagatgtactgggtgagctgcggcaccgggaacatcgtgtccgcggtcaacatgaccagccgcatgctgctcaaccgcttcacgatggcccaccggaagcccacctacgagcgcgacgtggacctgggcaccggcacccggcacgtggccgtcgagcccgaggtggccaacctggacatcatcgggcagcgcatcgagaacatcaagcacgagcacaagtccacgtggcactacgacgaggacaacccctacaagacctgggcctaccacggcagctacgaggtgaagccgtccgggagcgcgtccagcatggtcaacggcgtggtcaagctcctgaccaagccctgggacgtgatccccatggtgacccagatcgccatgacggacaccacccccttcgggcagcagcgggtcttcaaggagaaggtggacacccgcacgccgaaggccaagcggggcaccgcccagatcatggaggtgaccgcccgctggctgtggggcttcctcagccggaacaagaagccccgcatctgcacccgggaggagttcacgcgcaaggtccggtccaacgcggccatcggggccgtgttcgtggacgagaaccagtggaacagcgccaaggaggcggtcgaggacgagcgcttctgggacctggtgcaccgggagcgcgagctgcacaagcagggcaagtgcgcgacctgcgtgtacaacatgatggggaagcgggagaagaagctcggcgagttcgggaaggccaagggctcccgcgccatctggtacatgtggctgggcgcccggttcctggagttcgaggcgctcgggttcatgaacgaggaccactggttcagccgcgagaactccctgagcggcgtcgagggggagggcctgcacaagctcgggtacatcctgcgggacatctccaagatccccggcggcaacatgtacgccgacgacaccgccgggtgggacacccgcatcacggaggacgacctgcagaacgaggccaagatcaccgacatcatggagccggagcacgccctcctggcgaaggccatcttcaagctgacctaccagaacaaggtggtgcgcgtccagcggcccgccaagaacggcaccgtgatggacgtgatcagccgccgggaccagcgcgggtccggccaggtcggcacgtacgggctcaacaccttcaccaacatggaggcccagctgatccggcagatggagagcgagggcatcttctcccccagcgagctggagacccccaacctcgccgagcgcgcgctggactggctggagaagtacggggtggagcggctcaagcgcatggccatctccggcgacgactgcgtggtcaagccgatcgacgaccggttcgccacggccctgaccgccctgaacgacatggggaaggtgcgcaaggacatcccccagtgggagcccagcaagggctggaacgactggcagcaggtccccttctgctcccaccacttccaccagctcatcatgaaggacggccgggagatcgtcgtgccgtgccgcaaccaggacgagctggtggggcgggcgcgcgtcagccagggcgccgggtggtccctgcgggagaccgcctgcctcggcaagagctacgcccagatgtggcagctgatgtacttccaccgccgggacctgcgcctcgcggccaacgccatctgcagcgccgtgcccgtggactgggtccccacctcccggacgacctggagcatccacgcccaccaccagtggatgaccaccgaggacatgctgtccgtgtggaaccgcgtgtggatcgaggagaacccctggatggaggacaagacgcacatcagctcctgggaggacgtcccgtacctggggaagcgcgaggaccagtggtgcggcagcctcatcggcctgaccgcgcgggccacctgggccaccaacatccaggtggccatcaaccaggtgcgccggctgatcgggaacgagaactacctcgactacatgacctccatgaagcgcttcaagaacgagagcgaccccgagggcgccctgtggtga

SEQ ID NO: 8536 - RNA, 9879 nt, synthetic construct
  misc_feature 1..9879: note = derived and/or modified CDS sequence (opt1) from DENV-1__FJ882558__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagaccagcgccggggtgaacatgtgcaccctcatcgccatggacctgggcgagttctgcgaggacaccatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagaccgtccagtacgagaacctgaagtacagcgtgatcgtgaccgtccacacgggcgaccagcaccaggtggggaacgagtccaccgagcacggcaccaccgcgaccatcacgccccaggcccccagcaccgagatccagctgaccgactacggggccctcaccctggactgcagcccccggacgggcctggacttcaacgagatggtcctcctgaccatgaaggagaagtcctggctggtgcacaagcagtggttcctcgacctgccgctgccctggaccagcggggcctccaccagccaggagacgtggaaccggaaggacctcctggtgaccttcaagaccgcccacgcgaagaagcaggaggtcgtggtgctgggctcccaggagggcgccatgcacaccgccctcacgggggccaccgagatccagaccagcggcaccacgaccatcttcgccgggcacctgaagtgccgcctgaagatggacaagctcaccctgaagggcatgtcctacgtcatgtgcaccgggagcttcaagctggagaaggaggtggcggagacgcagcacggcaccgtgctcgtccagatcaagtacgagggcaccgacgccccctgcaagatccccttctccacccaggacgagaagggggtgacgcagaacggccggctgatcaccgccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacacggcctgggacttcgggagcatcggcggcgtgttcacctccgtcgggaagctggtgcaccagatcttcggcaccgcctacggggtgctgttcagcggcgtctcctggaccatgaagatcgggatcggcgtgctcctgacgtggctgggcctcaacagccgctccaccagcctgtccatgacctgcatcgccgtggggctggtcaccctctacctgggcgtgatggtgcaggccgacagcgggtgcgtcatcaactggaagggccgggagctgaagtgcgggagcggcatcttcgtgacgaacgaggtgcacacctggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagttcaccgtggtggtcggggacgtggcgggcatcctggcccaggggaagaagatgatccggccccagcccatggagtacaagtactcctggaagtcctggggcaaggccaagatcatcggcgccgacgtgcagaacacgaccttcatcatcgacgggcccaacaccccggagtgccccgacgaccagcgcgcgtggaacatctgggaggtcgaggactacggcttcgggatcttcaccacgaacatctggctcaagctgcgggactcctacacccaggtgtgcgaccaccgcctgatgagcgccgccatcaaggactccaaggccgtgcacgccgacatgggctactggatcgagagcgagaagaacgagacctggaagctcgcgcgggcctccttcatcgaggtcaagacctgcatctggcccaagagccacacgctgtggtccaacggcgtgctggagagcgagatgatcatccccaagatctacgggggcccgatctcccagcacaactaccgccccgggtacttcacccagaccgccggcccctggcacctcgggaagctggagctggacttcgacctctgcgagggcaccacggtggtcgtggacgagcactgcggcaaccgggggccgagcctgcgcaccaccaccgtgacgggcaagatcatccacgagtggtgctgccggtcctgcaccctgccgcccctgcgcttcaagggggaggacggctgctggtacgggatggagatccggcccgtcaaggagaaggaggagaacctggtcaagagcatggtgagcgccggctccggcgaggtcgacagcttctccctggggctcctgtgcatcagcatcatgatcgaggaggtgatgcgctcccggtggagccgcaagatgctgatgaccggcaccctcgccgtgttcttcctgctgatcatggggcagctcacgtggaacgacctgatccggctgtgcatcatggtcggcgcgaacgcctccgaccgcatggggatgggcaccacctacctcgccctgatggccaccttcaagatgcgcccgatgttcgccgtgggcctcctgttccggcgcctgacgagccgggaggtgctgctcctgaccatcgggctgtccctcgtcgcgagcgtggagctgcccaactccctggaggagctcggcgacgggctggccatgggcatcatgatcctgaagctcctgaccgacttccagagccaccagctgtgggccaccctcctgtccctgacgttcatcaagaccaccttcagcctccactacgcctggaagaccatggcgatggtcctgtccatcgtgagcctgttccccctctgcctgtccacgaccagccagaagaccacctggctgcccgtgctcctgggctccctggggtgcaagccgctcacgatgttcctgatcgccgagaacaagatctggggccgcaagagctggcccctgaacgaggggatcatggccgtcggcatcgtgagcatcctcctgtccagcctgctcaagaacgacgtgcccctggccgggcccctgatcgccggcggcatgctcatcgcgtgctacgtcatctccgggagctccgccgacctgagcctggagaaggccgccgaggtgtcctgggaggaggaggccgagcacagcggcgcgtcccacaacatcctcgtggaggtccaggacgacgggaccatgaagatcaaggacgaggagcgggacgacaccctgaccatcctgctcaaggccaccctgctgacggtgagcggcgtgtacccgctctccatccccgccaccctgttcgtctggtacttctggcagaagaagaagcagcgcagcggggtgctgtgggacacccccagcccgcccaaggtggagcgggccgtcctcgacgacggcatctaccgcatcatgcagcggggcctgctggggcgcagccaggtgggcgtgggggtcttccaggagaacgtgttccacaccatgtggcacgtgacgcggggcgccgtcctgatgtaccaggggaagcgcctcgagccctcctgggcgagcgtgaagaaggacctgatctcctacggcggcgggtggcggctgcagggcagctggaacaccggggaggaggtgcaggtcatcgccgtggagcccggcaagaaccccaagaacgtgcagaccgcccccgggaccttcaagacgtccgagggcgaggtcggcgccatcgccctcgacttcaagcccgggaccagcggcagccccatcgtgaaccgcgaggggaagatcgtgggcctgtacggcaacggggtcgtgaccacctccggcacgtacgtgagcgcgatcgcccaggccaaggcctcccaggaggggcccctgccggagatcgaggacgaggtcttccggaagcgcaacctcaccatcatggacctgcaccccggcagcgggaagacccggcgctacctgcccgcgatcgtgcgggaggccatcaagcgcaagctccggaccctgatcctggccccgacgcgcgtggtcgcctccgagatggccgaggcgctcaagggcatgcccatccgctaccagaccaccgccgtcaagagcgagcacaccggcaaggagatcgtggacctgatgtgccacgccacgttcaccatgcggctgctctcccccgtccgcgtgcccaactacaacatgatcatcatggacgaggcccacttcaccgacccgagctccatcgccgcgcgggggtacatcagcacccgcgtgggcatgggggaggccgccgccatcttcatgacggccacgccgcccggctccgtcgaggcgttcccccagagcaacgccgtgatccaggacgaggagcgggacatcccggagcgctcctggaacagcgggtacgagtggatcaccgacttccccggcaagaccgtgtggttcgtcccctccatcaagagcggcaacgacatcgccaactgcctgcggaagaacgggaagcgcgtgatccagctgtcccggaagacgttcgacaccgagtaccagaagaccaagaacaacgactgggactacgtggtcaccacggacatcagcgagatgggcgccaacttccgcgcggaccgggtgatcgacccccgccggtgcctcaagccggtgatcctgaaggacgggcccgagcgcgtcatcctggccggccccatgcccgtgaccgtcgcctccgccgcccagcggcgcgggcggatcggccgcaaccacaacaaggagggcgaccagtacatctacatggggcagccgctcaacaacgacgaggaccacgcgcactggaccgaggccaagatgctgctggacaacatcaacacccccgagggcatcatccccgccctcttcgagcccgagcgggagaagtccgccgccatcgacggggagtaccgcctgcgcggcgaggcgcggaagacgttcgtggagctgatgcgccgcggggacctcccggtgtggctgagctacaaggtcgcctccgagggcttccagtacagcgaccgccggtggtgcttcgacggcgagcgcaacaaccaggtgctggaggagaacatggacgtggagatctggaccaaggagggggagcggaagaagctccgcccccggtggctggacgcccgcacctactccgaccccctggccctccgggagttcaaggagttcgccgcgggccgccggagcgtctccggggacctgatcctggagatcggcaagctcccccagcacctgacccagcgcgcccagaacgccctggacaacctcgtgatgctgcacaacagcgagcagggcgggcgggcctaccgccacgcgatggaggagctgccggacacgatcgagaccatgatgctcctggccctgatcgccgtgctcaccggcggggtcaccctgttcttcctgtccggccgggggctcggcaagaccagcatcggcctgctgtgcgtgatggcctccagcgtgctcctgtggatggcctccgtcgagccccactggatcgcggccagcatcatcctggagttcttcctcatggtgctgctgatccccgagcccgaccgccagcggacgccgcaggacaaccagctcgcctacgtggtcatcgggctgctgttcatgatcctcaccgtggccgccaacgagatgggcctgctggagaccaccaagaaggacctcgggatcggccacgtggcggtcgagaaccaccaccacgccgccatgctggacgtggacctgcaccccgcctccgcctggacgctctacgcggtggccaccaccatcatcacccccatgatgcgccacacgatcgagaacaccaccgccaacatcagcctgaccgccatcgccaaccaggcggccatcctgatggggctcgacaagggctggccgatctccaagatggacatcggcgtccccctgctggccctcgggtgctacagccaggtgaaccccctgacgctgaccgccgcggtgctcatgctggtcgcccactacgccatcatcggccccgggctgcaggccaaggccacccgggaggcgcagaagcgcaccgccgccggcatcatgaagaacccgacggtggacgggatcgtggccatcgacctcgaccccgtcgtgtacgacgccaagttcgagaagcagctgggccagatcatgctgctcatcctgtgcacctcccagatcctgctcatgcgcaccacctgggcgctgtgcgagagcatcacgctggccaccggccccctcaccaccctgtgggaggggtcccccggcaagttctggaacacgaccatcgccgtgagcatggccaacatcttccgggggagctacctggccggcgcgggcctcgccttctccctgatgaagtccctcgggggcgggcgccgggggaccggggcccagggcgagaccctcggcgagaagtggaagcgccagctgaaccagctgtccaagagcgagttcaacacgtacaagcggtccgggatcatggaggtcgaccgcagcgaggccaaggagggcctcaagcgcggggagaccaccaagcacgcggtgtcccgcggcaccgccaagctgcggtggttcgtggagcgcaacctggtcaagccggaggggaaggtgatcgacctcggctgcggccgcggcgggtggagctactactgcgccgggctgaagaaggtgacggaggtcaaggggtacaccaagggcggccccggccacgaggagcccatccccatggccacctacgggtggaacctggtgaagctgcactccggcaaggacgtgttcttcatcccgcccgagaagtgcgacaccctcctgtgcgacatcggggagagctcccccaaccccacgatcgaggagggccgcaccctgcgggtcctcaagatggtggagccgtggctgcgcgggaaccagttctgcatcaagatcctgaacccctacatgcccagcgtggtcgagaccctcgagcagatgcagcggaagcacggcggcatgctggtgcgcaaccccctgtcccggaacagcacccacgagatgtactgggtgtcctgcgggaccggcaacatcgtcagcgccgtgaacatgacgtcccgcatgctcctgaaccggttcaccatggcgcaccgcaagccgacctacgagcgcgacgtggacctgggggccggcacccggcacgtcgccgtggagcccgaggtggccaacctcgacatcatcggccagcgcatcgagaacatcaagcacgagcacaagagcacgtggcactacgacgaggacaacccctacaagacctgggcctaccacgggtcctacgaggtcaagcccagcggcagcgcgtccagcatggtgaacggggtcgtgaagctgctgaccaagccgtgggacgtgatccccatggtcacccagatcgccatgacggacaccacccccttcggccagcagcgggtgttcaaggagaaggtggacacccgcacgcccaaggccaagcgggggaccgcccagatcatggaggtcaccgccaagtggctctggggcttcctgtcccgcaacaagaagccgcggatctgcacccgcgaggagttcacgcggaaggtgcgcagcaacgcggccatcggcgccgtgttcgtcgacgagaaccagtggaactccgccaaggaggcggtggaggacgagcggttctgggacctggtgcaccgcgagcgggagctccacaagcaggggaagtgcgcgacctgcgtctacaacatgatgggcaagcgcgagaagaagctgggggagttcggcaaggccaaggggagccgggccatctggtacatgtggctgggcgcccgcttcctcgagttcgaggcgctgggcttcatgaacgaggaccactggttctcccgggagaacagcctgtccggggtggagggcgaggggctccacaagctgggctacatcctgcgcgacatcagcaagatccccgggggcaacatgtacgccgacgacaccgccggctgggacacccggatcacggaggacgacctccagaacgaggccaagatcaccgacatcatggagcccgagcacgccctgctggcgaagtccatcttcaagctcacctaccagaacaaggtggtccgcgtgcagcggccggccaagaacgggaccgtgatggacgtcatcagccgccgcgaccagcggggctccggccaggtgggcacgtacggcctgaacaccttcaccaacatggaggcccagctgatccgccagatggagagcgaggggatcttctcccccagcgagctcgagacccccaacctggcccggcgcgtgctggactggctcgagaagcacggcgtcgagcggctgaagcgcatggccatctccggggacgactgcgtggtgaagcccatcgacgaccggttcgcgacggccctgaccgccctcaacgacatgggcaaggtccgcaaggacatcccgcagtgggagcccagcaaggggtggaacgactggcagcaggtccccttctgcagccaccacttccaccagctgatcatgaaggacggccgggagatcgtggtcccctgccgcaaccaggacgagctggtgggccgggcccgcgtgtcccagggggccggctggagcctccgggagaccgcgtgcctggggaagtcctacgcccagatgtggcagctgatgtacttccaccgccgggacctccgcctggccgccaacgcgatctgcagcgccgtcccggtggactgggtgcccacctcccggacgacctggagcatccacgcccaccaccagtggatgaccaccgaggacatgctgtccgtctggaaccgcgtgtggatcgaggagaacccctggatggaggacaagacgcacatcagctcctggggcgacgtgccctacctcgggaagcgggaggaccagtggtgcggcagcctgatcggcctgaccgcccgcgccacctgggcgaccaacatccaggtcgccatcaaccaggtgcgccggctcatcgggaacgagaactacctggactacatgacctccatgaagcgcttcaagaacgagagcgacccggagggcgccctgtggtga

SEQ ID NO: 8537 - RNA, 9879 nt, synthetic construct
  misc_feature 1..9879: note = derived and/or modified CDS sequence (opt1) from DENV-1__GQ199824__SS-prME
  source 1..9879: mol_type = other RNA
agcgtgaccatgctgctgatgctgatgcccaccgccctggccttccacctcacgacccggggcggggagccccacatgatcgtgtccaagcaggagcggggcaagagcctgctgttcaagacctccgcgggggtgaacatgtgcaccctcatcgccatggacctgggcgagttctgcgaggacacgatgacctacaagtgcccccgcatcaccgaggccgagcccgacgacgtggactgctggtgcaacgccaccgacacgtgggtcacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtcgagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagaccgtccagtacgagaacctgaagtacagcgtgatcgtgaccgtccacacgggcgaccagcaccaggtggggaacgagtccaccgagcacggcaccaccgcgaccatcacgccccaggcccccagcaccgagatccagctgaccgactacggggccctcaccctggactgcagcccccggacgggcctggacttcaacgagatggtcctcctgaccatgaaggagaagtcctggctggtgcacaagcagtggttcctcgacctgccgctgccctggaccagcggggcctccaccagccaggagacgtggaaccggaaggacctcctggtgaccttcaagaccgcccacgcgaagaagcaggaggtcgtggtgctgggctcccaggagggcgccatgcacaccgccctcacgggggccaccgagatccagaccagcggcaccacgaccatcttcgccgggcacctgaagtgccgcctgaagatggacaagctcaccctgaagggcatgtcctacgtcatgtgcaccgggagcttcaagctggagaaggaggtggcggagacgcagcacggcaccgtgctcgtccagatcaagtacgagggcaccgacgccccctgcaagatccccttctccacccaggacgagaagggggtgacgcagaacggccggctgatcaccgccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacacggcctgggacttcgggagcatcggcggcgtgttcacctccgtcgggaagctggtgcaccagatcttcggcaccgcctacggggtgctgttcagcggcgtctcctggaccatgaagatcgggatcggcgtgctcctgacgtggctgggcctcaacagccgctccaccagcctgtccatgacctgcatcgccgtggggctggtcaccctctacctgggcgtgatggtgcaggccgacagcgggtgcgtcatcaactggaagggccgggagctgaagtgcgggagcggcatcttcgtgacgaacgaggtgcacacctggaccgagcagtacaagttccaggcggactccccgaagcgcctcagcgccgccatcggcaaggcctgggaggagggggtctgcggcatccggtccgccacccgcctggagaacatcatgtggaagcagatcctgaacgagctcaaccacatcctgctggagaacgacatgaagttcaccgtggtggtcggggacgtggcgggcatcctcgcccaggggaagaagatgatccggccccagcccatggagtacaagtacagctggaagtcctggggcaaggccaagatcatcggcgccgacgtgcagaacacgaccttcatcatcgacgggcccaacaccccggagtgccccgacgaccagcgcgcgtggaacatctgggaggtcgaggactacggcttcgggatcttcaccacgaacatctggctgaagctgcgggacagctacacccaggtgtgcgaccaccgcctcatgtccgccgccatcaaggacagcaaggccgtgcacgccgacatgggctactggatcgagtccgagaagaacgagacctggaagctggcgcgggccagcttcatcgaggtcaagacctgcatctggcccaagtcccacacgctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcaccacggtggtcgtggacgagcactgcggcaaccgggggccgtccctgcgcaccaccaccgtgacgggcaagatcatccacgagtggtgctgccggagctgcaccctgccgcccctccgcttcaagggggaggacggctgctggtacgggatggagatccggcccgtcaaggagaaggaggagaacctggtgaagtccatggtgagcgccggcagcggcgaggtcgactccttcagcctcgggctgctgtgcatctccatcatgatcgaggaggtgatgcgcagccggtggtcccgcaagatgctcatgaccggcaccctggccgtgttcttcctgctcatcatggggcagctgacgtggaacgacctgatccggctctgcatcatggtcggcgcgaacgccagcgaccgcatggggatgggcaccacctacctggccctgatggccaccttcaagatgcgcccgatgttcgccgtgggcctcctgttccggcgcctgacgtcccgggaggtgctcctgctgaccatcgggctcagcctggtcgcgtccgtggagctgcccaacagcctcgaggagctgggcgacgggctggccatgggcatcatgatcctcaagctgctgaccgacttccagtcccaccagctctgggccaccctgctgagcctcacgttcatcaagaccaccttctccctgcactacgcctggaagaccatggcgatggtcctgagcatcgtgtccctcttccccctgtgcctgagcacgacctcccagaagaccacctggctccccgtgctgctgggcagcctcgggtgcaagccgctgacgatgttcctgatcgccgagaacaagatctggggccgcaagtcctggcccctcaacgaggggatcatggccgtcggcatcgtgagcatcctgctgagctccctcctgaagaacgacgtgcccctggccgggcccctcatcgccggcggcatgctgatcgcgtgctacgtcatcagcgggtccagcgccgacctgtccctcgagaaggccgccgaggtgagctgggaggaggaggccgagcactccggcgcgagccacaacatcctggtggaggtccaggacgacgggaccatgaagatcaaggacgaggagcgggacgacaccctgaccatcctcctgaaggccaccctgctcgccgtgtccggcgtgtacccgctgagcatccccgccacgctgttcgtctggtacttctggcagaagaagaagcagcgctccggggtgctctgggacacccccagcccgcccgaggtggagcgggccgtcctggacgacggcatctaccgcatcatgcagcggggcctgctggggcgctcccaggtgggcgtgggggtcttccaggagaacgtgttccacaccatgtggcacgtgacccggggcgcggtcctcatgtaccaggggaagcgcctggagcccagctgggcctccgtgaagaaggacctgatcagctacggcggcgggtggcggctccagggctcctggaacacgggggaggaggtgcaggtcatcgccgtggagcccggcaagaaccccaagaacgtgcagaccgcccccgggaccttcaagaccagcgagggcgaggtcggcgccatcgcgctggacttcaagcccgggacgtccggcagccccatcgtgaaccgcgaggggaagatcgtgggcctgtacggcaacggggtcgtgaccaccagcggcacctacgtgtccgccatcgcccaggccaaggcgagccaggaggggcccctcccggagatcgaggacgaggtcttccggaagcgcaacctgacgatcatggacctgcaccccggctccgggaagacccggcgctacctccccgccatcgtgcgggaggccatcaagcgcaagctgcggaccctgatcctcgccccgacccgcgtggtcgccagcgagatggcggaggccctgaagggcatgcccatccgctaccagacgaccgccgtgaagtccgagcacaccggcaaggagatcgtggacctgatgtgccacgccaccttcacgatgcggctcctgagccccgtccgcgtgcccaactacaacatgatcatcatggacgaggcccacttcaccgacccgtccagcatcgcggcccgggggtacatctccacccgcgtgggcatgggggaggccgccgccatcttcatgaccgcgacgccgcccggcagcgtcgaggccttcccccagtccaacgccgtgatccaggacgaggagcgggacatcccggagcgcagctggaactccgggtacgagtggatcaccgacttccccggcaagaccgtgtggttcgtccccagcatcaagtccggcaacgacatcgccaactgcctgcggaagaacgggaagcgcgtgatccagctcagccggaagaccttcgacacggagtaccagaagaccaagaacaacgactgggactacgtggtcaccaccgacatctccgagatgggcgcgaacttccgcgccgaccgggtgatcgacccccgccggtgcctgaagccggtgatcctgaaggacgggcccgagcgcgtcatcctcgccggccccatgcccgtgacggtcgccagcgccgcgcagcggcgcgggcggatcggccgcaaccacaacaaggagggcgaccagtacatctacatggggcagccgctgaacaacgacgaggaccacgcccactggaccgaggccaagatgctgctcgacaacatcaacacccccgagggcatcatccccgccctgttcgagcccgagcgggagaagtccgccgcgatcgacggggagtaccgcctgcgcggcgaggcccggaagaccttcgtggagctcatgcgccgcggggacctgccggtgtggctgagctacaaggtcgccagcgagggcttccagtactccgaccgccggtggtgcttcgacggcgagcgcaacaaccaggtgctcgaggagaacatggacgtggagatctggacgaaggagggggagcggaagaagctgcgcccccggtggctggacgcccgcacctacagcgaccccctcgccctgcgggagttcaaggagttcgcggccggccgccggtccgtcagcggggacctgatcctcgagatcggcaagctgccccagcacctgacccagcgcgcccagaacgccctcgacaacctggtgatgctgcacaactccgagcagggcgggcgggcgtaccgccacgccatggaggagctcccggacaccatcgagacgctgatgctgctcgccctgatcgccgtgctgaccggcggggtcaccctcttcttcctgagcggccgggggctgggcaagacctccatcggcctcctgtgcgtgatggccagctccgtgctgctctggatggcgagcgtcgagccccactggatcgccgcctccatcatcctggagttcttcctgatggtgctcctgatccccgagcccgaccgccagcggaccccgcaggacaaccagctggcctacgtggtcatcgggctcctgttcatgatcctgacggtggccgcgaacgagatgggcctcctggagaccaccaagaaggacctggggatcggccacgtggccgtcgagaaccaccaccacgccgccatgctcgacgtggacctgcaccccgccagcgcgtggaccctgtacgccgtggccacgaccatcatcacccccatgatgcgccacaccatcgagaacacgaccgccaacatctccctcaccgccatcgcgaaccaggccgccatcctgatggggctggacaagggctggccgatcagcaagatggacatcggcgtccccctcctggccctggggtgctactcccaggtgaaccccctcaccctgacggcggccgtgctgatgctcgtcgcccactacgccatcatcggccccgggctgcaggccaaggcgacccgggaggcccagaagcgcaccgccgccggcatcatgaagaacccgaccgtggacgggatcgtggccatcgacctggaccccgtcgtgtacgacgcgaagttcgagaagcagctcggccagatcatgctgctgatcctctgcacgagccagatcctgctgatgcgcaccacctgggccctctgcgagtccatcaccctggccacgggccccctgaccaccctctgggaggggagccccggcaagttctggaacaccacgatcgccgtgtccatggccaacatcttccgggggagctacctggcgggcgccggcctggccttcagcctcatgaagtccctcgggggcgggcgccgggggaccggggcccagggcgagaccctgggcgagaagtggaagcgccagctcaaccagctgagcaagtccgagttcaacacctacaagcggagcgggatcatggaggtcgaccgctccgaggcgaaggagggcctgaagcgcggggagacgaccaagcacgccgtgagccgcggcaccgccaagctccggtggttcgtggagcgcaacctggtcaagccggaggggaaggtgatcgacctgggctgcggccgcggcgggtggtcctactactgcgccgggctgaagaaggtgaccgaggtcaaggggtacacgaagggcgggcccggccacgaggagcccatccccatggccacctacgggtggaacctcgtgaagctgcacagcggcaaggacgtgttcttcatcccgcccgagaagtgcgacaccctgctctgcgacatcggggagtccagccccaaccccaccatcgaggagggccgcacgctgcgggtcctgaagatggtggagccgtggctccgcgggaaccagttctgcatcaagatcctgaacccctacatgccctccgtggtcgagaccctggagcagatgcagcggaagcacggcggcatgctcgtgcgcaaccccctgagccggaactccacccacgagatgtactgggtgagctgcgggaccggcaacatcgtctccgcggtgaacatgaccagccgcatgctgctcaaccggttcacgatggcccaccgcaagccgacctacgagcgcgacgtggacctgggggccggcacccggcacgtcgccgtggagcccgaggtggccaacctggacatcatcggccagcgcatcgagaacatcaagcacgagcacaagtccacctggcactacgacgaggacaacccctacaagacgtgggcgtaccacgggagctacgaggtcaagccctccggcagcgccagctccatggtgaacggggtcgtgaagctcctgaccaagccgtgggacgtgatccccatggtcacccagatcgccatgaccgacacgacccccttcggccagcagcgggtgttcaaggagaaggtggacacccgcacccccaaggccaagcgggggacggcccagatcatggaggtcaccgcgaagtggctgtggggcttcctcagccgcaacaagaagccgcggatctgcacccgcgaggagttcacccggaaggtgcgctccaacgccgccatcggcgccgtgttcgtcgacgagaaccagtggaacagcgcgaaggaggccgtggaggacgagcggttctgggacctggtgcaccgcgagcgggagctgcacaagcaggggaagtgcgccacgtgcgtctacaacatgatgggcaagcgcgagaagaagctcggggagttcggcaaggccaaggggtcccgggccatctggtacatgtggctgggcgcgcgcttcctggagttcgaggccctcggcttcatgaacgaggaccactggttcagccgggagaactccctgagcggggtggagggcgaggggctgcacaagctcggctacatcctgcgcgacatctccaagatccccgggggcaacatgtacgccgacgacaccgccggctgggacacccggatcaccgaggacgacctgcagaacgaggccaagatcacggacatcatggagcccgagcacgcgctcctggccaagagcatcttcaagctgacctaccagaacaaggtggtccgcgtgcagcggccggccaagaacgggaccgtgatggacgtcatctcccgccgcgaccagcggggcagcggccaggtgggcacctacggcctcaacacgttcaccaacatggaggcccagctgatccgccagatggagtccgaggggatcttcagcccctccgagctggagacccccaacctcgccggccgggtgctggactggctggagaagcacggggtcgagcgcctcaagcggatggcgatcagcggcgacgactgcgtggtgaagcccatcgacgaccgcttcgccaccgccctgacggccctgaacgacatggggaaggtccggaaggacatcccgcagtgggagccctccaagggctggaacgactggcagcaggtccccttctgcagccaccacttccaccagctcatcatgaaggacggccgcgagatcgtggtcccctgccggaaccaggacgagctggtggggcgcgcccgggtgagccagggcgcggggtggtccctgcgcgagaccgcctgcctcggcaagagctacgcccagatgtggcagctgatgtacttccaccggcgcgacctgcggctcgccgcgaacgccatctgctccgccgtcccggtggactgggtgcccaccagccgcaccacgtggtccatccacgcccaccaccagtggatgaccaccgaggacatgctgagcgtctggaaccgggtgtggatcgaggagaacccctggatggaggacaagacccacatctccagctggggcgacgtgccctacctgggcaagcgcgaggaccagtggtgcggctccctcatcgggctgacggcccgggcgacctgggccaccaacatccaggtcgccatcaaccaggtgcgccgcctgatcggcaacgagaactacctcgactacatgaccagcatgaagcggttcaagaacgagtccgacccggagggggccctgtggtga

SEQ ID NO: 8538 - RNA, 9879 nt, synthetic construct
  misc_feature 1..9879: note = derived and/or modified CDS sequence (opt1) from DENV-1__FJ882559__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagaccagcgccggggtgaacatgtgcaccctcatcgccatggacctgggcgagttctgcgaggacaccatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggaccagcggggcctccaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctcgtccagatcaagtacgagggcaccgacgccccctgcaagatccccttctccacccaggacgagaagggggtgacccagaacggccggctgatcacggccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacaccgcctgggacttcgggagcatcggcggcgtgttcacgtccgtcgggaagctggtgcaccagatcttcggcaccgcctacggggtgctgttcagcggcgtctcctggaccatgaagatcgggatcggcgtgctcctgacctggctgggcctcaacagccgctccacgagcctgtccatgacctgcatcgccgtggggctggtcaccctctacctgggcgtgatggtgcaggccgacagcgggtgcgtcatcaactggaagggccgggagctgaagtgcgggagcggcatcttcgtgaccaacgaggtgcacacgtggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagttcaccgtggtggtcggggacgtggcgggcatcctggcccaggggaagaagatgatccggccccagcccatggagtacaagtactcctggaagtcctggggcaaggcccgcatcatcggcgccgacgtgcagaacaccacgttcatcatcgacgggcccaacaccccggagtgccccgacgaccagcgggcgtggaacatctgggaggtcgaggactacggcttcgggatcttcaccaccaacatctggctccgcctgcgggactcctacacccaggtgtgcgaccaccgcctgatgagcgccgccatcaaggactccaaggccgtgcacgccgacatgggctactggatcgagagcgagaagaacgagacctggaagctcgcgcgggcctccttcatcgaggtcaagacctgcatctggcccaagagccacaccctgtggtccaacggcgtgctggagagcgagatgatcatccccaagatctacgggggcccgatctcccagcacaactaccgccccgggtacttcacgcagaccgccggcccctggcacctcgggaagctggagctggacttcgacctctgcgagggcaccaccgtggtcgtggacgagcactgcggcaaccgggggccgagcctgcgcacgaccaccgtgaccggcaagatcgtccacgagtggtgctgccggtcctgcacgctgccgcccctgcgcttcaagggggaggacggctgctggtacgggatggagatccggcccgtgaaggagaaggaggagaacctggtcaagagcatggtcagcgccggctccggcgaggtggacagcttctccctggggctcctgtgcatcagcatcatgatcgaggaggtgatgcgctcccggtggagccgcaagatgctgatgaccggcaccctcgccgtcttcttcctgctgatcatggggcagctcacctggaacgacctgatccgcctgtgcatcatggtgggcgcgaacgcctccgaccggatggggatgggcatgacgtacctcgccctgatggccaccttcaagatgcgcccgatgttcgccgtgggcctcctgttccggcgcctgaccagccgggaggtcctgctcctgaccatcgggctgtccctcgtggcgagcgccgagctgcccaactccctggaggagctcggcgacgggctggccatgggcatcatgatcctgaagctcctgacggacttccagagccaccagctgtgggccaccctcctgtccctgaccttcatcaagaccacgttcagcctccactacgcgtggaagaccatggccatggtcctgtccatcgtgagcctgttccccctctgcctgtccaccaccagccagaagacgacctggctgcccgtgctcctgggctccctggggtgcaagccgctcaccatgttcctgatcgccgagaacaagatctggggccgcaagagctggcccctgaacgaggggatcatggccgtcggcatcgtgagcatcctcctgtccagcctgctcaagaacgacgtgcccctggccgggcccctgatcgcgggcggcatgctcatcgcctgctacgtcatctccgggagctccgccgacctgagcctggagaaggccgccgaggtgtcctgggaggaggaggcggagcacagcggcgcctcccacaacatcctcgtggaggtccaggacgacgggaccatgaagatcaaggacgaggagcgggacgacacgctgaccatcctgctcaaggccaccctgctggccgtgagcggcgtgtacccgctctccatccccgccaccctgttcgtctggtacttctggcagaagaagaagcagcgcagcggggtgctgtgggacacccccagcccgcccgaggtggagcgggcggtcctcgacgacggcatctaccgcatcatgcagcggggcctgctggggcgcagccaggtgggcgtgggggtcttccaggagaacgtgttccacacgatgtggcacgtgacccggggcgccgtcctgatgtaccaggggaagcgcctcgagccctcctgggccagcgtgaagaaggacctgatctcctacggcggcgggtggcggctgcagggcagctggaacaccggggaggaggtgcaggtcatcgccgtggagcccggcaagaaccccaagaacgtgcagaccgcccccgggacgttcaagacctccgagggcgaggtcggcgcgatcgccctcgacttcaagcccgggaccagcggcagccccatcgtgaaccgcgaggggaagatcgtgggcctgtacggcaacggggtcgtgaccacgtccggcacctacgtgagcgccatcgcccaggcgaaggcctcccaggaggggcccctgccggagatcgaggacgaggtcttccggaagcgcaacctcaccatcatggacctgcaccccggcagcgggaagacccggcgctacctgcccgccatcgtgcgggaggccatcaagcgcaagctccgcacgctgatcctggccccgacccgggtggtcgcgtccgagatggccgaggccctcaagggcatgcccatccgctaccagaccaccgccgtcaagagcgagcacacgggcaaggagatcgtggacctgatgtgccacgccaccttcaccatgcggctgctctcccccgtccgcgtgcccaactacaacatgatcatcatggacgaggcgcacttcaccgacccgagctccatcgccgcccgggggtacatcagcacgcgcgtgggcatgggggaggccgccgcgatcttcatgaccgccacgccgcccggctccgtcgaggccttcccccagagcaacgccgtgatccaggacgaggagcgggacatcccggagcgctcctggaacagcgggtacgagtggatcaccgacttccccggcaagacggtgtggttcgtcccctccatcaagagcggcaacgacatcgcgaactgcctgcggaagaacgggaagcgcgtgatccagctgtcccggaagaccttcgacaccgagtaccagaagaccaagaacaacgactgggactacgtggtcacgaccgacatcagcgagatgggcgccaacttccgcgccgaccgggtgatcgacccccgccggtgcctcaagccggtgatcctgaaggacgggcccgagcgcgtcatcctggccggccccatgcccgtgaccgtcgcctccgcggcccagcggcgcgggcggatcggccgcaaccacaacaaggagggcgaccagtacatctacatggggcagccgctcaacaacgacgaggaccacgcccactggaccgaggccaagatgctgctggacaacatcaacacgcccgagggcatcatccccgccctcttcgagcccgagcgcgagaagtccgcggccatcgacggggagtaccggctgcgcggcgaggcccggaagaccttcgtggagctgatgcgccgcggggacctcccggtgtggctgagctacaaggtcgcctccgagggcttccagtacagcgaccgccggtggtgcttcgacggcgagcgcaacaaccaggtgctggaggagaacatggacgtggagatctggaccaaggagggggagcggaagaagctccgcccccggtggctggacgcccgcacctactccgaccccctggcgctccgggagttcaaggagttcgccgccggccgccggagcgtctccggggacctgatcctggagatcggcaagctcccccagcacctgacgcagcgcgcccagaacgcgctggacaacctcgtgatgctgcacaacagcgagcagggcgggcgggcctaccgccacgccatggaggagctgccggacaccatcgagaccctcatgctgctggccctcatcgccgtgctgaccggcggggtcacgctgttcttcctctccggccgggggctgggcaagaccagcatcggcctgctctgcgtgatggcgtccagcgtgctgctgtggatggcctccgtcgagccccactggatcgccgccagcatcatcctcgagttcttcctgatggtgctgctcatccccgagcccgaccgccagcggaccccgcaggacaaccagctggcctacgtggtcatcgggctcctcttcatgatcctgaccgtggcggccaacgagatgggcctgctcgagaccacgaagaaggacctggggatcggccacgtggccgtcgagaaccaccaccacgccgccatgctggacgtggacctccaccccgcgtccgcctggaccctgtacgccgtggccaccaccatcatcacgcccatgatgcgccacaccatcgagaacaccaccgccaacatcagcctgacggcgatcgccaaccaggccgccatcctcatggggctggacaagggctggccgatctccaagatggacatcggcgtccccctgctcgcgctggggtgctacagccaggtgaaccccctgaccctcaccgccgccgtgctgatgctggtcgcccactacgccatcatcggccccgggctccaggcgaaggccacccgcgaggcccagaagcggacggccgccggcatcatgaagaacccgaccgtggacgggatcgtggcgatcgacctggaccccgtcgtgtacgacgccaagttcgagaagcagctgggccagatcatgctcctgatcctgtgcacctcccagatcctcctgatgcgcaccacgtgggccctgtgcgagagcatcaccctcgccaccggccccctgaccacgctgtgggaggggtcccccggcaagttctggaacaccaccatcgccgtgagcatggcgaacatcttccgggggagctacctcgccggcgccggcctggccttctccctgatgaagtccctcgggggcgggcgccggggcaccggggcgcagggcgagacgctgggcgagaagtggaagcgccagctgaaccagctctccaagagcgagttcaacacctacaagcggtccgggatcatggaggtcgaccgcagcgaggccaaggagggcctgaagcgcggggagaccaccaagcacgccgtgtcccgcggcacggccaagctgcggtggttcgtggagcgcaacctcgtcaagccggaggggaaggtgatcgacctgggctgcggccgcggcgggtggagctactactgcgccgggctgaagaaggtgaccgaggtcaaggggtacaccaagggcgggcccggccacgaggagcccatccccatggcgacctacgggtggaacctggtgcgcctccactccggcaaggacgtgttcttcacgccgcccgagaagtgcgacaccctgctgtgcgacatcggggagagctcccccaaccccaccatcgaggagggccggaccctccgcgtcctgaagatggtggagccgtggctgcgggggaaccagttctgcatcaagatcctcaacccctacatgcccagcgtggtcgagacgctggagcagatgcagcgcaagcacggcggcatgctggtgcggaaccccctctcccgcaacagcacccacgagatgtactgggtgtcctgcgggaccggcaacatcgtcagcgccgtgaacatgacctcccgcatgctgctgaaccggttcaccatggcccaccgcaagccgacgtacgagcgggacgtggacctcggggccggcacccgccacgtcgccgtggagcccgaggtggcgaacctggacatcatcggccagcggatcgagaacatcaagcacgagcacaagagcacctggcactacgacgaggacaacccctacaagacctgggcctaccacgggtcctacgaggtcaagcccagcggcagcgcctccagcatggtgaacggggtcgtgaagctgctcacgaagccgtgggacgtgatccccatggtcacccagatcgccatgaccgacaccacgcccttcggccagcagcgcgtgttcaaggagaaggtggacacccggacccccaaggccaagcgcgggaccgtccagatcatggaggtgacggcgaagtggctgtggggcttcctgtcccggaacaagaagccgcgcatctgcacccgggaggagttcacccgcaaggtgcggagcaacgccgccatcggcgccgtcttcgtggacgagaaccagtggaactccgcgaaggaggccgtggaggacgagcgcttctgggacctcgtccaccgggagcgcgagctgcacaagcaggggaagtgcgcgacctgcgtgtacaacatgatgggcaagcgggagaagaagctgggggagttcggcaaggccaaggggagccgcgccatctggtacatgtggctcggcgcgcggttcctggagttcgaggccctgggcttcatgaacgaggaccactggttctcccgcgagaacagcctctccggggtggagggcgaggggctgcacaagctgggctacatcctccgggacatcagcaagatccccgggggcaacatgtacgccgacgacacggccggctgggacacccgcatcaccgaggacgacctgcagaacgaggccaagatcaccgacatcatggagcccgagcacgcgctgctcgccaagtccatcttcaagctgacgtaccagaacaaggtcgtgcgcgtgcagcggccggccaagaacgggaccgtcatggacgtgatcagccgccgggaccagcgcggctccggccaggtgggcacctacggcctgaacaccttcacgaacatggaggcccagctcatccggcagatggagagcgaggggatcttctcccccagcgagctggagacccccaacctggccgagcgcgcgctcgactggctggagaagcacggcgtcgagcggctgaagcgcatggccatctccggggacgactgcgtggtgaagcccatcgacgaccggttcgccaccgccctcaccgccctgaacgacatgggcaaggtccgcaaggacatcccgcagtgggagcccagcaaggggtggaacgactggcagcaggtccccttctgcagccaccacttccaccagctgatcatgaaggacggccgggagatcgtggtcccctgccgcaaccaggacgagctcgtgggccgggcgcgcgtgtcccagggggccggctggagcctgcgggagacggcctgcctggggaagtcctacgcccagatgtggcagctcatgtacttccaccgccgggacctgcgcctggcggccaacgccatctgcagcgccgtcccggtggactgggtgcccacctcccggaccacctggagcatccacgcccaccaccagtggatgacgaccgaggacatgctctccgtctggaaccgcgtgtggatcgaggagaacccctggatggaggacaagacccacatcagctcctggggcgacgtgccctacctggggaagcgcgaggaccagtggtgcggcagcctgatcggcctcaccgcgcgggccacgtgggccaccaacatccaggtcgccatcaaccaggtgcgccggctgatcgggaacgagaactacctggactacatgacctccatgaagcgcttcaagaacgagagcgacccggagggcgccctctggtga

SEQ ID NO: 8539 - RNA, 9879 nt, synthetic construct
  misc_feature 1..9879: note = derived and/or modified CDS sequence (opt1) from DENV-1__GQ199828__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgcgggggtgaacatgtgcaccctcatcgccatggacctgggcgagctgtgcgaggacaccatgacctacaagtgcccccggatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtggagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtcctcttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggccgactccgggtgcgtcatcaactggaagggccgggagctcaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctggagaacatcatgtggaagcagatctccaacgagctcaaccacatcctgctggagaacgacatgaagctcaccgtggtggtcggggacgtggcgggcatcctggggcagggcaagaagatgatccggccccagcccatggagtacaagtacagctggaagtcctggggcaaggccaagatcatcggggccgacgcccagaacacgaccttcatcatcgacggccccaacaccccggagtgccccgacgaccagcgcgcgtggaacatctgggaggtggaggactacgggttcggcatcttcaccacgaacatctggctgaagctccgggacagctacacccaggtctgcgaccaccgcctgatgtccgccgccatcaaggacagcaaggccgtgcacgccgacatgggctactggatcgagtccgagaagaacgagacctggaagctggcgcgggccagcttcatcgaggtgaagacctgcgtctggcccaagtcccacacgctctggagcaacggggtgcgcgagtccgagatgatcatccccaagatctacggcgggccgatcagccagcacaactaccggcccggctacttcacccagaccgccgggccctggcacctgggcaagctggagctcgacttcgacctgtgcgagggcaccacggtggtcgtggacgagcactgcgggaaccgcggcccgtccctgcggaccaccaccgtgacggggaagatcatccacgagtggtgctgccgcagctgcaccctgccgcccctccggttccgcggcgaggacgggtgctggtacggcatggagatccggcccgtcaaggagaaggaggagaacctggtgaagtccatggtgagcgccggcagcggggaggtcgactccttcagcctcggcctgctgtgcatctccatcatgatcgaggaggtgatgcgcagccggtggtcccgcaagatgctcatgatcgggaccctggccgtgttcttcctgctcatcatgggccagctgacctggaacgacctgatccgcctctgcatcatggtcggggcgaacgccagcgaccggatgggcatgggcacgacctacctggccctgatggccaccttcaagatgcgcccgatgttcgccgtggggctcctgttccggcgcctgacctcccgggaggtgctcctgctgacgatcggcctcagcctggtcgcgtccgtggagctgcccaacagcctcgaggagctgggggacggcctggccatgggcatcatgatcctcaagctgctgaccgacttccagtcccaccagctctgggccaccctgctgagcctcaccttcatcaagacgaccttctccctgcactacgcctggaagaccatggcgatggtcctgagcatcgtgtccctcttccccctgtgcctgagcaccacgtcccagaagaccacctggctccccgtgctgctggggagcctcggctgcaagccgctgaccatgttcctgatcgccgagaacaagatctgggggcgcaagtcctggcccctcaacgagggcatcatggccgtcgggatcgtgagcatcctgctgagctccctcctgaagaacgacgtgcccctggccggccccctcatcgccggcgggatgctgatcgcgtgctacgtcatcagcggctccagcgccgacctgtccctcgagaaggccgccgaggtgagctgggaggaggaggccgagcactccggggcgagccacaacatcctggtggaggtccaggacgacggcacgatgaagatcaagaacgaggagcgggacgacaccctgaccatcctcctgaaggccaccctgctcgccgtgtccggggtgtacccgctgagcatccccgccaccctgttcgtctggtacttctggcagaagaagaagcagcgctccggcgtgctctgggacacgcccagcccgcccgaggtggagcgggccgtcctggacgacggcatctaccgcatcatgcagcgggggctgctgggccgctcccaggtgggggtgggcgtcttccaggagaacgtgttccacaccatgtggcacgtgacccgcggggcggtcctcatgtaccagggcaagcgcctggagcccagctgggcctccgtgaagaaggacctgatcagctacggcgggggctggcggctccgcgggtcctggaacaccggcgaggaggtgcaggtcatcgccgtggagcccgggaagaaccccaagaacgtgcagacggcccccggcaccttcaagacccccgagggcgaggtcggggccatcgcgctggacttcaagcccggcaccagcgggtcccccatcgtgaaccgggagggcaagatcgtgggcctgtacgggaacggcgtcgtgacgaccagcgggacctacgtgagcgccatcgcccaggccaaggcgtcccaggagggcccgctccccgagatcgaggacgaggtcttccgcaagcggaacctgaccatcatggacctgcaccccgggagcggcaagacgcgccggtacctcccggccatcgtgcgcgaggccatcaagcgcaagctgcggaccctgatcctcgcccccacccgcgtggtcgcctccgagatggcggaggccctgaagggcatgcccatccggtaccagaccacggccgtcaagagcgagcacaccgggaaggagatcgtggacctgatgtgccacgccaccttcaccatgcgcctcctgtcccccgtccgggtgccgaactacaacatgatcatcatggacgaggcccacttcacggaccccagctccatcgcggcccgcggctacatcagcacccgggtggggatgggcgaggccgccgccatcttcatgaccgcgacgccgcccgggtccgtcgaggccttcccgcagagcaacgccgtgatccaggacgaggagcgcgacatccccgagcggtcctggaacagcggctacgagtggatcacggacttccccggcaagaccgtgtggttcgtcccctccatcaagagcgggaacgacatcgccaactgcctgcgcaagaacggcaagcgggtgatccagctctcccgcaagaccttcgacaccgagtaccagaagacgaagaacaacgactgggactacgtggtcaccaccgacatcagcgagatgggggcgaacttccgggccgaccgcgtgatcgacccgcggcgctgcctgaagcccgtgatcctgaaggacggccccgagcgggtcatcctcgccgggcccatgccggtgaccgtcgcctccgccgcgcagcgccggggccgcatcggccgcaaccacaacaaggagggggaccagtacatctacatgggccagcccctgaacaacgacgaggaccacgcccactggacggaggccaagatgctgctcgacaacatcaacacccccgaggggatcatccccgccctgttcgagccggagcgggagaagtccgccgcggtggacggcgagtaccgcctgcgcggggaggcccgcaagaccttcgtggagctcatgcggcgcggcgacctgcccgtctggctgtcctacaaggtggccagcgagggcttccagtacagcgaccggcgctggtgcttcgacggggagcggaacaaccaggtgctcgaggagaacatggacgtcgagatctggaccaaggagggcgagcgcaagaagctgcggccccgctggctggacgcccggacgtactccgaccccctcgccctgcgcgagttcaaggagttcgcggccgggcggcgcagcgtgtccggcgacctgatcctcgagatcggcaagctgccgcagcacctgacccagcgggcccagaacgccctcgacaacctggtgatgctgcacaacagcgagcagggcgggcgcgcgtaccggcacgccatggaggagctccccgacaccatcgagaccctgatgctgctcgccctgatcgccgtcctgaccggcggggtgaccctcttcttcctgtccgggcgcgggctgggcaagaccagcatcgggctcctgtgcgtgatggcctccagcgtcctgctctggatggcgtccgtggagccccactggatcgccgccagcatcatcctggagttcttcctgatggtgctcctgatccccgagccggaccggcagcgcacgccccaggacaaccagctggcctacgtcgtgatcggcctcctgttcatgatcctgaccgtggccgcgaacgagatggggctcctggagacgaccaagaaggacctgggcatcgggcacgtcgccgtggagaaccaccaccacgccgccatgctcgacgtggacctgcaccccgcctccgcgtggaccctgtacgccgtcgccaccacgatcatcaccccgatgatgcgccacaccatcgagaacaccacggccaacatcagcctcaccgccatcgcgaaccaggccgccatcctgatgggcctggacaagggctggcccatctccaagatggacatcggggtgcccctcctggccctgggctgctacagccaggtgaaccccctcaccctgaccgcggccgtcctgatgctcgtggcccactacgccatcatcgggccgggcctgcaggccaaggcgacgcgggaggcccagaagcgcaccgccgccgggatcatgaagaaccccaccgtggacggcatcgtcgccatcgacctggaccccgtggtgtacgacgcgaagttcgagaagcagctcggccagatcatgctgctgatcctctgcacctcccagatcctgctgatgcggacgacctgggccctctgcgagagcatcaccctggccaccgggcccctgacgaccctctgggagggctccccggggaagttctggaacaccaccatcgccgtcagcatggccaacatcttccgcggctcctacctggcgggcgccgggctggccttcagcctcatgaagtccctgggcgggggccggcgcgggacgggcgcccagggcgagaccctgggggagaagtggaagcggcagctcaaccagctgtccaagagcgagttcaacacctacaagcgctccggcatcatggaggtggaccggagcgaggcgaaggaggggctgaagcgcggcgagaccacgaagcacgccgtgtcccgggggaccgccaagctccgctggttcgtcgagcggaacctggtgaagcccgagggcaaggtgatcgacctgggctgcgggcgcggcgggtggagctactactgcgccggcctgaagaaggtcaccgaggtgaaggggtacaccaagggcggccccgggcacgaggagcccatcccgatggccacgtacggctggaacctcgtgaagctgcactccgggaaggacgtcttcttcatcccgcccgagaagtgcgacaccctgctctgcgacatcggcgagagctcccccaacccgaccatcgaggaggggcggaccctgcgcgtgctgaagatggtggagccctggctccggggcaaccagttctgcatcaagatcctgaacccctacatgcccagcgtcgtggagacgctggagcagatgcagcgcaagcacggcgggatgctcgtgcggaacccgctgtcccgcaacagcacccacgagatgtactgggtctcctgcggcaccgggaacatcgtgagcgcggtgaacatgacctcccgcatgctgctcaaccggttcaccatggcccaccgcaagcccacgtacgagcgggacgtcgacctgggcaccggcacccgccacgtggccgtggagcccgaggtcgccaacctggacatcatcgggcagcggatcgagaacatcaagcacgagcacaagagcacctggcactacgacgaggacaacccctacaagacgtgggcctaccacggctcctacgaggtgaagccgagcgggtccgcgagcagcatggtcaacggcgtggtgaagctcctgaccaagccctgggacgtcatccccatggtgacccagatcgccatgaccgacacgacccccttcgggcagcagcgcgtgttcaaggagaaggtcgacacccggaccccgaaggccaagcgcggcacggcccagatcatggaggtgaccgcccggtggctgtggggcttcctctcccgcaacaagaagccccggatctgcacccgcgaggagttcacccggaaggtgcgcagcaacgcggccatcggggccgtcttcgtggacgagaaccagtggaactccgccaaggaggcggtggaggacgagcggttctgggacctggtccaccgcgagcgggagctgcacaagcagggcaagtgcgccacgtgcgtgtacaacatgatggggaagcgcgagaagaagctcggcgagttcgggaaggccaagggcagccgggccatctggtacatgtggctgggcgcccgcttcctggagttcgaggcgctcgggttcatgaacgaggaccactggttctcccgggagaacagcctgtccggcgtggagggggagggcctgcacaagctcgggtacatcctgcgcgacatcagcaagatccccggcggcaacatgtacgccgacgacaccgccgggtgggacacccgcatcaccgaggacgacctgcagaacgaggccaagatcacggacatcatggagccggagcacgccctcctggcgaaggccatcttcaagctgacctaccagaacaaggtcgtgcgggtgcagcgccccgccaagaacggcaccgtcatggacgtgatctcccggcgcgaccagcgggggagcggccaggtgggcacctacgggctcaacacgttcaccaacatggaggcccagctgatccgccagatggagtccgaggagatcttcagcccctccgagctggagacccccaacctcgccgagcgggcgctggactggctggagaagtacggcgtcgagcgcctcaagcggatggccatcagcggggacgactgcgtggtgaagccgatcgacgaccgcttcgccaccgccctgacggccctgaacgacatgggcaaggtccggaaggacatcccccagtgggagccctccaaggggtggaacgactggcagcaggtccccttctgcagccaccacttccaccagctcatcatgaaggacggccgcgagatcgtggtcccgtgccggaaccaggacgagctggtgggccgcgcgcgggtgtcccagggggccggctggagcctgcgcgagaccgcctgcctcggcaagagctacgcccagatgtggcagctgatgtacttccaccggcgcgacctgcggctcgcggacaaggccatcggctccgccgtccccgtggactgggtgcccaccagccgcaccacgtggtccatccacgcccaccaccagtggatgaccaccgaggacatgctgagcgtctggaaccgcgtgtggatcgaggagaacccctggatggaggacaagacccacatctccagctgggaggacgtgccgtacctggggaagcgggaggaccagtggtgcggctccctcatcggcctgacggcccgcgcgacctgggccaccaacatccaggtcgccatcaaccaggtgcggcgcctgatcgggaacgagaactacctcgactacatgaccagcatgaagcggttcaagaacgagtccgaccccgagggcgccctgtggtga

SEQ ID NO: 8540 - RNA, 9879 nt, synthetic construct
  misc_feature 1..9879: note = derived and/or modified CDS sequence (opt1) from DENV-1__GQ199829__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacacgatgacctacaagtgcccccggatcaccgagaccgagcccgacgacgtggactgctggtgcaacgccacggacacctgggtgacctacgggacctgcagccagacgggcgagcaccggcgcgacaagcggtccgtggccctcgcgccccacgtgggcctggggctggagacccggaccgagacctggatgagctccgagggcgcgtggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgctggtggaccggggctgggggaacggctgcgggctgttcggcaaggggtccctgatcacgtgcgccaagttcaagtgcgtgaccaagctggagggcaagatcgtccagtacgagaacctcaagtacagcgtgatcgtgaccgtccacacgggcgaccagcaccaggtggggaacgagtccaccgagcacggcaccaccgccaccatcacgccccaggcgcccaccaccgagatccagctgaccgactacggggccctgacgctcgactgcagcccccgcaccggcctggacttcaacgagatggtcctgctcaccatgaaggagaagtcctggctggtgcacaagcagtggttcctggacctccccctgccctggaccagcggggccagcacgtcccaggagacctggaaccggcaggacctgctcgtgaccttcaagaccgcccacgccaagaagcaggaggtcgtggtgctgggcagccaggagggcgcgatgcacacggccctgaccggggccaccgagatccagacctccggcacgaccaccatcttcgccgggcacctcaagtgccgcctgaagatggacaagctgaccctcaagggcatgagctacgtcatgtgcacggggtccttcaagctggagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcgtgatcggcgccggcgagaaggcgctcaagctgagctggttcaagaaggggtccagcatcggcaagatgttcgaggccacggcccgcggggcccggcgcatggccatcctgggcgacaccgcgtgggacttcgggtccatcggcggcgtgttcaccagcgtcgggaagctcgtgcaccagatcttcggcaccgcctacggggtgctgttctccggcgtcagctggacgatgaagatcgggatcggcgtgctgctcacctggctgggcctgaactcccgcagcacctccctcagcatgacctgcatcgccgtggggctggtcacgctgtacctcggcgtgatggtgcaggccgactccgggtgcgtcatcaactggaagggccgggagctgaagtgcgggagcggcatcttcgtgaccaacgaggtgcacacctggaccgagcagtacaagttccaggccgacagcccgaagcgcctgtccgcggccatcggcaaggcctgggaggagggggtctgcggcatccggagcgccacccgcctcgagaacatcatgtggaagcagatctccaacgagctgaaccacatcctgctcgagaacgacatgaagttcacggtggtggtcggggacgtggccggcatcctggcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtcgaggactacggcttcgggatcttcacgaccaacatctggctgaagctccgggacagctacacccaggtgtgcgaccaccgcctgatgtccgcggccatcaaggacagcaaggccgtgcacgccgacatgggctactggatcgagtccgagaagaacgagacctggaagctggcccgggcgagcttcatcgaggtcaagacgtgcatctggccccgctcccacaccctctggagcaacggcgtgctggagtccgagatgatcatccccaagatctacgggggcccgatcagccagcacaactaccggcccgggtacttcacccaggccgccggcccctggcacctggggaagctcgagctggacttcgacctgtgcgagggcaccacggtggtcgtggacgagcactgcggcaaccgcgggccgtccctccggaccaccaccgtgacgggcaagatcatccacgagtggtgctgccgcagctgcaccctgccgcccctgcggttccgcggggaggacggctgctggtacgggatggagatccggcccgtcaaggagaaggaggagaacctcgtgaagtccatggtgagcgccggcagcggcgaggtcgactccttcagcctggggctgctctgcatctccatcatgatcgaggaggtgatgcgcagccggtggtcccgccgcatgctgatgaccggcaccctggccgtgttcttcctcctgatcatggggcagctgacgtggaacgacctcatccggctgtgcatcatggtcggcgcgaacgccagcgaccgcatggggatgggcaccacctacctggccctcatggccaccttcaagatgcggccgatgttcgccgtgggcctgctgttccgccggctcacgtcccgcgaggtgctgctgctcaccatcgggctgagcctggtcgcgtccgtggagctccccaacagcctggaggagctgggcgacgggctcgccatgggcatcatgatcctgaagctgctcaccgacttccagtcccaccagctgtgggccaccctgctcagcctgacgttcatcaagaccaccttctccctgcactacgcctggaagaccatggcgatggtcctcagcatcgtgtccctgttccccctgtgcctcagcacgacctcccagaagaccacctggctgcccgtgctgctcggcagcctggggtgcaagccgctgacgatgttcctcatcgccgagaacaagatctggggccggcgctcctggcccctgaacgaggggatcatggccgtcggcatcgtgagcatcctgctcagctccctgctgaagaacgacgtgcccctcgccgggcccctgatcgccggcggcatgctgatcgcgtgctacgtcatcagcgggtccagcgccgacctctccctggagaaggccgccgaggtgagctgggaggaggaggccgagcactccggcgcgagccacaacatcctggtggaggtccaggacgacgggaccatgaagatcaaggacgaggagcgggacgacaccctcaccatcctgctgaaggccaccctcctggccgtgtccggcgtgtacccgctgagcatccccgccaccctcttcgtctggtacttctggcagaagaagaagcagcgctccggggtgctgtgggacacccccagcccgcccgaggtggagcgggccgtcctggacgacggcatctaccgcatcatgcagcggggcctgctcgggcgctcccaggtgggcgtgggggtcttccaggagaacgtgttccacaccatgtggcacgtgacccggggcgcggtcctgatgtaccaggggaagcgcctggagcccagctgggcctccgtgaagaaggacctcatcagctacggcggcgggtggcggctgcagggctcctggaacacgggggaggaggtgcaggtcatcgccgtggagcccggcaagaaccccaagaacgtgcagaccgcccccgggaccttcaagacccccgagggcgaggtcggcgccatcgcgctggacttcaagcccgggacgagcggctcccccatcgtgaaccgcgaggggaagatcgtgggcctctacggcaacggggtcgtgaccaccagcggcacctacgtgagcgccatcgcccaggccaaggcgtcccaggaggggccgctgcccgagatcgaggacgaggtcttccggaagcgcaacctgacgatcatggacctccaccccggcagcgggaagacccggcgctacctgccggccatcgtgcgcgaggccatcaagcggaagctgcgcaccctcatcctggcccccacccgggtggtcgcctccgagatggcggaggccctgaagggcatgcccatccgctaccagacgaccgccgtcaagagcgagcacaccggcaaggagatcgtggacctcatgtgccacgccaccttcacgatgcggctgctgtcccccgtccgcgtgccgaactacaacatgatcatcatggacgaggcccacttcaccgaccccagctccatcgcggcccgggggtacatcagcacccgcgtgggcatgggggaggccgccgccatcttcatgaccgcgacgccgcccggctccgtcgaggccttcccgcagagcaacgccgtgatccaggacgaggagcgggacatccccgagcgctcctggaacagcgggtacgagtggatcaccgacttccccggcaagaccgtgtggttcgtcccctccatcaagagcggcaacgacatcgccaactgcctccggaagaacgggaagcgcgtgatccagctgtcccggaagaccttcgacacggagtaccagaagaccaagaacaacgactgggactacgtggtcaccaccgacatcagcgagatgggcgcgaacttccgcgccgaccgggtgatcgacccgcgccggtgcctgaagcccgtgatcctcaaggacgggcccgagcgcgtcatcctggccggccccatgccggtgacggtcgcctccgccgcgcagcggcgcgggcgcatcggccggaaccacaacaaggagggcgaccagtacatctacatggggcagcccctgaacaacgacgaggaccacgcccactggaccgaggccaagatgctcctggacaacatcaacacccccgagggcatcatccccgccctgttcgagccggagcgcgagaagtccgccgcgatcgacggggagtaccggctccgcggcgaggcccggaagaccttcgtggagctgatgcgccgcggggacctgcccgtgtggctctcctacaaggtcgccagcgagggcttccagtacagcgaccgccggtggtgcttcgacggcgagcgcaacaaccaggtgctggaggagaacatggacgtggagatctggacgaaggagggggagcggaagaagctgcgcccccggtggctcgacgcccgcacctactccgaccccctggccctgcgggagttcaaggagttcgcggccggccgccggagcgtctccggggacctcatcctggagatcggcaagctgccgcagcacctcacccagcgcgcccagaacgccctggacaacctggtgatgctccacaacagcgagcagggcgggcgggcgtaccgccacgccatggaggagctgcccgacaccatcgagacgctgatgctcctggccctgatcgccgtgctcaccggcggggtcaccctgttcttcctgtccggccgggggctcggcaagaccagcatcggcctgctgtgcgtgatggcctccagcgtgctcctgtggatggcgtccgtcgagccccactggatcgccgccagcatcatcctggagttcttcctcatggtgctgctgatccccgagccggaccgccagcgcacgccccaggacaaccagctcgcctacgtggtcatcgggctgctgttcatgatcctcacggtggccgcgaacgagatgggcctgctggagaccaccaagaaggacctcgggatcggccacgtggccgtcgagaaccaccaccacgccgccatgctggacgtggacctgcaccccgcctccgcgtggaccctctacgccgtggccacgaccatcatcaccccgatgatgcggcacaccatcgagaacacgaccgccaacatcagcctgaccgccatcgcgaaccaggccgccatcctgatggggctcgacaagggctggcccatctccaagatggacatcggcgtccccctgctggccctcgggtgctacagccaggtgaaccccctgaccctgacggcggccgtgctcatgctggtcgcccactacgccatcatcggcccggggctgcaggccaaggcgacccgcgaggcccagaagcggaccgccgccggcatcatgaagaaccccaccgtggacgggatcgtggccatcgacctcgaccccgtcgtgtacgacgcgaagttcgagaagcagctgggccagatcatgctgctcatcctgtgcacgtcccagatcctgctcatgcgcaccacctgggccctgtgcgagagcatcaccctggccacgggccccctcaccaccctgtgggaggggtccccgggcaagttctggaacaccacgatcgccgtgagcatggccaacatcttccgggggtcctacctggcgggcgccggcctcgccttcagcctgatgaagtccctcgggggcgggcgccgggggaccggggcccagggcgagaccctcggcgagaagtggaagcgccagctgaaccagctgtccaagagcgagttcaacacctacaagcggtccgggatcatggaggtcgaccgcagcgaggcgaaggagggcctcaagcgcggggagacgaccaagcacgccgtgtcccgcggcaccgccaagctgcggtggttcgtggagcgcaacctggtcaagcccgaggggaaggtgatcgacctgggctgcggccgcggcgggtggagctactactgcgccgggctcaagaaggtgaccgaggtcaaggggtacacgaagggcggccccggccacgaggagcccatcccgatggccacctacgggtggaacctggtgaagctgcactccggcaaggacgtgttcttcatcccgcccgagaagtgcgacaccctcctgtgcgacatcggggagagctcccccaacccgaccatcgaggagggccgcacgctgcgggtcctcaagatggtggagccctggctgcgcgggaaccagttctgcatcaagatcctgaacccctacatgcccagcgtggtcgagaccctcgagcagatgcagcggaagcacggcggcatgctggtgcgcaacccgctgtcccgcaacagcacccacgagatgtactgggtgtcctgcgggaccggcaacatcgtcagcgcggtgaacatgacctcccggatgctcctgaaccgcttcacgatggcccaccggaagcccacctacgagcgcgacgtggacctgggggccggcacccggcacgtcgccgtggagcccgaggtggccaacctcgacatcatcggccagcgcatcgagaacatcaagcacgagcacaagagcacctggcactacgacgaggacaacccctacaagacgtgggcgtaccacgggtcctacgaggtcaagccgagcggctccgccagcagcatggtgaacggggtcgtgaagctgctgaccaagccctgggacgtgatccccatggtcacccagatcgccatgaccgacacgacccccttcggccagcagcgggtgttcaaggagaaggtggacacccgcaccccgaaggccaagcgggggacggcccagatcatggaggtcaccgcgaagtggctctggggcttcctgtcccgcaacaagaagccccggatctgcacccgcgaggagttcacccggaaggtgcgcagcaacgccgccatcggcgccgtgttcgtcgacgagaaccagtggaactccgcgaaggaggccgtggaggacgagcggttctgggacctggtgcaccgcgagcgggagctccacaagcaggggaagtgcgccacgtgcgtctacaacatgatgggcaagcgcgagaagaagctgggggagttcggcaaggccaaggggagccgggccatctggtacatgtggctgggcgcgcgcttcctcgagttcgaggccctgggcttcatgaacgaggaccactggttctcccgggagaacagcctgtccggggtggagggcgaggggctccacaagctgggctacatcctgcgcgacatcagcaagatccccgggggcaacatgtacgccgacgacaccgccggctgggacacccgcatcaccgaggacgacctccagaacgaggcccggatcacggacatcatggagccggagcacgcgctgctggccaagtccatcttcaagctcacctaccagaacaaggtggtccgcgtgcagcggcccgccaagaacgggaccgtgatggacgtcatcagccgccgggaccagcgcggctccggccaggtgggcacctacggcctgaacacgttcaccaacatggaggcccagctgatccggcagatggagagcgaggggatcttctcccccagcgagctcgagacccccaacctggccgagcgcgtgctggactggctcgagaagtacggcgtcgagcggctgaagcgcatggcgatctccggggacgactgcgtggtgaagccgatcgacgaccggttcgccaccgccctgacggccctcaacgacatgggcaaggtccgcaaggacatcccccagtgggagcccagcaaggggtggaacgactggcagcaggtccccttctgctcccaccacttccaccagctgatcatgaaggacggccgggagatcgtggtcccgtgccgcaaccaggacgagctggtgggccgggcccgcgtgagccagggggcgggctggagcctccgggagaccgcctgcctggggaagtcctacgcccagatgtggcagctgatgtacttccaccgccgggacctccgcctggccgcgaacgccatctgcagcgccgtccccgtggactggatccccacctcccgcaccacgtggagcatccacgcccaccaccagtggatgaccaccgaggacatgctgtccgtgtggaaccgggtctggatcgaggagaacccctggatggaggacaagacccacatcagctcctggggcgacgtgccgtacctcgggaagcgcgaggaccagtggtgcggcagcctgatcggcctgacggcccgggcgacctgggccaccaacatccaggtggccatcaaccaggtccgccggctcatcgggaacgagaactacctggactacatgacctccatgaagcgcttcaagaacgagagcgaccccgagggcgccctgtggtga

SEQ ID NO: 8541 - RNA, 9879 nt, synthetic construct
  misc_feature 1..9879: note = derived and/or modified CDS sequence (opt1) from DENV-1__FJ882562__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcctgttcaccagcgtggggaagctcgtccaccagatcttcggcaccgcctacggggtgctgttctccggcgtgagctggaccatgaagatcgggatcggcgtcctgctcacgtggctgggcctgaactcccgcagcacctccctcagcatgacctgcatcgccgtggggctggtgaccctgtacctcggcgtcatggtgcaggccgactccgggtgcgtgatcaactggaagggccgggagctgaagtgcgggagcggcatcttcgtcacgaacgaggtgcacacctggaccgagcagtacaagttccaggcggacagcccgaagcgcctgtccgccgccatcggcaaggcctgggaggagggggtgtgcggcatccggagcgccacccgcctcgagaacatcatgtggaagcagatctccaacgagctgaaccacatcctgctcgagaacgacatgaagctgaccgtcgtggtgggggacgtcgcgggcatcctggcccaggggaagaagatgatccggccccagcccatggagtacaagtacagctggaagtcctggggcaaggccaagatcatcggcgccgacgcgcagaacacgaccttcatcatcgacgggcccaacaccccggagtgccccgacgaccagcgcgcctggaacatctgggaggtggaggactacggcttcgggatcttcaccacgaacatctggctcaagctgcgggacagctacacccaggtgtgcgaccaccgcctgatgtccgccgccatcaaggacagcaaggccgtccacgcggacatgggctactggatcgagtccgagaagaacgagacctggaagctcgcccgggccagcttcatcgaggtgaagacctgcatctggcccaagtcccacacgctgtggagcaacggcgtgctggagtccgagatgatcatccccaagatctacgggggcccgatcagccagcacaactaccgccccgggtacttcacccagaccgccggcccctggcacctcgggaagctggagctggacttcgacctctgcgagggcaccacggtcgtggtggacgagcactgcggcaaccgggggccgtccctgcgcaccaccaccgtcacgggcaagatcatccacgagtggtgctgccggagctgcaccctgccgcccctgcgcttccgcggggaggacggctgctggtacgggatggagatccgccccgtgaaggagaaggaggagaacctggtgaagtccatggtcagcgccggcagcggcgaggtggactccttcagcctggggctcctgtgcatctccatcatgatcgaggaggtgatgcggagccgctggtcccggaagatgctgatgaccggcaccctcgcggtcttcttcctgctgatcatggggcagctcacgtggaacgacctgatccgcctgtgcatcatggtgggcgccaacgccagcgaccgcatggggatgggcaccacctacctcgccctgatggccaccttcaagatgcggccgatgttcgcggtggggctcctgttccgccggctgacgtcccgcgaggtcctgctcctgaccatcgggctgagcctcgtggcctccgtggagctgcccaacagcctggaggagctcggcgacgggctggccatgggcatcatgatcctgaagctcctgaccgacttccagtcccaccagctgtgggccaccctcctgagcctgacgttcatcaagaccaccttctccctccactacgcgtggaagaccatggccatggtcctgagcatcgtgtccctgttccccctctgcctgagcacgacctcccagaagaccacctggctgcccgtcctcctgggcagcctggggtgcaagccgctcacgatgttcctgatcgccgagaacaagatctggggccggaagtcctggcccctgaacgaggggatcatggccgtgggcatcgtgagcatcctcctgagctccctgctcaagaacgacgtccccctggccgggcccctgatcgcgggcggcatgctcatcgcctgctacgtgatcagcgggtccagcgccgacctgtccctggagaaggccgccgaggtgagctgggaggaggaggcggagcactccggcgccagccacaacatcctcgtcgaggtgcaggacgacgggaccatgaagatcaaggacgaggagcgcgacgacaccctgaccatcctgctcaaggccaccctgctggccgtgtccggcgtctacccgctcagcatccccgccacgctgttcgtgtggtacttctggcagaagaagaagcagcggtccggggtgctgtgggacacccccagcccgcccgaggtcgagcgcgcggtgctggacgacggcatctaccggatcatgcagcgcggcctcctggggcggtcccaggtgggcgtcggggtgttccaggagaacgtgttccacaccatgtggcacgtcacccgcggcgccgtgctgatgtaccaggggaagcggctcgagcccagctgggcctccgtgaagaaggacctgatcagctacggcggcgggtggcgcctgcagggctcctggaacacgggggaggaggtccaggtgatcgccgtggagcccggcaagaaccccaagaacgtccagaccgcccccgggaccttcaagacccccgagggcgaggtgggcgcgatcgccctcgacttcaagcccgggacgagcggctcccccatcgtgaaccgggaggggaagatcgtcggcctgtacggcaacggggtggtgaccaccagcggcacctacgtcagcgccatcgcccaggcgaaggcctcccaggaggggccgctgcccgagatcgaggacgaggtgttccgcaagcggaacctcacgatcatggacctgcaccccggcagcgggaagacccgccggtacctgccggccatcgtgcgcgaggccatcaagcggaagctccgcaccctgatcctggcccccacccgcgtcgtggcgtccgagatggccgaggccctcaagggcatgcccatccggtaccagacgaccgccgtcaagagcgagcacaccggcaaggagatcgtcgacctgatgtgccacgccaccttcacgatgcgcctgctctcccccgtgcgggtgccgaactacaacatgatcatcatggacgaggcgcacttcaccgaccccagctccatcgccgcccgcgggtacatcagcacccgggtcggcatgggggaggccgccgcgatcttcatgaccgccacgccgcccggctccgtggaggccttcccgcagagcaacgccgtgatccaggacgaggagcgcgacatccccgagcggtcctggaacagcgggtacgagtggatcaccgacttccccggcaagaccgtctggttcgtgccctccatcaagagcggcaacgacatcgcgaactgcctgcgcaagaacgggaagcgggtgatccagctgtcccgcaagaccttcgacacggagtaccagaagaccaagaacaacgactgggactacgtcgtgaccaccgacatcagcgagatgggcgccaacttccgggccgaccgcgtgatcgacccgcggcgctgcctcaagcccgtcatcctgaaggacgggcccgagcgggtgatcctggccggccccatgccggtgacggtcgcctccgcggcccagcgccgggggcgcatcggccggaaccacaacaaggagggcgaccagtacatctacatggggcagcccctcaacaacgacgaggaccacgcccactggaccgaggccaagatgctgctggacaacatcaacacccccgagggcatcatccccgccctcttcgagccggagcgcgagaagtccgcggccatcgacggggagtaccgcctgcggggcgaggcccgcaagaccttcgtggagctgatgcggcgcggggacctccccgtctggctgtcctacaaggtggccagcgagggcttccagtacagcgaccggcgctggtgcttcgacggcgagcggaacaaccaggtgctggaggagaacatggacgtcgagatctggacgaaggagggggagcgcaagaagctccggccccgctggctggacgcccggacctactccgaccccctggcgctccgcgagttcaaggagttcgccgccggccggcgcagcgtgtccggggacctgatcctggagatcggcaagctcccgcagcacctgacccagcgggcccagaacgcgctggacaacctcgtgatgctgcacaacagcgagcagggcgggcgcgcctaccggcacgccatggaggagctgcccgacaccatcgagacgctcatgctgctggccctcatcgccgtcctgaccggcggggtgaccctgttcttcctctccggccgcgggctgggcaagaccagcatcggcctgctctgcgtgatgacctccagcgtcctgctgtggatggcgtccgtggagccccactggatcgccgccagcatcatcctcgagttcttcctgatggtgctgctcatccccgagccggaccggcagcgcacgccccaggacaaccagctggcctacgtcgtgatcgggctcctcttcatgatcctgaccgtggccgcgaacgagatgggcctgctcgagaccaccaagaaggacctggggatcggccacgtcgccgtggagaaccaccaccacgccgccatgctggacgtggacctccaccccgcctccgcgtggacgctgtacgccgtcgccaccaccatcatcaccccgatgatgcggcacacgatcgagaacaccaccgccaacatcagcctgaccgccatcgcgaaccaggccgccatcctcatggggctggacaagggctggcccatctccaagatggacatcggcgtgcccctgctcgccctggggtgctacagccaggtgaaccccctgacgctcaccgcggccgtcctgatgctggtggcccactacgccatcatcggcccggggctccaggccaaggcgacccgcgaggcccagaagcgcaccgccgccggcatcatgaagaaccccacggtggacgggatcgtcgccatcgacctggaccccgtggtgtacgacgcgaagttcgagaagcagctgggccagatcatgctcctgatcctgtgcacctcccagatcctcctgatgcggaccacctgggccctgtgcgagagcatcacgctcgccaccggccccctgaccaccctgtgggaggggtccccgggcaagttctggaacacgaccatcgccgtcagcatggccaacatcttccgcgggtcctacctcgcgggcgccggcctggccttcagcctgatgaagtccctcgggggcgggcggcgcggcaccggggcccagggcgagaccctgggcgagaagtggaagcggcagctgaaccagctctccaagagcgagttcaacacgtacaagcgctccgggatcatggaggtggaccggagcgaggcgaaggagggcctgaagcgcggggagaccaccaagcacgccgtgtcccggggcaccgccaagctgcgctggttcgtcgagcggaacctggtgaagcccgaggggaaggtgatcgacctcggctgcggccgcgggggctggagctactactgcgccgggctgaagaaggtcacggaggtgaagggctacaccaagggcgggcccggccacgaggagcccatcccgatggccacctacgggtggaacctggtgaagctccactccggcaaggacgtcttcttcatcccgcccgagaagtgcgacaccctgctgtgcgacatcggggagagctcccccaacccgacgatcgaggagggccggaccctccgcgtgctgaagatggtggagccctggctgcgggggaaccagttctgcatcaagatcctcaacccctacatgcccagcgtcgtggagaccctggagcagatgcagcgcaagcacggcggcatgctggtgcggaacccgctctcccgcaacagcacccacgagatgtactgggtctcctgcgggaccggcaacatcgtgagcgcggtgaacatgacgtcccggatgctgctgaaccgcttcaccatggcccaccgcaagcccacctacgagcgggacgtcgacctcgggaccggcacgcgccacgtggccgtggagcccgaggtcgccaacctggacatcatcggccagcggatcgagaacatcaagcacgagcacaagagcacctggcactacgacgaggacaacccctacaagacctgggcctaccacgggtcctacgaggtgaagccgagcggctccgcgagcagcatggtgaacggggtcgtgaagctgctcaccaagccctgggacgtcatccccatggtgacgcagatcgccatgaccgacaccacccccttcggccagcagcgcgtgttcaaggagaaggtcgacacgcggaccccgaaggccaagcgcgggaccgcccagatcatggaggtgaccgcccggtggctgtggggcttcctgtcccgcaacaagaagccccggatctgcacgcgcgaggagttcacccggaaggtgcgcagcaacgcggccatcggcgccgtcttcgtggacgagaaccagtggaactccgccaaggaggcggtggaggacgagcggttctgggacctcgtccaccgcgagcgggagctgcacaagcaggggaagtgcgcgacctgcgtgtacaacatgatgggcaagcgcgagaagaagctgggggagttcggcaaggccaaggggagccgggccatctggtacatgtggctcggcgcccgcttcctggagttcgaggcgctgggcttcatgaacgaggaccactggttctcccgggagaacagcctctccggggtggagggcgaggggctgcacaagctgggctacatcctccgcgacatcagcaagatccccgggggcaacatgtacgccgacgacaccgccggctgggacacgcggatcaccgaggacgacctgcagaacgaggccaagatcaccgacatcatggagccggagcacgccctgctcgcgaaggccatcttcaagctgacctaccagaacaaggtcgtgcgcgtgcagcgccccgccaagaacgggacggtcatggacgtgatctcccggcgcgaccagcggggcagcggccaggtggggacctacggcctgaacaccttcaccaacatggaggcccagctcatccgccagatggagtccgaggggatcttcagcccctccgagctggagacgcccaacctggccgagcgggcgctcgactggctggagaagtacggcgtcgagcgcctgaagcggatggccatcagcggggacgactgcgtggtgaagccgatcgacgaccgcttcgccaccgccctcaccgccctgaacgacatgggcaaggtccggaaggacatcccccagtgggagccctccaaggggtggaacgactggcagcaggtccccttctgcagccaccacttccaccagctgatcatgaaggacggccgcgagatcgtggtcccgtgccggaaccaggacgagctcgtgggccgcgcgcgggtgtcccagggggccggctggagcctgcgcgagaccgcctgcctgggcaagagctacgcccagatgtggcagctcatgtacttccaccggcgcgacctgcggctggcggccaacgccatctgctccgccgtccccgtggactgggtgcccacgagccgcaccacctggtccatccacgcccaccaccagtggatgaccacggaggacatgctcagcgtctggaaccgggtgtggatcgaggagaacccctggatggaggacaagacccacatctccagctgggaggacgtgccgtacctgggcaagcgcgaggaccagtggtgcgggtccctgatcggcctcaccgcgcgcgccacctgggccaccaacatccaggtcgccatcaaccaggtgcggcgcctgatcggcaacgagaactacctggactacatgacgagcatgaagcggttcaagaacgagtccgaccccgagggggccctctggtga

SEQ ID NO: 8542 - RNA, 9879 nt, synthetic construct
  misc_feature 1..9879: note = derived and/or modified CDS sequence (opt1) from DENV-1__FJ882564__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgcgggggtgaacatgtgcaccctcatcgccatggacctgggcgagctgtgcgaggacaccatgacctacaagtgcccccgcatcaccgaggccgagcccgacgacgtggactgctggtgcaacgccaccgacacctgggtgacctacgggacctgcagccagacgggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtggggaagctggtccaccagatcttcggcaccgcctacggggtcctgttctccggcgtgagctggaccatgaagatcgggatcggcgtcctgctgacgtggctcggcctgaactcccgcagcacctccctgagcatgacctgcatcgccgtggggctcgtgaccctgtacctgggcgtcatggtgcaggccgactccgggtgcgtgatcaactggaagggccgggagctcaagtgcgggagcggcatcttcgtcacgaacgaggtgcacacctggaccgagcagtacaagttccaggcggacagcccgaagcgcctgtccgccgccatcggcaaggcctgggaggagggggtgtgcggcatccggagcgccacccgcctggagaacatcatgtggaagcagatctccaacgagctcaaccacatcctgctggagaacgggatgaagttcaccgtcgtggtgggcgacgtcgtggggatcctcgcgcagggcaagaagatgatccggccccagcccatggagcacaagtacagctggaagtcctggggcaaggccaagatcatcggggccgacgtgcagaacacgaccttcatcatcgacggccccaacaccccggagtgccccgacgaccagcgcgcctggaacatctgggaggtcgaggactacgggttcggcatcttcaccacgaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacctgcatctggcccaagtcccacacgctgtggagcaacggggtgctcgagtccgagatgatcatccccaagatctacggcgggccgatcagccagcacaactaccgccccggctacttcacccagaccgccgggccctggcacctgggcaagctggagctcgacttcgacctgtgcgagggcaccacggtggtcgtggacgagcactgcgggaaccggggcccgtccctgcgcaccaccaccgtgacggggaagatcatccacgagtggtgctgccggagctgcaccctgccgcccctccgcttcaagggcgaggacgggtgctggtacggcatggagatccggcccgtcaaggagaaggaggagaacctggtgaagtccatggtgagcgccggcagcggggaggtcgactccttcagcctcggcctgctgtgcacctccatcatgatcgaggaggtgatgcgcagccggtggtcccgcaagatgctcatgaccgggacgctggccgtgttcctgctcctgatcatgggccagctgacctggaacgacctcatccggctgtgcatcatggtcggggccaacgcgagcgaccgcatgggcatgggcaccacctacctggccctcatggccacgttcaagatgcgcccgatggtggccgtggggctgctgttccggcgcctcacctcccgggaggtcctgctgctcaccatcgggctgagcctggtggcctccgtcgagctccccaacagcctggaggagctgggggacggcctcgcgatgggcatcatgatcctgaagctgctcaccgacttccagtcccaccagctgtgggccacgctgctcagcctgaccttcatcaagaccaccctgtccctccactacgcctggaagacgatggccatggtgctgagcatcgtgtccctgttccccctctgcctgagcaccacctcccagaagaccacgtggctgcccgtcctcctggggagcctgggctgcaagccgctcaccatgttcctgatcgcggagaacaagatctgggggcgcaagtcctggcccctgaacgagggcatcatggccgtgggggtggtcagcatcctcctgagctccctgctcaagaacgacgtgcccctggccggccccctgatcgccggcgggatgctcatcgcctgctacgtgatcagcggctccagcgcggacctgtccctggagaaggccgccgaggtcagctgggaggaggaggccgagcactccggggccagccacaacatcctcgtggaggtgcaggacgacggcaccatgaagatcaaggacgaggagcgggacgacaccctgaccatcctgctcaaggcgacgctgctggccgtctccggggtgtacccgctcagcatccccgccaccctgttcgtgtggtacttctggcagaagaagaagcagcgctccggcgtcctgtgggacacccccagcccgcccgaggtggagcgggccgtgctggacgacggcatctaccgcatcatgcagcgggggctcctgggccgctcccaggtcggggtgggcgtgttccaggagaacgtcttccacaccatgtggcacgtgacgcgcggggccgtgctgatgtaccagggcaagcgcctcgagcccagctgggcgtccgtcaagaaggacctgatcagctacggcgggggctggcggctgcaggggtcctggaacaccggcgaggaggtccaggtgatcgccgtcgagcccgggaagaaccccaagaacgtgcagaccgcccccggcaccttcaagacgcccgagggcgaggtgggggccatcgccctcgacttcaagcccggcaccagcgggtcccccatcgtcaaccgcgagggcaagatcgtgggcctgtacgggaacggcgtggtcaccaccagcgggacgtacgtgagcgcgatcgcccaggccaaggcctcccaggagggcccgctgcccgagatcgaggacgaggtgttccggaagcgcaacctcaccatcatggacctgcaccccgggagcggcaagacccggcgctacctgccggcgatcgtccgggaggccatcaagcgcaagctccggaccctgatcctggcccccacgcgcgtggtggcctccgagatggccgaggcgctcaagggcatgcccatccgctaccagaccaccgccgtcaagagcgagcacaccgggaaggagatcgtggacctgatgtgccacgccacgttcaccatgcggctgctctcccccgtgcgcgtcccgaactacaacatgatcatcatggacgaggcccacttcaccgaccccagctccatcgccgcgcggggctacatcagcacccgcgtggggatgggcgaggccgccgccatcttcatgacggccacgccgcccgggtccgtggaggcgttcccgcagagcaacgccgtcatccaggacgaggagcgggacatccccgagcgctcctggaacagcggctacgagtggatcaccgacttccccggcaagaccgtgtggttcgtgccctccatcaagagcgggaacgacatcgccaactgcctgcggaagaacggcaagcgcgtcatccagctgtcccggaagacgttcgacaccgagtaccagaagaccaagaacaacgactgggactacgtggtgaccacggacatcagcgagatgggggccaacttccgcgcggaccgggtcatcgacccgcgccggtgcctcaagcccgtgatcctgaaggacggccccgagcgcgtcatcctggccgggcccatgccggtgaccgtggcctccgccgcccagcggcgcggccggatcggccgcaaccacaacaaggagggggaccagtacatctacatgggccagcccctcaacaacgacgaggaccacgcgcactggaccgaggccaagatgctgctggacaacatcaacacccccgaggggatcatccccgccctcttcgagccggagcgggagaagtccgccgccatcgacggcgagtaccgcctgcgcggggaggcgcggaagacgttcgtcgagctgatgcgccggggcgacctccccgtgtggctgtcctacaaggtggccagcgagggcttccagtacagcgaccgccggtggtgcttcgacggggagcgcaacaaccaggtcctggaggagaacatggacgtggagatctggaccaaggagggcgagcggaagaagctccgcccccggtggctggacgcccgcacctactccgaccccctggccctccgggagttcaaggagttcgccgcggggcgccggagcgtgtccggcgacctgatcctggagatcggcaagctcccgcagcacctgacccagcgcgcccagaacgccctggacaacctcgtcatgctgcacaacagcgagcagggcgggcgggcctaccgccacgcgatggaggagctgcccgacacgatcgagaccctcatgctgctggccctcatcgccgtgctgaccgggggcgtgaccctgttcttcctctccgggcggggcctgggcaagaccagcatcgggctgctctgcgtcatggcctccagcgtgctgctgtggatggcctccgtggagccccactggatcgcggccagcatcatcctcgagttcttcctgatggtcctgctcatccccgagccggaccgccagcggacgccccaggacaaccagctggcctacgtggtgatcggcctcctcttcatgatcctgaccgtcgccgccaacgagatggggctgctcgagaccaccaagaaggacctgggcatcgggcacgtggcggtggagaaccaccaccacgccacgatgctggacgtcgacctccaccccgcctccgcctggaccctgtacgccgtggcgaccaccatcatcacgccgatgatgcgccacaccatcgagaacaccaccgccaacatcagcctgacggccatcgccaaccaggccgcgatcctcatgggcctggacaagggctggcccatctccaagatggacatcggggtgcccctgctcgccctgggctgctacagccaggtcaaccccctgaccctcaccgccgccgtgctgatgctggtggcgcactacgccatcatcgggccgggcctccaggccaaggccacccgggaggcccagaagcgcacggcggccgggatcatgaagaaccccaccgtcgacggcatcgtggccatcgacctggaccccgtggtctacgacgccaagttcgagaagcagctgggccagatcatgctcctgatcctgtgcacctcccagatcctcctgatgcgcaccacgtgggccctgtgcgagagcatcaccctcgcgaccgggcccctgaccacgctgtgggagggctccccggggaagttctggaacaccaccatcgccgtgagcatggccaacatcttccggggctcctacctcgccggcgccgggctggcgttcagcctgatgaagtccctcggcgggggccgccgggggaccggcgcccagggcgagacgctgggggagaagtggaagcgccagctgaaccagctctccaagagcgagttcaacatctacaagcggtccggcatcatggaggtggaccgcagcgaggccaaggaggggctgaagcggggcgagaccacccgccacgccgtctcccgggggaccgcgaagctgcgctggttcgtggagcggaacctggtgaagcccgagggcaaggtcatcgacctcggctgcgggcgcggcgggtggagctactactgcgccggcctgaagaaggtgacggaggtgaaggggtacaccaagggcggccccgggcacgaggagcccatcccgatggccacctacggctggaacctggtcaagctccactccgggaaggacgtgttcttcacgccgcccgagaagtgcgacacgctgctgtgcgacatcggcgagagctcccccaacccgaccatcgaggaggggcggaccctccgcgtgctgaagatggtcgagccctggctgcggggcaaccagttctgcatcaagatcctcaacccctacatgcccagcgtggtggagaccctggagcagatgcagcgcaagcacggcgggatgctggtccggaacccgctctcccgcaacagcacccacgagatgtactgggtgtcctgcggcacggggaacatcgtgagcgccgtcaacatgacctcccggatgctgctgaaccgcttcaccatggcccaccgcaagcccacctacgagcgggacgtggacctcggcgcgggcacgcgccacgtggccgtcgagcccgaggtggccaacctggacatcatcgggcagcggatcgagaacatcaagcacgagcacaagagcacctggcactacgacgaggacaacccctacaagacctgggcctaccacggctcctacgaggtcaagccgagcgggtccgccagcagcatggtgaacggcgtggtcaagctgctcaccaagccctgggacgtgatccccatggtgacgcagatcgcgatgaccgacaccacccccttcgggcagcagcgcgtcttcaaggagaaggtggacacgcggaccccgaaggccaagcgcggcaccgcccagatcatggaggtgaccgcccggtggctgtggggcttcctgtcccgcaacaagaagccccggatctgcacgcgcgaggagttcacccggaaggtccgcagcaacgccgcgatcggggccgtgttcgtggacgagaaccagtggaactccgccaaggaggccgtcgaggacgagcggttctgggacctcgtgcagaaggagcgcgagctgcacaagcagggcaagtgcgcgacctgcgtgtacaacatgatggggaagcgggagaagaagctgggcgagttcgggaaggccaagggcagccgcgccatctggtacatgtggctcggcgcccggttcctggagttcgaggccctggggttcatgaacgaggaccactggttctcccgcgagaacagcctctccggcgtcgagggggagggcctgcacaagctggggtacatcctccgggacatcagcaagatccccggcggcaacatgtacgcggacgacaccgccgggtgggacacgcgcatcaccgaggacgacctgcagaacgaggccaagatcaccgacatcatggagccggagcacgccctgctcgccacctccatcttcaagctgacgtaccagaacaaggtggtgcgggtccagcgccccgcgaagaacggcaccgtgatggacgtgatcagccgccgggaccagcgcgggtccggccaggtcggcacctacgggctgaacaccttcacgaacatggaggcccagctcatccggcagatggagagcgagggcatcttcctgccctccgagctggagacccccaacctcgccgagcgcgtgctggactggctggagaagtacggggtggagcggctcaagcgcatggccatcagcggcgacgactgcgtcgtgaagccgatcgacgaccggttcgccaccgcgctgaccgccctgaacgacatggggaaggtgcgcaaggacatcccccagtgggagccctccaagggctggaacgactggcagcaggtccccttctgcagccaccacttccaccagctcatcatgaaggacggccgggagatcgtggtgccgtgccgcaaccaggacgagctggtcgggcgggcccgcgtgtcccagggcgccgggtggagcctgcgggagacggcctgcctcggcaagagctacgcgcagatgtggcagctgatgtacttccaccgccgggacctgcgcctcgccgccaacgccatctgctccgcggtgcccgtcgactgggtgcccaccagccggaccacctggtccatccacgcccaccaccagtggatgacgaccgaggacatgctgagcgtgtggaaccgcgtctggatcgaggagaacccctggatggaggacaagacccacgtgtccagctggggcgacgtgccgtacctgggcaagcgggaggaccagtggtgcggctccctcatcgggctgaccgcccgcgccacctgggccagcaacatccaggtcgcgatcaaccaggtgcgccggctgatcggcaacgagaactacctcgactacatgacgtccatgaagcgcttcaagaacgagggggaccccgagggcgccctgtggtga

SEQ ID NO: 8543 - RNA, 9879 nt, synthetic construct
  misc_feature 1..9879: note = derived and/or modified CDS sequence (opt1) from DENV-1__FJ882565__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgcgggggtgaacatgtgcaccctcatcgccatggacctgggcgagctgtgcgaggacaccatgacctacaagtgcccccgcatcaccgaggccgagcccgacgacgtggactgctggtgcaacgccaccgacacctgggtgacctacgggacctgcagccagacgggcgagcaccggcgcgacaagcggagcgtggccctcgcgccccacgtgggcctggggctggagacccgcaccgagacctggatgtccagcgagggcgcctggaagcagatccagcgggtggagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtggggaagctggtccaccagatcttcggcaccgcctacggggtcctgttctccggcgtgagctggaccatgaagatcgggatcggcgtcctgctgacgtggctcggcctgaactcccgcagcacctccctgagcatgacctgcatcgccgtggggctcgtgaccctgtacctgggcgtcatggtgcaggccgactccgggtgcgtgatcaactggaagggccgggagctcaagtgcgggagcggcatcttcgtcacgaacgaggtgcacacctggaccgagcagtacaagttccaggcggacagcccgaagcgcctgtccgccgccatcggcaaggcctgggaggagggggtgtgcggcatccggagcgccacccgcctggagaacatcatgtggaagcagatctccaacgagctcaaccacatcctgctggagaacgacatgaagttcaccgtcgtggtgggggacgtcgtgggcatcctcgcgcaggggaagaagatgatccggccccagcccatggagcacaagtacagctggaagtcctggggcaaggccaagatcatcggcgccgacgtgcagaacacgaccttcatcatcgacgggcccaacaccccggagtgccccgacgaccagcgcgcctggaacatctgggaggtcgaggactacggcttcgggatcttcaccacgaacatctggctgaagctgcggggcagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacctgcatctggcccaagtcccacacgctgtggagcaacggggtgctcgagtccgagatgatcatccccaagatctacggcgggccgatcagccagcacaactaccgccccggctacttcacccagaccgccgggccctggcacctgggcaagctggagctcgacttcgacctgtgcgagggcaccacggtggtcgtggacgagcactgcgggaaccggggcccgtccctgcgcaccaccaccgtgacggggaagatcatccacgagtggtgctgccggagctgcaccctgccgcccctccgcttcaagggcgaggacgggtgctggtacggcatggagatccggcccgtcaaggagaaggaggagaacctggtgaagtccatggtgagcgccggcagcggggaggtcgactccttcagcctcggcctgctgtgcatctccatcatgatcgaggaggtgatgcgcagccggtggtcccgcaagatgctcatgaccgggaccctggccgtgttcctgctcctgatcatgggccagctgacgtggaacgacctcatccggctgtgcatcatggtcggggccaacgcgagcgaccgcatgggcatgggcaccacctacctggccctcatggccaccttcaagatgcgcccgatgttcgccgtggggctgctgttccggcgcctcacgtcccgggaggtgctgctgctcaccatcgggctgagcctggtcgcctccgtggagctccccaacagcctggaggagctgggggacggcctcgcgatgggcatcatgatcctgaagctgctcaccgacttccagtcccaccagctgtgggccaccctgctcagcctgacgttcatcaagaccaccctgtccctccactacgcctggaagaccatggccatggtcctgagcatcgtgtccctgttccccctctgcctgagcacgacctcccagaagaccacctggctgcccgtgctcctggggagcctgggctgcaagccgctcacgatgttcctgatcgcggagaacaagatctgggggcgcaagtcctggcccctgaacgagggcatcatggccgtcggggtggtgagcatcctcctgagctccctgctcaagaacgacgtccccctggccggccccctgatcgccggcgggatgctcatcgcctgctacgtgatcagcggctccagcgcggacctgtccctggagaaggccgccgaggtgagctgggaggaggaggccgagcactccggggccagccacaacatcctcgtcgaggtgcaggacgacggcaccatgaagatcaaggacgaggagcgggacgacaccctgaccatcctgctcaaggcgaccctgctggccgtgtccggggtctacccgctcagcatccccgccacgctgttcgtgtggtacttctggcagaagaagaagcagcgctccggcgtgctgtgggacacccccagcccgcccgaggtcgagcgggccgtgctggacgacggcatctaccgcatcatgcagcgggggctcctgggccgctcccaggtgggggtcggcgtgttccaggagaacgtgttccacaccatgtggcacgtcacccgcggggccgtgctgatgtaccagggcaagcgcctcgagcccagctgggcgtccgtgaagaaggacctgatcagctacggcgggggctggcggctgcaggggtcctggaacacgggcgaggaggtccaggtgatcgccgtggagcccgggaagaaccccaagaacgtccagaccgcccccggcaccttcaagacccccgagggcgaggtgggggccatcgccctcgacttcaagcccggcacgagcgggtcccccatcgtgaaccgcgagggcaagatcgtcggcctgtacgggaacggcgtggtgaccaccagcgggacctacgtcagcgcgatcgcccaggccaaggcctcccaggagggcccgctgcccgagatcgaggacgaggtgttccggaagcgcaacctcacgatcatggacctgcaccccgggagcggcaagacccggcgctacctgccggcgatcgtgcgggaggccatcaagcgcaagctccggaccctgatcctggcccccacccgcgtcgtggcctccgagatggccgaggcgctcaagggcatgcccatccgctaccagacgaccgccgtcaagagcgagcacaccgggaaggagatcgtcgacctgatgtgccacgccaccttcacgatgcggctgctctcccccgtgcgcgtgccgaactacaacatgatcatcatggacgaggcccacttcaccgaccccagctccatcgccgcgcggggctacatcagcacccgcgtcgggatgggcgaggccgccgccatcttcatgaccgccacgccgcccgggtccgtggaggcgttcccgcagagcaacgccgtgatccaggacgaggagcgggacatccccgagcgctcctggaacagcggctacgagtggatcaccgacttccccggcaagaccgtctggttcgtgccctccatcaagagcgggaacgacatcgccaactgcctgcggaagaacggcaagcgcgtgatccagctgtcccggaagaccttcgacacggagtaccagaagaccaagaacaacgactgggactacgtcgtgaccaccgacatcagcgagatgggggccaacttccgcgcggaccgggtgatcgacccgcgccggtgcctcaagcccgtcatcctgaaggacggccccgagcgcgtgatcctggccgggcccatgccggtcacggtggcctccgccgcccagcggcgcggccggatcggccgcaaccacaacaaggagggggaccagtacatctacatgggccagcccctcaacaacgacgaggaccacgcgcactggaccgaggccaagatgctgctggacaacatcaacacccccgaggggatcatccccgccctcttcgagccggagcgggagaagtccgccgccatcgacggcgagtaccgcctgcgcggggaggcgcggaagaccttcgtggagctgatgcgccggggcgacctccccgtctggctgtcctacaaggtggccagcgagggcttccagtacagcgaccgccggtggtgcttcgacggggagcgcaacaaccaggtgctggaggagaacatggacgtcgagatctggacgaaggagggcgagcggaagaagctccgcccccggtggctggacgcccgcacctactccgaccccctggccctccgggagttcaaggagttcgccgcggggcgccggagcgtgtccggcgacctgatcctggagatcggcaagctcccgcagcacctgacccagcgcgcccagaacgccctggacaacctcgtgatgctgcacaacagcgagcagggcgggcgggcctaccgccacgcgatggaggagctgcccgacaccatcgagacgctcatgctgctggccctcatcgccgtcctgaccgggggcgtgaccctgttcttcctctccgggcggggcctgggcaagaccagcatcgggctgctctgcgtgatggcctccagcgtcctgctgtggatggcctccgtggagccccactggatcgcggccagcatcatcctcgagttcttcctgatggtgctgctcatccccgagccggaccgccagcggacgccccaggacaaccagctggcctacgtcgtgatcggcctcctcttcatgatcctgacggtggccgccaacgagatggggctgctcgagaccaccaagaaggacctgggcatcgggcacgtcgcggtggagaaccaccaccacgccaccatgctggacgtggacctccaccccgcctccgcctggacgctgtacgccgtcgcgaccaccatcatcaccccgatgatgcgccacacgatcgagaacaccaccgccaacatcagcctgaccgccatcgccaaccaggccgcgatcctcatgggcctggacaagggctggcccatctccaagatggacatcggggtgcccctgctcgccctgggctgctacagccaggtgaaccccctgacgctcaccgccgccgtcctgatgctggtggcgcactacgccatcatcgggccgggcctccaggccaaggccacccgggaggcccagaagcgcaccgcggccgggatcatgaagaaccccacggtggacggcatcgtcgccatcgacctggaccccgtggtgtacgacgccaagttcgagaagcagctgggccagatcatgctcctgatcctgtgcacctcccagatcctcctgatgcgcaccacctgggccctgtgcgagagcatcacgctcgcgaccgggcccctgaccaccctgtgggagggctccccggggaagttctggaacacgaccatcgccgtcagcatggccaacatcttccggggctcctacctcgccggcgccgggctggcgttcagcctgatgaagtccctcggcgggggccgccgggggaccggcgcccagggcgagaccctgggggagaagtggaagcgccagctgaaccagctctccaagagcgagttcaacatctacaagcggtccggcatcatggaggtggaccgcagcgaggccaaggaggggctgaagcggggcgagacgacccgccacgccgtgtcccgggggaccgcgaagctgcgctggttcgtcgagcggaacctggtgaagcccgagggcaaggtgatcgacctcggctgcgggcgcggcgggtggagctactactgcgccggcctgaagaaggtcaccgaggtgaaggggtacacgaagggcggccccgggcacgaggagcccatcccgatggccacctacggctggaacctggtgaagctccactccgggaaggacgtcttcttcacgccgcccgagaagtgcgacaccctgctgtgcgacatcggcgagagctcccccaacccgacgatcgaggaggggcggaccctccgcgtgctgaagatggtggagccctggctgcggggcaaccagttctgcatcaagatcctcaacccctacatgcccagcgtcgtggagaccctggagcagatgcagcgcaagcacggcgggatgctggtgcggaacccgctctcccgcaacagcacccacgagatgtactgggtctcctgcggcaccgggaacatcgtgagcgccgtgaacatgacgtcccggatgctgctgaaccgcttcaccatggcccaccgcaagcccacctacgagcgggacgtcgacctcggcgcgggcacccgccacgtggccgtggagcccgaggtcgccaacctggacatcatcgggcagcggatcgagaacatcaagcacgagcacaagagcacgtggcactacgacgaggacaacccctacaagacctgggcctaccacggctcctacgaggtgaagccgagcgggtccgccagcagcatggtcaacggcgtggtgaagctgctcaccaagccctgggacgtcatccccatggtgacccagatcgcgatgacggacaccacccccttcgggcagcagcgcgtgttcaaggagaaggtcgacacccggacgccgaaggccaagcgcggcaccgcccagatcatggaggtgaccgcccggtggctgtggggcttcctgtcccgcaacaagaagccccggatctgcacccgcgaggagttcacgcggaaggtgcgcagcaacgccgcgatcggggccgtcttcgtggacgagaaccagtggaactccgccaaggaggccgtggaggacgagcggttctgggacctcgtccagaaggagcgcgagctgcacaagcagggcaagtgcgcgacctgcgtgtacaacatgatggggaagcgggagaagaagctgggcgagttcgggaaggccaagggcagccgcgccatctggtacatgtggctcggcgcccggttcctggagttcgaggccctggggttcatgaacgaggaccactggttctcccgcgagaacagcctctccggcgtggagggggagggcctgcacaagctggggtacatcctccgggacatcagcaagatccccggcggcaacatgtacgcggacgacaccgccgggtgggacacccgcatcacggaggacgacctgcagaacgaggccaagatcaccgacatcatggagccggagcacgccctgctcgccacctccatcttcaagctgacctaccagaacaaggtcgtgcgggtgcagcgccccgcgaagaacggcacggtcatggacgtgatcagccgccgggaccagcgcgggtccggccaggtgggcacctacgggctgaacaccttcaccaacatggaggcccagctcatccggcagatggagagcgagggcatcttcctgccctccgagctggagacgcccaacctcgccgagcgcgtcctggactggctggagaagtacggggtggagcggctcaagcgcatggccatcagcggcgacgactgcgtggtcaagccgatcgacgaccggttcgccaccgcgctgaccgccctgaacgacatggggaaggtgcgcaaggacatcccccagtgggagccctccaagggctggaacgactggcagcaggtccccttctgcagccaccacttccaccagctcatcatgaaggacggccgggagatcgtcgtgccgtgccgcaaccaggacgagctggtggggcgggcccgcgtctcccagggcgccgggtggagcctgcgggagaccgcctgcctcggcaagagctacgcgcagatgtggcagctgatgtacttccaccgccgggacctgcgcctcgccgccaacgccatctgctccgcggtgcccgtggactgggtccccacgagccggaccacctggtccatccacgcccaccaccagtggatgaccacggaggacatgctgagcgtgtggaaccgcgtgtggatcgaggagaacccctggatggaggacaagacccacgtctccagctggggcgacgtgccgtacctgggcaagcgggaggaccagtggtgcggctccctcatcgggctgaccgcccgcgccacctgggccagcaacatccaggtggcgatcaaccaggtccgccggctgatcggcaacgagaactacctcgactacatgacctccatgaagcgcttcaagaacgagggggaccccgagggcgccctgtggtga

SEQ ID NO: 8544 - RNA, 9879 nt, synthetic construct
  misc_feature 1..9879: note = derived and/or modified CDS sequence (opt1) from DENV-1__FJ882567__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgcgggggtgaacatgtgcaccctcatcgccatggacctgggcgagctgtgcgaggacaccatgacctacaagtgcccccgcatcaccgaggccgagcccgacgacgtggactgctggtgcaacgccaccgacacctgggtgacctacgggacctgcagccagacgggcgagcaccggcgcgacaagcggagcgtggccctcgcgccccacgtgggcctggggctggagacccgcaccgagacctggatgtccagcgagggcgcctggaagcagatccagcgggtggagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtggggaagctggtccaccagatcttcggcaccgcctacggggtcctgttctccggcgtgagctggaccatgaagatcgggatcggcgtcctgctgacgtggctcggcctgaactcccgcagcacctccctgagcatgacctgcatcgccgtggggctcgtgaccctgtacctgggcgtcatggtgcaggccgactccgggtgcgtgatcaactggaagggccgggagctcaagtgcgggagcggcatcttcgtcacgaacgaggtgcacacctggaccgagcagtacaagttccaggcggacagcccgaagcgcctgtccgccgccatcggcaaggcctgggaggagggggtgtgcggcatccggagcgccacccgcctggagaacatcatgtggaagcagatctccaacgagctcaaccacatcctgctggagaacgggatgaagttcaccgtcgtggtgggcgacgtcgtggggatcctcgcgcagggcaagaagatgatccggccccagcccatggagcacaagtacagctggaagtcctggggcaaggccaagatcatcggggccgacgtgcagaacacgaccttcatcatcgacggccccaacaccccggagtgccccgacgaccagcgcgcctggaacatctgggaggtcgaggactacgggttcggcatcttcaccacgaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacctgcatctggcccaagtcccacacgctgtggagcaacggggtgctcgagtccgagatgatcatccccaagatctacggcgggccgatcagccagcacaactaccgccccggctacttcacccagaccgccgggccctggcacctgggcaagctggagctcgacttcgacctgtgcgagggcaccacggtggtcgtggacgagcactgcgggaaccggggcccgtccctgcgcaccaccaccgtgacggggaagatcatccacgagtggtgctgccggagctgcaccctgccgcccctccgcttcaagggcgaggacgggtgctggtacggcatggagatccggcccgtcaaggagaaggaggagaacctggtgaagtccatggtgagcgccggcagcggggaggtcgactccttcagcctcggcctgctgtgcacctccatcatgatcgaggaggtgatgcgcagccggtggtcccgcaagatgctcatgaccgggacgctggccgtgttcctgctcctgatcatgggccagctgacctggaacgacctcatccggctgtgcatcatggtcggggccaacgcgagcgaccgcatgggcatgggcaccacctacctggccctcatggccacgttcaagatgcgcccgatgttcgccgtggggctgctgttccggcgcctcacctcccgggaggtgctgctgctcaccatcgggctgagcctggtcgcctccgtggagctccccaacagcctggaggagctgggggacggcctcgcgatgggcatcatgatcctgaagctgctcaccgacttccagtcccaccagctgtgggccacgctgctcagcctgaccttcatcaagaccaccctgtccctccactacgcctggaagacgatggccatggtcctgagcatcgtgtccctgttccccctctgcctgagcaccacctcccagaagaccacgtggctgcccgtgctcctggggagcctgggctgcaagccgctcaccatgttcctgatcgcggagaacaagatctgggggcgcaagtcctggcccctgaacgagggcatcatggccgtcggggtggtgagcatcctcctgagctccctgctcaagaacgacgtccccctggccggccccctgatcgccggcgggatgctcatcgcctgctacgtgatcagcggctccagcgcggacctgtccctggagaaggccgccgaggtgagctgggaggaggaggccgagcactccggggccagccacaacatcctcgtcgaggtgcaggacgacggcaccatgaagatcaaggacgaggagcgggacgacaccctgaccatcctgctcaaggcgacgctgctggccgtgtccggggtctacccgctcagcatccccgccaccctgttcgtgtggtacttctggcagaagaagaagcagcgctccggcgtgctgtgggacacccccagcccgcccgaggtcgagcgggccgtgctggacgacggcatctaccgcatcatgcagcgggggctcctgggccgctcccaggtgggggtcggcgtgttccaggagaacgtgttccacaccatgtggcacgtcacgcgcggggccgtgctgatgtaccagggcaagcgcctcgagcccagctgggcgtccgtgaagaaggacctgatcagctacggcgggggctggcggctgcaggggtcctggaacaccggcgaggaggtccaggtgatcgccgtggagcccgggaagaaccccaagaacgtccagaccgcccccggcaccttcaagacgcccgagggcgaggtgggggccatcgccctcgacttcaagcccggcaccagcgggtcccccatcgtgaaccgcgagggcaagatcgtcggcctgtacgggaacggcgtggtgaccaccagcgggacgtacgtcagcgcgatcgcccaggccaaggcctcccaggagggcccgctgcccgagatcgaggacgaggtgttccggaagcgcaacctcaccatcatggacctgcaccccgggagcggcaagacccggcgctacctgccggcgatcgtgcgggaggccatcaagcgcaagctccggaccctgatcctggcccccacgcgcgtcgtggcctccgagatggccgaggcgctcaagggcatgcccatccgctaccagaccaccgccgtcaagagcgagcacaccgggaaggagatcgtcgacctgatgtgccacgccacgttcaccatgcggctgctctcccccgtgcgcgtgccgaactacaacatgatcatcatggacgaggcccacttcaccgaccccagctccatcgccgcgcggggctacatcagcacccgcgtcgggatgggcgaggccgccgccatcttcatgacggccacgccgcccgggtccgtggaggcgttcccgcagagcaacgccgtgatccaggacgaggagcgggacatccccgagcgctcctggaacagcggctacgagtggatcaccgacttccccggcaagaccgtctggttcgtgccctccatcaagagcgggaacgacatcgccaactgcctgcggaagaacggcaagcgcgtgatccagctgtcccggaagacgttcgacaccgagtaccagaagaccaagaacaacgactgggactacgtcgtgaccacggacatcagcgagatgggggccaacttccgcgcggaccgggtgatcgacccgcgccggtgcctcaagcccgtcatcctgaaggacggccccgagcgcgtgatcctggccgggcccatgccggtcaccgtggcctccgccgcccagcggcgcggccggatcggccgcaaccacaacaaggagggggaccagtacatctacatgggccagcccctcaacaacgacgaggaccacgcgcactggaccgaggccaagatgctgctggacaacatcaacacccccgaggggatcatccccgccctcttcgagccggagcgggagaagtccgccgccatcgacggcgagtaccgcctgcgcggggaggcgcggaagacgttcgtggagctgatgcgccggggcgacctccccgtctggctgtcctacaaggtggccagcgagggcttccagtacagcgaccgccggtggtgcttcgacggggagcgcaacaaccaggtgctggaggagaacatggacgtcgagatctggaccaaggagggcgagcggaagaagctccgcccccggtggctggacgcccgcacctactccgaccccctggccctccgggagttcaaggagttcgccgcggggcgccggagcgtgtccggcgacctgatcctggagatcggcaagctcccgcagcacctgacccagcgcgcccagaacgccctggacaacctcgtgatgctgcacaacagcgagcagggcgggcgggcctaccgccacgcgatggaggagctgcccgacacgatcgagaccctcatgctgctggccctcatcgccgtcctgaccgggggcgtgaccctgttcttcctctccgggcggggcctgggcaagaccagcatcgggctgctctgcgtgatggcctccagcgtcctgctgtggatggcctccgtggagccccactggatcgcggccagcatcatcctcgagttcttcctgatggtgctgctcatccccgagccggaccgccagcggacgccccaggacaaccagctggcctacgtcgtgatcggcctcctcttcatgatcctgaccgtggccgccaacgagatggggctgctcgagaccaccaagaaggacctgggcatcgggcacgtcgcggtggagaaccaccaccacgccacgatgctggacgtggacctccaccccgcctccgcctggaccctgtacgccgtcgcgaccaccatcatcacgccgatgatgcgccacaccatcgagaacaccaccgccaacatcagcctgacggccatcgccaaccaggccgcgatcctcatgggcctggacaagggctggcccatctccaagatggacatcggggtgcccctgctcgccctgggctgctacagccaggtgaaccccctgaccctcaccgccgccgtcctgatgctggtggcgcactacgccatcatcgggccgggcctccaggccaaggccacccgggaggcccagaagcgcacggcggccgggatcatgaagaaccccaccgtggacggcatcgtcgccatcgacctggaccccgtggtgtacgacgccaagttcgagaagcagctgggccagatcatgctcctgatcctgtgcacctcccagatcctcctgatgcgcaccacgtgggccctgtgcgagagcatcaccctcgcgaccgggcccctgaccacgctgtgggagggctccccggggaagttctggaacaccaccatcgccgtcagcatggccaacatcttccggggctcctacctcgccggcgccgggctggcgttcagcctgatgaagtccctcggcgggggccgccgggggaccggcgcccagggcgagacgctgggggagaagtggaagcgccagctgaaccagctctccaagagcgagttcaacatctacaagcggtccggcatcatggaggtggaccgcagcgaggccaaggaggggctgaagcggggcgagaccacccgccacgccgtgtcccgggggaccgcgaagctgcgctggttcgtcgagcggaacctggtgaagcccgagggcaaggtgatcgacctcggctgcgggcgcggcgggtggagctactactgcgccggcctgaagaaggtcacggaggtgaaggggtacaccaagggcggccccgggcacgaggagcccatcccgatggccacctacggctggaacctggtgaagctccactccgggaaggacgtcttcttcacgccgcccgagaagtgcgacacgctgctgtgcgacatcggcgagagctcccccaacccgaccatcgaggaggggcggaccctccgcgtgctgaagatggtggagccctggctgcggggcaaccagttctgcatcaagatcctcaacccctacatgcccagcgtcgtggagaccctggagcagatgcagcgcaagcacggcgggatgctggtgcggaacccgctctcccgcaacagcacccacgagatgtactgggtctcctgcggcacggggaacatcgtgagcgccgtgaacatgacctcccggatgctgctgaaccgcttcaccatggcccaccgcaagcccacctacgagcgggacgtcgacctcggcgcgggcacgcgccacgtggccgtggagcccgaggtcgccaacctggacatcatcgggcagcggatcgagaacatcaagcacgagcacaagagcacctggcactacgacgaggacaacccctacaagacctgggcctaccacggctcctacgaggtgaagccgagcgggtccgccagcagcatggtcaacggcgtggtgaagctgctcaccaagccctgggacgtcatccccatggtgacgcagatcgcgatgaccgacaccacccccttcgggcagcagcgcgtgttcaaggagaaggtcgacacgcggaccccgaaggccaagcgcggcaccgcccagatcatggaggtgaccgcccggtggctgtggggcttcctgtcccgcaacaagaagccccggatctgcacgcgcgaggagttcacccggaaggtgcgcagcaacgccgcgatcggggccgtcttcgtggacgagaaccagtggaactccgccaaggaggccgtggaggacgagcggttctgggacctcgtccagaaggagcgcgagctgcacaagcagggcaagtgcgcgacctgcgtgtacaacatgatggggaagcgggagaagaagctgggcgagttcgggaaggccaagggcagccgcgccatctggtacatgtggctcggcgcccggttcctggagttcgaggccctggggttcatgaacgaggaccactggttctcccgcgagaacagcctctccggcgtggagggggagggcctgcacaagctggggtacatcctccgggacatcagcaagatccccggcggcaacatgtacgcggacgacaccgccgggtgggacacgcgcatcaccgaggacgacctgcagaacgaggccaagatcaccgacatcatggagccggagcacgccctgctcgccacctccatcttcaagctgacgtaccagaacaaggtcgtgcgggtgcagcgccccgcgaagaacggcaccgtcatggacgtgatcagccgccgggaccagcgcgggtccggccaggtgggcacctacgggctgaacaccttcacgaacatggaggcccagctcatccggcagatggagagcgagggcatcttcctgccctccgagctggagacccccaacctcgccgagcgcgtcctggactggctggagaagcacggggtggagcggctcaagcgcatggccatcagcggcgacgactgcgtggtcaagccgatcgacgaccggttcgccaccgcgctgaccgccctgaacgacatggggaaggtgcgcaaggacatcccccagtgggagccctccaagggctggaacgactggcagcaggtccccttctgcagccaccacttccaccagctcatcatgaaggacggccgggagatcgtcgtgccgtgccgcaaccaggacgagctggtggggcgggcccgcgtctcccagggcgccgggtggagcctgcgggagacggcctgcctcggcaagagctacgcgcagatgtggcagctgatgtacttccaccgccgggacctgcgcctcgccgccaacgccatctgctccgcggtgcccgtggactgggtccccaccagccggaccacctggtccatccacgcccaccaccagtggatgacgaccgaggacatgctgagcgtgtggaaccgcgtgtggatcgaggagaacccctggatggaggacaagacccacgtctccagctggggcgacgtgccgtacctgggcaagcgggaggaccagtggtgcggctccctcatcgggctgaccgcccgcgccacctgggccagcaacatccaggtggcgatcaaccaggtccgccggctgatcggcaacgagaactacctcgactacatgacgtccatgaagcgcttcaagaacgagggggaccccgagggcgccctgtggtga

SEQ ID NO: 8545 - RNA, 9879 nt, synthetic construct
  misc_feature 1..9879: note = derived and/or modified CDS sequence (opt1) from DENV-1__GQ199831__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgccggggtgaacatgtgcaccctcatcgccatggacctgggggagctgtgcgaggacaccatgacctacaagtgcccccggatcaccgagaccgagcccgacgacgtggactgctggtgcaacgccaccgacacctgggtgacctacgggacctgcagccagaccggggagcaccggcgcgacaagcggagcgtggccctcgcgccccacgtgggcctggggctggagacccgcaccgagacgtggatgtccagcgagggcgcctggaagcagatccagcgggtggagacctgggccctccgccaccccgggttcaccgtgatcgccctgttcctggcccacgcgatcggcacctccatcacgcagaaggggatcatcttcatcctcctgatgctggtgacccccagcatggccatgcggtgcgtcggcatcggctcccgcgacttcgtggaggggctcagcggcgccacctgggtggacgtcgtgctggagcacgggtcctgcgtgaccacgatggccaaggacaagcccaccctggacatcgagctcctgaagaccgaggtcaccaaccccgccgtgctgcggaagctctgcatcgaggcgaagatcagcaacacgaccaccgactcccgctgccccacccagggcgaggccacgctgatggaggagcaggacgccaacttcgtgtgccggcgcaccttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgacggtgcacaccggcgaccagcaccaggtcgggaacgagagcaccgagcacggcaccaccgccacgatcacgccccaggcgcccacctccgagatccagctcaccgactacggggccctgacgctggactgcagcccccgcaccggcctcgacttcaacgagatggtgctgctgaccatgaaggagaagtcctggctcgtccacaagcagtggttcctggacctgccgctcccctggaccagcggggccagcacgtcccaggagacctggaaccggcaggacctgctggtgaccttcaagaccgcccacgccaagaagcaggaggtggtcgtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtgatgtgcacggggtccttcaagctcgagaaggaggtcgccgagacccagcacggcaccgtgctggtgcagatcaagtacgagggcaccgacgcgccctgcaagatccccttcagcacgcaggacgagaagggggtcacccagaacggccggctgatcaccgccaacccgatcgtgaccgacaaggagaagcccgtgaacatcgaggccgagccgcccttcggggagtcctacatcgtcatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtggggaagctggtccaccagatcttcggcaccgcctacggggtcctgttctccggcgtgagctggacgatgaagatcgggatcggcgtcctgctgacctggctcggcctgaactcccgcagcacctccctgagcatgacctgcatcgccgtggggctcgtgacgctgtacctgggcgtcatggtgcaggccgactccgggtgcgtgatcaactggaagggccgggagctcaagtgcgggagcggcatcttcgtcaccaacgaggtgcacacctggaccgagcagtacaagttccaggccgacagcccgaagcgcctgtccgcggccatcggcaaggcctgggaggagggggtgtgcggcatccggagcgccacccgcctggagaacatcatgtggaagcagatctccaacgagctcaaccacatcctgctggagaacgacatgaagttcacggtcgtggtgggggacgtcgtgggcatcctcgcccaggggaagaagatgatccggccccagcccatggagcacaagtacagctggaagtcctggggcaaggcgaagatcatcggcgccgacgtgcagaacaccaccttcatcatcgacgggcccaacaccccggagtgccccgacgaccagcgcgcctggaacatctgggaggtcgaggactacggcttcgggatcttcacgaccaacatctggctgaagctgcgggacagctacacccaggtgtgcgaccaccgcctcatgtccgccgcgatcaaggacagcaaggccgtgcacgccgacatgggctactggatcgagtccgagaagaacgagacctggaagctggcccgggccagcttcatcgaggtcaagacgtgcatctggcccaagtcccacaccctgtggagcaacggcgtgctcgagtccgagatgatcatccccaagatctacgggggcccgatcagccagcacaactaccgccccgggtacttcacccagaccgcgggcccctggcacctggggaagctggagctcgacttcgacctgtgcgagggcacgaccgtggtcgtggacgagcactgcggcaaccgggggccgtccctgcgcaccaccacggtgaccggcaagatcatccacgagtggtgctgccggagctgcaccctgccgcccctccgcttcaagggggaggacggctgctggtacgggatggagatccggcccgtcaaggagaaggaggagaacctggtgaagtccatggtgagcgccggcagcggcgaggtcgactccttcagcctcgggctgctgtgcatctccatcatgatcgaggaggtgatgcgcagccggtggtcccgcaagatgctcatgaccggcacgctggccgtgttcctgctcctgatcatggggcagctgacctggaacgacctcatccggctgtgcatcatggtcggcgccaacgccagcgaccgcatggggatgggcaccacctacctggcgctcatggccacgttcaagatgcgcccgatgttcgccgtgggcctgctgttccggcgcctcacctcccgggaggtgctgctgctcaccatcgggctgagcctggtcgcctccgtggagctccccaacagcctggaggagctgggcgacgggctcgccatgggcatcatgatcctgaagctgctcaccgacttccagtcccaccagctgtgggcgacgctgctcagcctgaccttcatcaagaccaccctgtccctccactacgcctggaagacgatggccatggtcctgagcatcgtgtccctgttccccctctgcctgagcaccacctcccagaagaccacgtggctgcccgtgctcctgggcagcctggggtgcaagccgctcaccatgttcctgatcgccgagaacaagatctggggccgcaagtcctggcccctgaacgaggggatcatggcggtcggcgtggtgagcatcctcctgagctccctgctcaagaacgacgtccccctggccgggcccctgatcgccggcggcatgctcatcgcctgctacgtgatcagcgggtccagcgccgacctgtccctggagaaggcggccgaggtgagctgggaggaggaggccgagcactccggcgccagccacaacatcctcgtcgaggtgcaggacgacgggaccatgaagatcaaggacgaggagcgggacgacaccctgaccatcctgctcaaggccacgctgctggcggtgtccggcgtctacccgctcagcatccccgccaccctgttcgtgtggtacttctggcagaagaagaagcagcgctccggggtgctgtgggacacccccagcccgcccgaggtcgagcgggccgtgctggacgacggcatctaccgcatcatgcagcggggcctcctggggcgctcccaggtgggcgtcggggtgttccaggagaacgtgttccacaccatgtggcacgtcacgcggggcgccgtgctgatgtaccaggggaagcgcctcgagcccagctgggcctccgtgaagaaggacctgatcagctacggcggcgggtggcggctgcagggctcctggaacaccggggaggaggtccaggtgatcgcggtggagcccggcaagaaccccaagaacgtccagaccgcccccgggaccttcaagacgcccgagggcgaggtgggcgccatcgccctcgacttcaagcccgggaccagcggctcccccatcgtgaaccgcgaggggaagatcgtcggcctgtacggcaacggggtggtgaccaccagcggcacgtacgtcagcgccatcgcgcaggccaaggcctcccaggaggggccgctgcccgagatcgaggacgaggtgttccggaagcgcaacctcaccatcatggacctgcaccccggcagcgggaagacccggcgctacctgccggccatcgtgcgggaggcgatcaagcgcaagctccggaccctgatcctggcccccacgcgcgtcgtggcctccgagatggccgaggccctcaagggcatgcccatccgctaccagaccaccgcggtcaagagcgagcacaccggcaaggagatcgtcgacctgatgtgccacgccacgttcaccatgcggctgctctcccccgtgcgcgtgccgaactacaacatgatcatcatggacgaggcccacttcaccgaccccagctccatcgccgcccgggggtacatcagcacccgcgtcggcatgggggaggcggccgccatcttcatgacggccacgccgcccggctccgtggaggccttcccgcagagcaacgcggtgatccaggacgaggagcgggacatccccgagcgctcctggaacagcgggtacgagtggatcaccgacttccccggcaagaccgtctggttcgtgccctccatcaagagcggcaacgacatcgccaactgcctgcggaagaacgggaagcgcgtgatccagctgtcccggaagacgttcgacaccgagtaccagaagaccaagaacaacgactgggactacgtcgtgaccacggacatcagcgagatgggcgccaacttccgcgccgaccgggtgatcgacccgcgccggtgcctcaagcccgtcatcctgaaggacgggcccgagcgcgtgatcctggcgggccccatgccggtcaccgtggcctccgccgcccagcggcgcgggcggatcggccgcaaccacaacaaggagggcgaccagtacatctacatggggcagcccctcaacaacgacgaggaccacgcccactggaccgaggcgaagatgctgctggacaacatcaacacccccgagggcatcatccccgccctcttcgagccggagcgggagaagtccgccgccatcgacggggagtaccgcctgcgcggcgaggcccggaagacgttcgtggagctgatgcgccgcggggacctccccgtctggctgtcctacaaggtggcgagcgagggcttccagtacagcgaccgccggtggtgcttcgacggcgagcgcaacaaccaggtgctggaggagaacatggacgtcgagatctggaccaaggagggggagcggaagaagctccgcccccggtggctggacgcccgcacctactccgaccccctggccctccgggagttcaaggagttcgccgccggccgccggagcgtgtccggggacctgatcctggagatcggcaagctcccgcagcacctgacccagcgcgcgcagaacgccctggacaacctcgtgatgctgcacaacagcgagcagggcgggcgggcctaccgccacgccatggaggagctgcccgacacgatcgagaccctcatgctgctggcgctcatcgccgtcctgaccggcggggtgaccctgttcttcctctccggccgggggctgggcaagaccagcatcggcctgctctgcgtgatggcctccagcgtcctgctgtggatggcctccgtggagccccactggatcgccgcgagcatcatcctcgagttcttcctgatggtgctgctcatccccgagccggaccgccagcggacgccccaggacaaccagctggcctacgtcgtgatcgggctcctcttcatgatcctgaccgtggccgccaacgagatgggcctgctcgagaccaccaagaaggacctggggatcggccacgtcgccgtggagaaccaccaccacgcgacgatgctggacgtggacctccaccccgcctccgcctggaccctgtacgccgtcgccaccaccatcatcacgccgatgatgcgccacaccatcgagaacaccaccgcgaacatcagcctgacggccatcgccaaccaggccgccatcctcatggggctggacaagggctggcccatctccaagatggacatcggcgtgcccctgctcgcgctggggtgctacagccaggtgaaccccctgaccctcaccgccgccgtcctgatgctggtggcccactacgcgatcatcggcccggggctccaggccaaggccacccgggaggcccagaagcgcacggccgcgggcatcatgaagaaccccaccgtggacgggatcgtcgccatcgacctggaccccgtggtgtacgacgccaagttcgagaagcagctgggccagatcatgctcctgatcctgtgcacctcccagatcctcctgatgcgcaccacgtgggccctgtgcgagagcatcaccctcgccaccggccccctgaccacgctgtgggaggggtccccgggcaagttctggaacaccaccatcgcggtcagcatggccaacatcttccgggggtcctacctcgccggcgccggcctggccttcagcctgatgaagtccctcgggggcgggcgccggggcaccggggcgcagggcgagacgctgggcgagaagtggaagcgccagctgaaccagctctccaagagcgagttcaacatctacaagcggtccgggatcatggaggtggaccgcagcgaggccaaggagggcctgaagcgcggggagaccacccgccacgccgtgtcccggggcaccgccaagctgcgctggttcgtcgagcggaacctggtgaagcccgaggggaaggtgatcgacctcggctgcggccgcgggggctggagctactactgcgcggggctgaagaaggtcacggaggtgaagggctacaccaagggcgggcccggccacgaggagcccatcccgatggccacctacgggtggaacctggtgaagctccactccggcaaggacgtcttcttcacgccgcccgagaagtgcgacacgctgctgtgcgacatcggggagagctcccccaacccgaccatcgaggagggccggaccctccgcgtgctgaagatggtggagccctggctgcgggggaaccagttctgcatcaagatcctcaacccctacatgcccagcgtcgtggagaccctggagcagatgcagcgcaagtacggcggcatgctggtgcggaacccgctctcccgcaacagcacccacgagatgtactgggtctcctgcgggacgggcaacatcgtgagcgccgtgaacatgacctcccggatgctgctgaaccgcttcaccatggcccaccgcaagcccacctacgagcgggacgtcgacctcggggccggcacgcgccacgtggcggtggagcccgaggtcgccaacctggacatcatcggccagcggatcgagaacatcaagcacgagcacaagagcacctggcactacgacgaggacaacccctacaagacctgggcctaccacgggtcctacgaggtgaagccgagcggctccgccagcagcatggtcaacggggtggtgaagctgctcaccaagccctgggacgtcatccccatggtgacgcagatcgccatgaccgacaccacccccttcggccagcagcgcgtgttcaaggagaaggtcgacacgcggaccccgaaggcgaagcgcgggaccgcccagatcatggaggtgaccgcccggtggctgtggggcttcctgtcccgcaacaagaagccccggatctgcacgcgcgaggagttcacccggaaggtgcgcagcaacgccgccatcggcgcggtcttcgtggacgagaaccagtggaactccgccaaggaggccgtggaggacgagcggttctgggacctcgtccagaaggagcgcgagctgcacaagcaggggaagtgcgcgacctgcgtgtacaacatgatgggcaagcgggagaagaagctgggggagttcggcaaggcgaaggggagccgcgccatctggtacatgtggctcggcgcccggttcctggagttcgaggccctgggcttcatgaacgaggaccactggttctcccgcgagaacagcctctccggggtggagggcgaggggctgcacaagctgggctacatcctccgggacatcagcaagatccccgggggcaacatgtacgccgacgacaccgcgggctgggacacgcgcatcaccgaggacgacctgcagaacgaggccaagatcaccgacatcatggagccggagcacgccctgctcgccacctccatcttcaagctgacgtaccagaacaaggtcgtgcgggtgcagcgccccgccaagaacgggaccgtcatggacgtgatcagccgccgggaccagcgcggctccggccaggtgggcacctacggcctgaacaccttcacgaacatggaggcgcagctcatccggcagatggagagcgaggggatcttcctgccctccgagctggagacccccaacctcgccgagcgcgtcctggactggctggagaagtacggcgtggagcggctcaagcgcatggccatcagcggggacgactgcgtggtcaagccgatcgacgaccggttcgccaccgccctgaccgcgctgaacgacatgggcaaggtgcgcaaggacatcccccagtgggagccctccaaggggtggaacgactggcagcaggtccccttctgcagccaccacttccaccagctcatcatgaaggacggccgggagatcgtcgtgccgtgccgcaaccaggacgagctggtgggccgggcccgcgtctcccagggggccggctggagcctgcgggagacggcctgcctcggcaagagctacgcccagatgtggcagctgatgtacttccaccgccgggacctgcgcctcgcggccaacgccatctgctccgccgaccccgtggactgggtgcccaccagccggaccacctggtccatccacgcgcaccaccagtggatgacgaccgaggacatgctgagcgtctggaaccgcgtgtggatcgaggagaacccctggatggaggacaagacccacgtgtccagctggggcgacgtcccgtacctggggaagcgggaggaccagtggtgcggctccctcatcggcctgaccgcccgcgccacctgggccagcaacatccaggtggccatcaaccaggtgcgccggctgatcgggaacgagaactacctcgactacatgacgtccatgaagcgcttcaagaacgagggcgaccccgagggggcgctgtggtga

SEQ ID NO: 8546 - RNA, 9879 nt, synthetic construct
  misc_feature 1..9879: note = derived and/or modified CDS sequence (opt1) from DENV-1__GQ199832__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgcgggggtgaacatgtgcaccctcatcgccatggacctgggcgagctgtgcgaggacaccatgacctacaagtgcccccgcatcaccgaggccgagcccgacgacgtggactgctggtgcaacgccacggacacctgggtgacctacgggacctgcagccagacgggcgagcaccggcgcgacaagcggagcgtggccctcgcgccccacgtgggcctggggctggagacccgcaccgagacctggatgtccagcgagggcgcctggaagcagatccagcgggtggagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgcccgacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgcccctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtggggaagctggtccaccagatcttcggcaccgcctacggggtcctgttctccggcgtgagctggaccatgaagatcgggatcggcgtcctgctgacgtggctcggcctgaactcccgcagcacctccctgagcatgacctgcatcgccgtggggctcgtgaccctgtacctgggcgtcatggtgcaggccgactccgggtgcgtgatcaactggaagggccgggagctcaagtgcgggagcggcatcttcgtcacgaacgaggtgcacacctggaccgagcagtacaagttccaggcggacagcccgaagcgcctgtccgccgccatcggcaaggcctgggaggagggggtgtgcggcatccggagcgccacccgcctggagaacatcatgtggaagcagatctccaacgagctcaaccacatcctgctggagaacgggatgaagttcaccgtcgtggtgggcgacgtcgtggggatcctcgcgcagggcaagaagatgatccggccccagcccatggagcacaagtacagctggaagtcctggggcaaggccaagatcatcggggccgacgtgcagaacacgaccttcatcatcgacggccccaacaccccggagtgccccgacgaccagcgcgcctggaacatctgggaggtcgaggactacgggttcggcatcttcaccacgaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacctgcatctggcccaagtcccacacgctgtggagcaacggggtgctcgagtccgagatgatcatccccaagatctacggcgggccgatcagccagcacaactaccgccccggctacttcacccagaccgccgggccctggcacctgggcaagctggagctcgacttcgacctgtgcgagggcaccacggtggtcgtggacgagcactgcgggaaccggggcccgtccctgcgcaccaccaccgtgacggggaagatcatccacgagtggtgctgccggagctgcaccctgccgcccctccgcttcaagggcgaggacgggtgctggtacggcatggagatccggcccgtcaaggagaaggaggagaacctggtgaagtccatggtgagcgccggcagcggggaggtcgactccttcagcctcggcctgctgtgcacctccatcatgatcgaggaggtgatgcgcagccggtggtcccgcaagatgctcatgaccgggacgctggccgtgttcctgctcctgatcatgggccagctgacctggaacgacctcatccggctgtgcatcatggtcggggccaacgcgagcgaccgcatgggcatgggcaccacctacctggccctcatggccacgttcaagatgcgcccgatgttcgccgtggggctgctgttccggcgcctcacctcccgggaggtgctgctgctcaccatcgggctgagcctggtcgcctccgtggagctccccaacagcctggaggagctgggggacggcctcgcgatgggcatcatgatcctgaagctgctcaccgacttccagtcccaccagctgtgggccacgctgctcagcctgaccttcatcaagaccaccctgtccctccactacgcctggaagacgatggccatggtcctgagcatcgtgtccctgttccccctctgcctgagcaccacctcccagaagaccacgtggctgcccgtgctcctggggagcctgggctgcaagccgctcaccatgttcctgatcgcggagaacaagatctgggggcgcaagtcctggcccctgaacgagggcatcatggccgtcggggtggtgagcatcctcctgagctccctgctcaagaacgacgtccccctggccggccccctgatcgccggcgggatgctcatcgcctgctacgtgatcagcggctccagcgcggacctgtccctggagaaggccgccgaggtgagctgggaggaggaggccgagcactccggggccagccacaacatcctcgtcgaggtgcaggacgacggcaccatgaagatcaaggacgaggagcgggacgacaccctgaccatcctgctcaaggcgacgctgctggccgtgtccggggtctacccgctcagcatccccgccaccctgttcgtgtggtacttctggcagaagaagaagcagcgctccggcgtgctgtgggacacccccagcccgcccgaggtcgagcgggccgtgctggacgacggcatctaccgcatcatgcagcgggggctcctgggccgctcccaggtgggggtcggcgtgttccaggagaacgtgttccacaccatgtggcacgtcacgcgcggggccgtgctgatgtaccagggcaagcgcctcgagcccagctgggcgtccgtgaagaaggacctgatcagctacggcgggggctggcggctgcaggggtcctggaacaccggcgaggaggtccaggtgatcgccgtggagcccgggaagaaccccaagaacgtccagaccgcccccggcaccttcaagacgcccgagggcgaggtgggggccatcgccctcgacttcaagcccggcaccagcgggtcccccatcgtgaaccgcgagggcaagatcgtcggcctgtacgggaacggcgtggtgaccaccagcgggacgtacgtcagcgcgatcgcccaggccaaggcctcccaggagggcccgctgcccgagatcgaggacgaggtgttccggaagcgcaacctcaccatcatggacctgcaccccgggagcggcaagacccggcgctacctgccggcgatcgtgcgggaggccatcaagcgcaagctccggaccctgatcctggcccccacgcgcgtcgtggcctccgagatggccgaggcgctcaagggcatgcccatccgctaccagaccaccgccgtcaagagcgagcacaccgggaaggagatcgtcgacctgatgtgccacgccacgttcaccatgcggctgctctcccccgtgcgcgtgccgaactacaacatgatcatcatggacgaggcccacttcaccgaccccagctccatcgccgcgcggggctacatcagcacccgcgtcgggatgggcgaggccgccgccatcttcatgacggccacgccgcccgggtccgtggaggcgttcccgcagagcaacgccgtgatccaggacgaggagcgggacatccccgagcgctcctggaacagcggctacgagtggatcaccgacttccccggcaagaccgtctggttcgtgccctccatcaagagcgggaacgacatcgccaactgcctgcggaagaacggcaagcgcgtgatccagctgtcccggaagacgttcgacaccgagtaccagaagaccaagaacaacgactgggactacgtcgtgaccacggacatcagcgagatgggggccaacttccgcgcggaccgggtgatcgacccgcgccggtgcctcaagcccgtcatcctgaaggacggccccgagcgcgtgatcctggccgggcccatgccggtcaccgtggcctccgccgcccagcggcgcggccggatcggccgcaaccacaacaaggagggggaccagtacatctacatgggccagcccctcaacaacgacgaggaccacgcgcactggaccgaggccaagatgctgctggacaacatcaacacccccgaggggatcatccccgccctcttcgagccggagcgggagaagtccgccgccatcgacggcgagtaccgcctgcgcggggaggcgcggaagacgttcgtggagctgatgcgccggggcgacctccccgtctggctgtcctacaaggtggccagcgagggcttccagtacagcgaccgccggtggtgcttcgacggggagcgcaacaaccaggtgctggaggagaacatggacgtcgagatctggaccaaggagggcgagcggaagaagctccgcccccggtggctggacgcccgcacctactccgaccccctggccctccgggagttcaaggagttcgccgcggggcgccggagcgtgtccggcgacctgatcctggagatcggcaagctcccgcagcacctgacccagcgcgcccagaacgccctggacaacctcgtgatgctgcacaacagcgagcagggcgggcgggcctacaagcacgcgatggaggagctgcccgacacgatcgagaccctcatgctgctggccctcatcgccgtcctgaccgggggcgtgaccctgttcttcctctccgggcgcggcctgggcaagaccagcatcgggctgctctgcgtgatggcctccagcgtcctgctgtggatggcctccgtggagccccactggatcgcggccagcatcatcctcgagttcttcctgatggtgctgctcatccccgagccggaccggcagcgcacgccccaggacaaccagctggcctacgtcgtgatcggcctcctcttcatcatcctgaccgtggccgccaacgagatggggctgctcgagaccaccaagaaggacctgggcatcgggcacgtcgcggtggagaaccaccaccacgccacgatgctggacgtggacctccaccccgcctccgcctggaccctgtacgccgtcgcgaccaccatcatcacgccgatgatgcggcacaccatcgagaacaccaccgccaacatcagcctgacggccatcgccaaccaggccgcgatcctcatgggcctggacaagggctggcccatctccaagatggacatcggggtgcccctgctcgccctgggctgctacagccaggtgaaccccctgaccctcaccgccgccgtcctgatgctggtggcgcactacgccatcatcgggccgggcctccaggccaaggccacccgcgaggcccagaagcggacggcggccgggatcatgaagaaccccaccgtggacggcatcgtcgccatcgacctggaccccgtggtgtacgacgccaagttcgagaagcagctgggccagatcatgctcctgatcctgtgcacctcccagatcctcctgatgcgcaccacgtgggccctgtgcgagagcatcaccctcgcgaccgggcccctgaccacgctgtgggagggctccccggggaagttctggaacaccaccatcgccgtcagcatggccaacatcttccgcggctcctacctcgccggcgccgggctggcgttcagcctgatgaagtccctcggcgggggccggcgcgggaccggcgcccagggcgagacgctgggggagaagtggaagcggcagctgaaccagctctccaagagcgagttcaacatctacaagcgctccggcatcatggaggtggaccggagcgaggccaaggaggggctgaagcgcggcgagaccacccggcacgccgtgtcccgcgggaccgcgaagctgcggtggttcgtcgagcgcaacctggtgaagcccgagggcaaggtgatcgacctcggctgcgggcggggcgggtggagctactactgcgccggcctgaagaaggtcacggaggtgaaggggtacaccaagggcggccccgggcacgaggagcccatcccgatggccacctacggctggaacctggtgaagctccactccgggaaggacgtcttcttcatcccgcccgagaagtgcgacaccctgctgtgcgacatcggcgagagctcccccaacccgacgatcgaggaggggcgcaccctccgggtgctgaagatggtggagccctggctgcgcggcaaccagttctgcatcaagatcctcaacccctacatgcccagcgtcgtggagaccctggagcagatgcagcggaagcacggcgggatgctggtgcgcaacccgctctcccggaacagcacccacgagatgtactgggtctcctgcggcaccgggaacatcgtgagcgccgtgaacatgacgtcccgcatgctgctgaaccggttcaccatggcccaccgcaagcccacctacgagcgcgacgtcgacctcggcgcgggcacccggcacgtggccgtggagcccgaggtcgccaacctggacatcatcgggcagcgcatcgagaacatcaagcacgagcacaagagcacgtggcactacgacgaggacaacccctacaagacctgggcctaccacggctcctacgaggtgaagccgagcgggtccgccagcagcatggtcaacggcgtggtgaagctgctcaccaagccctgggacgtcatccccatggtgacccagatcgcgatgacggacaccacccccttcgggcagcagcgggtgttcaaggagaaggtcgacacccgcacgccgaaggccaagcggggcaccgcccagatcatggaggtgaccgcccgctggctgtggggcttcctgtcccggaacaagaagccccgcatctgcacccgggaggagttcacgcgcaaggtgcggagcaacgccgcgatcggggccgtcttcgtggacgagaaccagtggaactccgccaaggaggccgtggaggacgagcgcttctgggacctcgtccagaaggagcgggagctgcacaagcagggcaagtgcgcgacctgcgtgtacaacatgatggggaagcgcgagaagaagctgggcgagttcgggaaggccaagggcagccgggccatctggtacatgtggctcggcgcccgcttcctggagttcgaggccctggggttcatgaacgaggaccactggttctcccgggagaacagcctctccggcgtggagggggagggcctgcacaagctggggtacatcctccgcgacatcagcaagatccccggcggcaacatgtacgcggacgacaccgccgggtgggacacccggatcacggaggacgacctgcagaacgaggccaagatcaccgacatcatggagccggagcacgccctgctcgccacctccatcttcaagctgacctaccagaacaaggtcgtgcgcgtgcagcggcccgcgaagaacggcacggtcatggacgtgatcagccgccgcgaccagcgggggtccggccaggtgggcacctacgggctgaacaccttcaccaacatggaggcccagctcatccgccagatggagagcgagggcatcttcctgccctccgagctggagacgcccaacctcgccgagcgggtcctggactggctggagaagtacggggtggagcgcctcaagcggatggccatcagcggcgacgactgcgtggtcaagccgatcgacgaccgcttcgccaccgcgctgaccgccctgaacgacatggggaaggtgcggaaggacatcccccagtgggagccctccaagggctggaacgactggcagcaggtccccttctgcagccaccacttccaccagctcatcatgaaggacggccgcgagatcgtcgtgccgtgccggaaccaggacgagctggtggggcgcgcccgggtctcccagggcgccgggtggagcctgcgcgagaccgcctgcctcggcaagagctacgcgcagatgtggcagctgatgtacttccaccggcgcgacctgcggctcgccgccaacgccatctgctccgcggtgcccgtggactgggtccccacgagccgcaccacctggtccatccacgcccaccaccagtggatgaccacggaggacatgctgagcgtgtggaaccgggtgtggatcgaggagaacccctggatggaggacaagacccacgtctccagctggggcgacgtgccgtacctgggcaagcgcgaggaccagtggtgcggctccctcatcgggctgaccgcccgggccacctgggccagcaacatccaggtggcgatcaaccaggtccgccgcctgatcggcaacgagaactacctcgactacatgacctccatgaagcggttcaagaacgagggggaccccgagggcgccctgtggtga

SEQ ID NO: 8547 - RNA, 9879 nt, synthetic construct
  misc_feature 1..9879: note = derived and/or modified CDS sequence (opt1) from DENV-1__FJ882568__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgcgggggtgaacatgtgcaccctcatcgccatggacctgggcgagctgtgcgaggacaccatgacctacaagtgcccccgcatcaccgaggccgagcccgacgacgtggactgctggtgcaacgccaccgacacctgggtgacctacgggacctgctcccagacgggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacggtcgtggaccggggctgggggaacggctgcgggctgttcggcaaggggagcctcatcacgtgcgccaagttcaagtgcgtgaccaagctggagggcaagatcgtccagtacgagaacctgaagtactccgtgatcgtgaccgtccacacgggcgaccagcaccaggtggggaacgagagcaccgagcacggcaccaccgcgaccatcacgccccaggcccccacctccgagatccagctcaccgactacggggccctgaccctggactgcagcccccgcacgggcctcgacttcaacgagatggtcctgctgaccatgaaggagaagtcctggctcgtgcacaagcagtggttcctggacctgccgctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcctgacccaggacgagaagggggtgacgcagaacggccggctgatcaccgccaacccgatcgtgaccgacaaggagaagcccgtcaacatcgaggccgagccgcccttcggggagagctacatcgtgatcggcgcgggcgagaaggccctcaagctgtcctggttcaagaaggggagctccatcggcaagatgttcgaggccaccgcccgcggggcccggcgcatggcgatcctgggcgacacggcctgggacttcgggagcatcggcggcgtgttcacctccgtcgggaagctcgtgcaccagatcttcggcaccgcctacggggtgctgttcagcggcgtctcctggaccatgaagatcgggatcggcgtgctgctcacgtggctgggcctgaacagccgctccaccagcctctccatgacctgcatcgccgtggggctggtcaccctgtacctcggcgtgatggtgcaggccgacagcgggtgcgtcatcaactggaagggccgggagctgaagtgcgggtccggcatcttcgtgacgaacgaggtgcacacctggaccgagcagtacaagttccaggcggacagcccgaagcgcctgagcgccgccatcggcaaggcctgggaggagggggtctgcggcatccggtccgccacccgcctcgagaacatcatgtggaagcagatcagcaacgagctgaaccacatcctgctcgagaacgggatgaagttcaccgtggtggtcggcgacgtggtggggatcctggcgcagggcaagaagatgatccggccccagcccatggagcacaagtactcctggaagtcctggggcaaggccaagatcatcggggccgacgtccagaacacgaccttcatcatcgacggccccaacaccccggagtgccccgacgaccagcgcgcctggaacatctgggaggtggaggactacgggttcggcatcttcaccacgaacatctggctgaagctccgggactcctacacccaggtgtgcgaccaccgcctgatgagcgcggccatcaaggactccaaggccgtccacgccgacatgggctactggatcgagagcgagaagaacgagacctggaagctggcccgggcgtccttcatcgaggtgaagacctgcatctggcccaagagccacacgctctggtccaacggggtgctggagagcgagatgatcatccccaagatctacggcgggccgatctcccagcacaactaccgccccggctacttcacccagaccgccgggccctggcacctgggcaagctcgagctggacttcgacctgtgcgagggcaccacggtcgtggtggacgagcactgcgggaaccggggcccgagcctccgcaccaccaccgtcacggggaagatcatccacgagtggtgctgccggtcctgcaccctgccgcccctgcgcttcaagggcgaggacgggtgctggtacggcatggagatccggcccgtgaaggagaaggaggagaacctcgtcaagagcatggtctccgccggcagcggggaggtggacagcttctccctgggcctgctctgcaccagcatcatgatcgaggaggtgatgcgctcccggtggagccgcaagatgctgatgaccgggacgctggccgtcttcctcctgctgatcatgggccagctcacctggaacgacctgatccggctgtgcatcatggtgggggccaacgcgtccgaccgcatgggcatgggcaccacctacctcgccctgatggccacgttcaagatgcgcccgatgttcgccgtggggctcctgttccggcgcctgaccagccgggaggtcctgctcctgaccatcgggctgtccctcgtggccagcgtcgagctgcccaactccctggaggagctcggggacggcctggcgatgggcatcatgatcctgaagctcctgaccgacttccagagccaccagctgtgggccacgctcctgtccctgaccttcatcaagaccaccctcagcctgcactacgcctggaagacgatggccatggtgctgtccatcgtgagcctcttccccctgtgcctgtccaccaccagccagaagaccacgtggctccccgtcctgctggggtccctcggctgcaagccgctgaccatgttcctgatcgcggagaacaagatctgggggcgcaagagctggcccctcaacgagggcatcatggccgtgggggtggtctccatcctgctgagcagcctcctgaagaacgacgtgcccctggccggccccctcatcgccggcgggatgctgatcgcctgctacgtgatctccggcagctccgcggacctgagcctcgagaaggccgccgaggtctcctgggaggaggaggccgagcacagcggggcctcccacaacatcctggtggaggtgcaggacgacggcaccatgaagatcaaggacgaggagcgggacgacaccctgaccatcctcctgaaggcgacgctgctcgccgtcagcggggtgtacccgctgtccatccccgccaccctgttcgtgtggtacttctggcagaagaagaagcagcgcagcggcgtcctgtgggacacccccagcccgcccgaggtggagcgggccgtgctcgacgacggcatctaccgcatcatgcagcgggggctgctgggccgcagccaggtcggggtgggcgtgttccaggagaacgtcttccacaccatgtggcacgtgacgcgcggggccgtgctcatgtaccagggcaagcgcctggagccctcctgggcgagcgtcaagaaggacctgatctcctacggcgggggctggcggctccaggggagctggaacaccggcgaggaggtccaggtgatcgccgtcgagcccgggaagaaccccaagaacgtgcagaccgcccccggcaccttcaagacgcccgagggcgaggtgggggccatcgccctggacttcaagcccggcacctccgggagccccatcgtcaaccgcgagggcaagatcgtgggcctgtacgggaacggcgtggtcaccacctccgggacgtacgtgagcgcgatcgcccaggccaaggccagccaggagggcccgctccccgagatcgaggacgaggtgttccggaagcgcaacctgaccatcatggacctgcaccccgggtccggcaagacccggcgctacctcccggcgatcgtccgggaggccatcaagcgcaagctgcggaccctgatcctcgcccccacgcgcgtggtggccagcgagatggccgaggcgctgaagggcatgcccatccgctaccagaccaccgccgtcaagtccgagcacaccgggaaggagatcgtggacctgatgtgccacgccacgttcaccatgcggctcctgagccccgtgcgcgtcccgaactacaacatgatcatcatggacgaggcccacttcaccgacccctccagcatcgccgcgcggggctacatctccacccgcgtggggatgggcgaggccgccgccatcttcatgacggccacgccgcccgggagcgtggaggcgttcccgcagtccaacgccgtcatccaggacgaggagcgggacatccccgagcgcagctggaactccggctacgagtggatcaccgacttccccggcaagaccgtgtggttcgtgcccagcatcaagtccgggaacgacatcgccaactgcctgcggaagaacggcaagcgcgtcatccagctcagccggaagacgttcgacaccgagtaccagaagaccaagaacaacgactgggactacgtggtgaccacggacatctccgagatgggggccaacttccgcgcggaccgggtcatcgacccgcgccggtgcctgaagcccgtgatcctgaaggacggccccgagcgcgtcatcctcgccgggcccatgccggtgaccgtggccagcgccgcccagcggcgcggccggatcggccgcaaccacaacaaggagggggaccagtacatctacatgggccagcccctgaacaacgacgaggaccacgcgcactggaccgaggccaagatgctgctcgacaacatcaacacccccgaggggatcatccccgccctgttcgagccggagcgggagaagtccgccgccatcgacggcgagtaccgcctgcgcggggaggcgcggaagacgttcgtcgagctcatgcgccggggcgacctgcccgtgtggctgagctacaaggtggcctccgagggcttccagtacagcgaccgccggtggtgcttcgacggggagcgcaacaaccaggtcctcgaggagaacatggacgtggagatctggaccaaggagggcgagcggaagaagctgcgcccccggtggctggacgcccgcacctacagcgaccccctcgccctgcgggagttcaaggagttcgccgcggggcgccggtccgtgagcggcgacctgatcctcgagatcggcaagctgccgcagcacctgacccagcgcgcccagaacgccctcgacaacctggtcatgctgcacaactccgagcagggcgggcgggcctaccgccacgcgatggaggagctccccgacacgatcgagaccctgatgctgctcgccctgatcgccgtgctgaccgggggcgtgaccctcttcttcctgagcgggcggggcctgggcaagacctccatcgggctcctgtgcgtcatggccagctccgtgctgctctggatggccagcgtggagccccactggatcgcggcctccatcatcctggagttcttcctgatggtcctcctgatccccgagccggaccgccagcggacgccccaggacaaccagctggcctacgtggtgatcggcctcctgttcatcatcctgaccgtcgccgccaacgagatggggctcctggagaccaccaagaaggacctgggcatcgggcacgtggcggtggagaaccaccaccacgccacgatgctcgacgtcgacctgcaccccgccagcgcctggaccctgtacgccgtggcgaccaccatcatcacgccgatgatgcgccacaccatcgagaacaccaccgccaacatctccctcacggccatcgccaaccaggccgcgatcctgatgggcctggacaagggctggcccatcagcaagatggacatcggggtgcccctcctggccctgggctgctactcccaggtcaaccccctcaccctgaccgccgccgtgctgatgctcgtggcgcactacgccatcatcgggccgggcctgcaggccaaggccacccgggaggcccagaagcgcacggcggccgggatcatgaagaaccccaccgtcgacggcatcgtggccatcgacctggaccccgtggtctacgacgccaagttcgagaagcagctcggccagatcatgctgctgatcctctgcaccagccagatcctgctgatgcgcaccacgtgggccctctgcgagtccatcaccctggcgaccgggcccctgaccacgctctgggagggcagcccggggaagttctggaacaccaccatcgccgtgtccatggccaacatcttccggggcagctacctggccggcgccgggctggcgttctccctcatgaagtccctgggcgggggccgccgggggaccggcgcccagggcgagacgctgggggagaagtggaagcgccagctcaaccagctgagcaagtccgagttcaacatctacaagcggagcggcatcatggaggtggaccgctccgaggccaaggaggggctgaagcggggcgagaccacccgccacgccgtcagccgggggaccgcgaagctgcgctggttcgtggagcggaacctcgtgaagcccgagggcaaggtcatcgacctgggctgcgggcgcggcgggtggtcctactactgcgccggcctgaagaaggtgacggaggtgaaggggtacaccaagggcggccccgggcacgaggagcccatcccgatggccacctacggctggaacctcgtcaagctgcacagcgggaaggacgtgttcttcacgccgcccgagaagtgcgacacgctgctctgcgacatcggcgagtccagccccaacccgaccatcgaggaggggcggaccctgcgcgtgctgaagatggtcgagccctggctccggggcaaccagttctgcatcaagatcctgaacccctacatgccctccgtggtggagaccctggagcagatgcagcgcaagcacggcgggatgctcgtccggaacccgctgagccgcaactccacccacgagatgtactgggtgagctgcggcacggggaacatcgtgtccgccgtcaacatgaccagccggatgctgctcaaccgcttcaccatggcccaccgcaagcccacctacgagcgggacgtggacctgggcgcgggcacgcgccacgtggccgtcgagcccgaggtggccaacctggacatcatcgggcagcggatcgagaacatcaagcacgagcacaagtccacctggcactacgacgaggacaacccctacaagacctgggcctaccacggcagctacgaggtcaagccgtccgggagcgcctccagcatggtgaacggcgtggtcaagctcctgaccaagccctgggacgtgatccccatggtgacgcagatcgcgatgaccgacaccacccccttcgggcagcagcgcgtcttcaaggagaaggtggacacgcggaccccgaaggccaagcgcggcaccgcccagatcatggaggtgaccgcccggtggctgtggggcttcctcagccgcaacaagaagccccggatctgcacgcgcgaggagttcacccggaaggtccgctccaacgccgcgatcggggccgtgttcgtggacgagaaccagtggaacagcgccaaggaggccgtcgaggacgagcggttctgggacctggtgcagaaggagcgcgagctgcacaagcagggcaagtgcgcgacctgcgtgtacaacatgatggggaagcgggagaagaagctcggcgagttcgggaaggccaagggctcccgcgccatctggtacatgtggctgggcgcccggttcctggagttcgaggccctcgggttcatgaacgaggaccactggttcagccgcgagaactccctgagcggcgtcgagggggagggcctgcacaagctcgggtacatcctgcgggacatctccaagatccccggcggcaacatgtacgcggacgacaccgccgggtgggacacgcgcatcaccgaggacgacctgcagaacgaggccaagatcaccgacatcatggagccggagcacgccctcctggccaccagcatcttcaagctgacgtaccagaacaaggtggtgcgggtccagcgccccgcgaagaacggcaccgtgatggacgtgatctcccgccgggaccagcgcgggagcggccaggtcggcacctacgggctcaacaccttcacgaacatggaggcccagctgatccggcagatggagtccgagggcatcttcctgcccagcgagctcgagacccccaacctggccgagcgcgtgctggactggctcgagaagtacggggtggagcggctgaagcgcatggccatctccggcgacgactgcgtcgtgaagccgatcgacgaccggttcgccaccgcgctgaccgccctcaacgacatggggaaggtgcgcaaggacatcccccagtgggagcccagcaagggctggaacgactggcagcaggtccccttctgctcccaccacttccaccagctgatcatgaaggacggccgggagatcgtggtgccgtgccgcaaccaggacgagctggtcgggcgggcccgcgtgagccagggcgccgggtggtccctccgggagacggcctgcctgggcaagagctacgcgcagatgtggcagctgatgtacttccaccgccgggacctccgcctggccgccaacgccatctgcagcgcggtgcccgtcgactgggtgcccacctcccggaccacctggagcatccacgcccaccaccagtggatgacgaccgaggacatgctgtccgtgtggaaccgcgtctggatcgaggagaacccctggatggaggacaagacccacgtgagctcctggggcgacgtgccgtacctcggcaagcgggaggaccagtggtgcggcagcctgatcgggctgaccgcccgcgccacctgggcctccaacatccaggtcgcgatcaaccaggtgcgccggctcatcggcaacgagaactacctggactacatgacgagcatgaagcgcttcaagaacgagggggaccccgagggcgccctgtggtga

SEQ ID NO: 8548 - RNA, 9879 nt, synthetic construct
  misc_feature 1..9879: note = derived and/or modified CDS sequence (opt1) from DENV-1__FJ882569__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgcgggggtgaacatgtgcaccctcatcgccatggacctgggcgagctgtgcgaggacaccatgacctacaagtgcccccgcatcaccgaggccgagcccgacgacgtggactgctggtgcaacgccaccgacacctgggtgacctacgggacctgcagccagacgggcgagcaccggcgcgacaagcggagcgtggccctcgcgccccacgtgggcctggggctggagacccgcaccgagacctggatgtccagcgagggcgcctggaagcagatccagcgggtggagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtggggaagctggtccaccagatcttcggcaccgcctacggggtcctgttctccggcgtgagctggaccatgaagatcgggatcggcgtcctgctgacgtggctcggcctgaactcccgcagcacctccctgagcatgacctgcatcgccgtggggctcgtgaccctgtacctgggcgtcatggtgcaggccgactccgggtgcgtgatcaactggaagggccgggagctcaagtgcgggagcggcatcttcgtcacgaacgaggtgcacacctggaccgagcagtacaagttccaggcggacagcccgaagcgcctgtccgccgccatcggcaaggcctgggaggagggggtgtgcggcatccggagcgccacccgcctggagaacatcatgtggaagcagatctccaacgagctcaaccacatcctgctggagaacgggatgaagttcaccgtcgtggtgggcgacgtcgtggggatcctcgcgcagggcaagaagatgatccggccccagcccatggagcacaagtacagctggaagtcctggggcaaggccaagatcatcggggccgacgtgcagaacacgaccttcatcatcgacggccccaacaccccggagtgccccgacgaccagcgcgcctggaacatctgggaggtcgaggactacgggttcggcatcttcaccacgaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacctgcatctggcccaagtcccacacgctgtggagcaacggggtgctcgagtccgagatgatcatccccaagatctacggcgggccgatcagccagcacaactaccgccccggctacttcacccagaccgccgggccctggcacctgggcaagctggagctcgacttcgacctgtgcgagggcaccacggtggtcgtggacgagcactgcgggaaccggggcccgtccctgcgcaccaccaccgtgacggggaagatcatccacgagtggtgctgccggagctgcaccctgccgcccctccgcttcaagggcgaggacgggtgctggtacggcatggagatccggcccgtcaaggagaaggaggagaacctggtgaagtccatggtgagcgccggcagcggggaggtcgactccttcagcctcggcctgctgtgcacctccatcatgatcgaggaggtgatgcgcagccggtggtcccgcaagatgctcatgaccgggacgctggccgtgttcctgctcctgatcatgggccagctgacctggaacgacctcatccggctgtgcatcatggtcggggccaacgcgagcgaccgcatgggcatgggcaccacctacctggccctcatggccacgttcaagatgcgcccgatgttcgccgtggggctgctgttccggcgcctcacctcccgggaggtgctgctgctcaccatcgggctgagcctggtcgcctccgtggagctccccaacagcctggaggagctgggggacggcctcgcgatgggcatcatgatcctgaagctgctcaccgacttccagtcccaccagctgtgggccacgctgctcagcctgaccttcatcaagaccaccctgtccctccactacgcctggaagacgatggccatggtcctgagcatcgtgtccctgttccccctctgcctgagcaccacctcccagaagaccacgtggctgcccgtgctcctggggagcctgggctgcaagccgctcaccatgttcctgatcgcggagaacaagatctgggggcgccggtcctggcccctgaacgagggcatcatggccgtcggggtggtgagcatcctcctgagctccctgctcaagaacgacgtccccctggccggccccctgatcgccggcgggatgctcatcgcctgctacgtgatcagcggctccagcgcggacctgtccctggagaaggccgccgaggtgagctgggaggaggaggccgagcactccggggccagccacaacatcctcgtcgaggtgcaggacgacggcaccatgaagatcaaggacgaggagcgcgacgacaccctgaccatcctgctcaaggcgacgctgctggccgtgtccggggtctacccgctcagcatccccgccaccctgttcgtgtggtacttctggcagaagaagaagcagcggtccggcgtgctgtgggacacccccagcccgcccgaggtcgagcgcgccgtgctggacgacggcatctaccggatcatgcagcgcgggctcctgggccggtcccaggtgggggtcggcgtgttccaggagaacgtgttccacaccatgtggcacgtcacgcgcggggccgtgctgatgtaccagggcaagcggctcgagcccagctgggcgtccgtgaagaaggacctgatcagctacggcgggggctggcgcctgcaggggtcctggaacaccggcgaggaggtccaggtgatcgccgtggagcccgggaagaaccccaagaacgtccagaccgcccccggcaccttcaagacgcccgagggcgaggtgggggccatcgccctcgacttcaagcccggcaccagcgggtcccccatcgtgaaccgggagggcaagatcgtcggcctgtacgggaacggcgtggtgaccaccagcgggacgtacgtcagcgcgatcgcccaggccaaggcctcccaggagggcccgctgcccgagatcgaggacgaggtgttccgcaagcggaacctcaccatcatggacctgcaccccgggagcggcaagacccgccggtacctgccggcgatcgtgcgcgaggccatcaagcggaagctccgcaccctgatcctggcccccacgcgcgtcgtggcctccgagatggccgaggcgctcaagggcatgcccatccggtaccagaccaccgccgtcaagagcgagcacaccgggaaggagatcgtcgacctgatgtgccacgccacgttcaccatgcgcctgctctcccccgtgcgggtgccgaactacaacatgatcatcatggacgaggcccacttcaccgaccccagctccatcgccgcgcgcggctacatcagcacccgggtcgggatgggcgaggccgccgccatcttcatgacggccacgccgcccgggtccgtggaggcgttcccgcagagcaacgccgtgatccaggacgaggagcgcgacatccccgagcggtcctggaacagcggctacgagtggatcaccgacttccccggcaagaccgtctggttcgtgccctccatcaagagcgggaacgacatcgccaactgcctgcgcaagaacggcaagcgggtgatccagctgtcccgcaagacgttcgacaccgagtaccagaagaccaagaacaacgactgggactacgtcgtgaccacggacatcagcgagatgggggccaacttccgggcggaccgcgtgatcgacccgcggcgctgcctcaagcccgtcatcctgaaggacggccccgagcgggtgatcctggccgggcccatgccggtcaccgtggcctccgccgcccagcgccggggccgcatcggccggaaccacaacaaggagggggaccagtacatctacatgggccagcccctcaacaacgacgaggaccacgcgcactggaccgaggccaagatgctgctggacaacatcaacacccccgaggggatcatccccgccctcttcgagccggagcgcgagaagtccgccgccatcgacggcgagtaccgcctgcgcggggaggcgcgcaagacgttcgtggagctgatgcggcgcggcgacctccccgtctggctgtcctacaaggtggccagcgagggcttccagtacagcgaccggcgctggtgcttcgacggggagcggaacaaccaggtgctggaggagaacatggacgtcgagatctggaccaaggagggcgagcgcaagaagctccggccccgctggctggacgcccggacctactccgaccccctggccctccgcgagttcaaggagttcgccgcggggcggcgcagcgtgtccggcgacctgatcctggagatcggcaagctcccgcagcacctgacccagcgggcccagaacgccctggacaacctcgtgatgctgcacaacagcgagcagggcgggcgcgcctaccggcacgcgatggaggagctgcccgacacgatcgagaccctcatgctgctggccctcatcgccgtcctgaccgggggcgtgaccctgttcttcctctccgggcgcggcctgggcaagaccagcatcgggctgctctgcgtgatggcctccagcgtcctgctgtggatggcctccgtggagccccactggatcgcggccagcatcatcctcgagttcttcctgatggtgctgctcatccccgagccggaccggcagcgcacgccccaggacaaccagctggcctacgtcgtgatcggcctcctcttcatgatcctgaccgtggccgccaacgagatggggctgctcgagaccaccaagaaggacctgggcatcgggcacgtcgcggtggagaaccaccaccacgccacgatgctggacgtggacctccaccccgcctccgcctggaccctgtacgccgtcgcgaccaccatcatcacgccgatgatgcggcacaccatcgagaacaccaccgccaacatcagcctgacggccatcgccaaccaggccgcgatcctcatgggcctggacaagggctggcccatctccaagatggacatcggggtgcccctgctcgccctgggctgctacagccaggtgaaccccctgaccctcaccgccgccgtcctgatgctggtggcgcactacgccatcatcgggccgggcctccaggccaaggccacccgcgaggcccagaagcgcacggcggccgggatcatgaagaaccccaccgtggacggcatcgtcgccatcgacctggaccccgtggtgtacgacgccaagttcgagaagcagctgggccagatcatgctcctgatcctgtgcacctcccagatcctcctgatgcggaccacgtgggccctgtgcgagagcatcaccctcgcgaccgggcccctgaccacgctgtgggagggctccccggggaagttctggaacaccaccatcgccgtcagcatggccaacatcttccgcggctcctacctcgccggcgccgggctggcgttcagcctgatgaagtccctcggcgggggccggcgcgggaccggcgcccagggcgagacgctgggggagaagtggaagcggcagctgaaccagctctccaagagcgagttcaacatctacaagcgctccggcatcatggaggtggaccggagcgaggccaaggaggggctgaagcgcggcgagaccacccggcacgccgtgtcccgcgggaccgcgaagctgcggtggttcgtcgagcgcaacctggtgaagcccgagggcaaggtgatcgacctcggctgcgggcggggcgggtggagctactactgcgccggcctgaagaaggtcacggaggtgaaggggtacaccaagggcggccccgggcacgaggagcccatcccgatggccacctacggctggaacctggtgaagctccactccgggaaggacgtcttcttcacgccgcccgagaagtgcgacacgctgctgtgcgacatcggcgagagctcccccaacccgaccatcgaggaggggcgcaccctccgggtgctgaagatggtggagccctggctgcgcggcaaccagttctgcatcaagatcctcaacccctacatgcccagcgtcgtggagaccctggagcagatgcagcggaagcacggcgggatgctggtgcgcaacccgctctcccggaacagcacccacgagatgtactgggtctcctgcggcacggggaacatcgtgagcgccgtgaacatgacctcccgcatgctgctgaaccgcttcaccatggcccaccggaagcccacctacgagcgcgacgtcgacctcggcgcgggcacgcggcacgtggccgtggagcccgaggtcgccaacctggacatcatcgggcagcgcatcgagaacatcaagcacgagcacaagagcacctggcactacgacgaggacaacccctacaagacctgggcctaccacggctcctacgaggtgaagccgagcgggtccgccagcagcatggtcaacggcgtggtgaagctgctcaccaagccctgggacgtcatccccatggtgacgcagatcgcgatgaccgacaccacccccttcgggcagcagcgggtgttcaaggagaaggtcgacacgcgcaccccgaaggccaagcggggcaccgcccagatcatggaggtgaccgcccgctggctgtggggcttcctgtcccggaacaagaagccccgcatctgcacgcgggaggagttcacccgcaaggtgcggagcaacgccgcgatcggggccgtcttcgtggacgagaaccagtggaactccgccaaggaggccgtggaggacgagcgcttctgggacctcgtccagaaggagcgggagctgcacaagcagggcaagtgcgcgacctgcgtgtacaacatgatggggaagcgcgagaagaagctgggcgagttcgggaaggccaagggcagccgggccatctggtacatgtggctcggcgcccgcttcctggagttcgaggccctggggttcatgaacgaggaccactggttctcccgggagaacagcctctccggcgtggagggggagggcctgcacaagctggggtacatcctccgcgacatcagcaagatccccggcggcaacatgtacgcggacgacaccgccgggtgggacacgcggatcaccgaggacgacctgcagaacgaggccaagatcaccgacatcatggagccggagcacgccctgctcgccacctccatcttcaagctgacgtaccagaacaaggtcgtgcgcgtgcagcgccccgcgaagaacggcaccgtcatggacgtgatcagccggcgcgaccagcgggggtccggccaggtgggcacctacgggctgaacaccttcacgaacatggaggcccagctcatccgccagatggagagcgagggcatcttcctgccctccgagctggagacccccaacctcgccgagcgggtcctggactggctggagaagtacggggtggagcgcctcaagcggatggccatcagcggcgacgactgcgtggtcaagccgatcgacgaccgcttcgccaccgcgctgaccgccctgaacgacatggggaaggtgcggaaggacatcccccagtgggagccctccaagggctggaacgactggcagcaggtccccttctgcagccaccacttccaccagctcatcatgaaggacggccgcgagatcgtcgtgccgtgccggaaccaggacgagctggtggggcgcgcccgggtctcccagggcgccgggtggagcctgcgcgagacggcctgcctcggcaagagctacgcgcagatgtggcagctgatgtacttccaccggcgcgacctgcggctcgccgccaacgccatctgctccgcggtgcccgtggactgggtccccaccagccgcaccacctggtccatccacgcccaccaccagtggatgacgaccgaggacatgctgagcgtgtggaaccgggtgtggatcgaggagaacccctggatggaggacaagacccacgtctccagctggggcgacgtgccgtacctgggcaagcgcgaggaccagtggtgcggctccctcatcgggctgaccgcccgcgccacctgggccagcaacatccaggtggcgatcaaccaggtccggcgcctgatcggcaacgagaactacctcgactacatgacgtccatgaagcggttcaagaacgagggggaccccgagggcgccctgtggtga

SEQ ID NO: 8549 - RNA, 9879 nt, synthetic construct
  misc_feature 1..9879: note = derived and/or modified CDS sequence (opt1) from DENV-1__GQ199833__SS-prME
  source 1..9879: mol_type = other RNA
agcgtgaccatgctgctcatgctgatgcccaccgccctggccttccacctcaccacccgcggcggggagccccacatgatcgtgaccaagcaggagcggggcaagagcctgctgttcaagaccagcgcgggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtgacctacgggacctgcagccagacgggcgagcaccggcgcgaccggcgcagcgtggccctcgcgccccacgtgggcctggggctggagacccggaccgagacctggatgtccagcgagggcgcctggaagcagatccagcgcgtggagacgtgggccctccggcaccccgggttcaccgtgatcgccctgttcctggcgcacgccatcggcacctccatcacccagaaggggatcatcttcatcctcctgatgctggtgacgcccagcatggccatgcgctgcgtcggcatcggctcccgggacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcgcaagctctgcatcgaggccaagatcagcaacaccacgaccgactcccggtgccccacccagggcgaggccaccctgatggaggagcaggacgccaacttcgtgtgccgccggacgttcgtcgaccgcggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccggacgggcctcgacttcaacgagatggtgctgctgaccatgaaggggaagtcctggctcgtccacaagcagtggttcctggacctgccgctcccctggaccagcggcgccagcacctcccaggagacgtggaaccgccaggacctgctggtgaccttcaagaccgcccacgcgaagaagcaggaggtggtcgtgctcggcagccaggagggggccatgcacaccgccctgacgggcgccaccgagatccagacctccgggaccacgaccatcttcgccggccacctgaagtgccggctcaagatggacaagctgaccctgaaggggatgagctacgtgatgtgcaccggctccttcaagctcgagaaggaggtcgcggagacgcagcacggcaccgtgctggtgcagatcaagtacgaggggaccgacgccccctgcaagatccccttcagcacccaggacgagaagggcgtcacgcagaacgggcgcctgatcaccgccaacccgatcgtgaccgacaaggagaagcccgtgaacatcgaggccgagccgcccttcggcgagtcctacatcgtcatcggcgcgggggagaaggccctgaagctcagctggttcaagaagggctccagcatcgggaagatgttcgaggccaccgcccggggcgcccgccgcatggcgatcctgggggacacggcctgggacttcggctccatcggcggggtgttcaccagcgtgggcaagctggtccaccagatcttcgggaccgcctacggcgtcctgttctccggggtgagctggaccatgaagatcggcatcggcgtcctgctgacgtggctcgggctgaactcccggagcacctccctgagcatgacctgcatcgccgtgggcctcgtgaccctgtacctgggggtcatggtgcaggccgactccggctgcgtgatcaactggaaggggcgcgagctcaagtgcggcagcggcatcttcgtcacgaacgaggtgcacacctggaccgagcagtacaagttccaggcggacagcccgaagcggctgtccgccgccatcgggaaggcctgggaggagggcgtgtgcgggatccgcagcgccacccggctggagaacatcatgtggaagcagatctccaacgagctcaaccacatcctgctggagaacggcatgaagttcaccgtcgtggtgggggacgtcgtgggcatcctcgcgcagggcaagaagatgatccgcccccagcccatggagcacaagtacagctggaagtcctgggggaaggccaagatcatcggcgccgacgtgcagaacacgaccttcatcatcgacgggcccaacaccccggagtgccccgacgaccagcgggcctggaacatctgggaggtcgaggactacggcttcggcatcttcaccacgaacatctggctgaagctgcgcgacagctacacccaggtgtgcgaccaccggctcatgtccgcggccatcaaggacagcaaggccgtgcacgccgacatggggtactggatcgagtccgagaagaacgagacctggaagctggcccgcgcgagcttcatcgaggtcaagacctgcatctggcccaagtcccacacgctgtggagcaacggcgtgctcgagtccgagatgatcatccccaagatctacgggggcccgatcagccagcacaactaccggcccgggtacttcacccagaccgccggcccctggcacctgggcaagctggagctcgacttcgacctgtgcgaggggaccacggtggtcgtggacgagcactgcggcaaccgcgggccgtccctgcggaccaccaccgtgacgggcaagatcatccacgagtggtgctgccgcagctgcaccctgccgcccctccggttcaagggggaggacggctgctggtacggcatggagatccgccccgtcaaggagaaggaggagaacctggtgaagtccatggtgagcgccgggagcggcgaggtcgactccttcagcctcgggctgctgtgcatctccatcatgatcgaggaggtgatgcggagccgctggtcccggaagatgctcatgaccggcaccctggccgtgttcctgctcctgatcatggggcagctgacgtggaacgacctcatccgcctgtgcatcatggtcggcgccaacgcgagcgaccgcatgggcatggggaccacctacctggccctcatggccaccttcaagatgcggccgatgttcgccgtgggcctgctgttccgccggctcacgtcccgcgaggtgctgctgctcaccatcgggctgagcctggtcgcctccgtggagctccccaacagcctggaggagctgggcgacggcctcgcgatggggatcatgatcctgaagctgctcaccgacttccagtcccaccagctgtgggccaccctgctcagcctgacgttcatcaagaccaccctgtccctccactacgcctggaagaccatggccatggtcctgagcatcgtgtccctgttccccctctgcctgagcacgacctcccagaagaccacctggctgcccgtgctcctgggcagcctggggtgcaagccgctcacgatgttcctgatcgcggagaacaagatctggggccggaagtcctggcccctgaacgaggggatcatggccgtcggcgtggtgagcatcctcctgagctccctgctcaagaacgacgtccccctggccggccccctgatcgccgggggcatgctcatcgcctgctacgtgatcagcgggtccagcgcggacctgtccctggagaaggccgccgaggtgagctgggaggaggaggccgagcactccggcgccagccacaacatcctcgtcgaggtgcaggacgacgggaccatgaagatcaaggacgaggagcgcgacgacaccctgaccatcctgctcaaggcgaccctgctggccgtgtccggcgtctacccgctcagcatccccgccacgctgttcgtgtggtacttctggcagaagaagaagcagcggtccggcgtgctgtgggacacccccagcccgcccgaggtcgagcgcgccgtgctggacgacgggatctaccggatcatgcagcgcggcctcctggggcggtcccaggtgggcgtcggggtgttccaggagaacgtgttccacaccatgtggcacgtcacccgcggcgccgtgctgatgtaccagggcaagcggctcgagcccagctgggcgtccgtgaagaaggacctgatcagctacgggggcgggtggcgcctgcagggctcctggaacacgggggaggaggtccaggtgatcgccgtggagcccggcaagaaccccaagaacgtccagaccgcccccggcaccttcaagacccccgagggggaggtgggcgccatcgccctcgacttcaagcccgggacgagcggctcccccatcgtgaaccgggagggcaagatcgtcgggctgtacggcaacggggtggtgaccaccagcggcacctacgtcagcgcgatcgcccaggccaaggcctcccaggaggggccgctgcccgagatcgaggacgaggtgttccgcaagcggaacctcacgatcatggacctgcaccccggcagcggcaagacccgccggtacctgccggcgatcgtgcgcgaggccatcaagcggaagctccgcaccctgatcctggcccccacccgcgtcgtggcctccgagatggccgaggcgctcaaggggatgcccatccggtaccagacgaccgccgtcaagagcgagcacaccggcaaggagatcgtcgacctgatgtgccacgccaccttcacgatgcgcctgctctcccccgtgcgggtgccgaactacaacatgatcatcatggacgaggcccacttcaccgaccccagctccatcgccgcgcgcgggtacatcagcacccgggtcggcatgggggaggccgccgccatcttcatgaccgccacgccgcccggctccgtggaggcgttcccgcagagcaacgccgtgatccaggacgaggagcgcgacatccccgagcggtcctggaacagcggctacgagtggatcaccgacttccccgggaagaccgtctggttcgtgccctccatcaagagcggcaacgacatcgccaactgcctgcgcaagaacgggaagcgggtgatccagctgtcccgcaagaccttcgacacggagtaccagaagaccaagaacaacgactgggactacgtcgtgaccaccgacatcagcgagatgggcgccaacttccgggcggaccgcgtgatcgacccgcggcgctgcctcaagcccgtcatcctgaaggacgggcccgagcgggtgatcctggccggccccatgccggtcacggtggcctccgccgcccagcgccggggccgcatcgggcggaaccacaacaaggagggcgaccagtacatctacatggggcagcccctcaacaacgacgaggaccacgcgcactggaccgaggccaagatgctgctggacaacatcaacacccccgagggcatcatccccgccctcttcgagccggagcgcgagaagtccgccgccatcgacggggagtaccgcctgcggggcgaggcgcgcaagaccttcgtggagctgatgcggcgcggcgacctccccgtctggctgtcctacaaggtggccagcgaggggttccagtacagcgaccggcgctggtgcttcgacggcgagcggaacaaccaggtgctggaggagaacatggacgtcgagatctggacgaaggagggggagcgcaagaagctccggccccgctggctggacgcccggacctactccgaccccctggccctccgcgagttcaaggagttcgccgcgggccggcgcagcgtgtccggcgacctgatcctggagatcgggaagctcccgcagcacctgacccagcgggcccagaacgccctggacaacctcgtgatgctgcacaacagcgagcagggcgggcgcgcctaccggcacgcgatggaggagctgcccgacaccatcgagacgctcatgctgctggccctcatcgccgtcctgaccggcggggtgaccctgttcttcctctccggccgcggcctggggaagaccagcatcggcctgctctgcgtgatggcctccagcgtcctgctgtggatggcctccgtggagccccactggatcgcggccagcatcatcctcgagttcttcctgatggtgctgctcatccccgagccggaccggcagcgcacgccccaggacaaccagctggcctacgtcgtgatcgggctcctcttcatgatcctgacggtggccgccaacgagatgggcctgctcgagaccaccaagaaggacctggggatcggccacgtcgcggtggagaaccaccaccacgccaccatgctggacgtggacctccaccccgcctccgcctggacgctgtacgccgtcgcgaccaccatcatcaccccgatgatgcggcacacgatcgagaacaccaccgccaacatcagcctgaccgccatcgccaaccaggccgcgatcctcatgggcctggacaaggggtggcccatctccaagatggacatcggcgtgcccctgctcgccctggggtgctacagccaggtgaaccccctgacgctcaccgccgccgtcctgatgctggtggcgcactacgccatcatcggcccggggctccaggccaaggccacccgcgaggcccagaagcgcaccgcggccggcatcatgaagaaccccacggtggacggcatcgtcgccatcgacctggaccccgtggtgtacgacgccaagttcgagaagcagctggggcagatcatgctcctgatcctgtgcacctcccagatcctcctgatgcggaccacctgggccctgtgcgagagcatcacgctcgcgaccggccccctgaccaccctgtgggaggggtccccgggcaagttctggaacacgaccatcgccgtcagcatggccaacatcttccgcggctcctacctcgccggggccggcctggcgttcagcctgatgaagtccctcgggggcgggcggcgcggcaccggcgcccagggggagaccctgggcgagaagtggaagcggcagctgaaccagctctccaagagcgagttcaacatctacaagcgctccgggatcatggaggtggaccggagcgaggccaaggagggcctgaagcgcggggagacgacccggcacgccgtgtcccgcggcaccgcgaagctgcggtggttcgtcgagcgcaacctggtgaagcccgagggcaaggtgatcgacctcgggtgcggccgcggcgggtggagctactactgcgccgggctgaagaaggtcaccgaggtgaaggggtacacgaagggcgggcccggccacgaggagcccatcccgatggccacctacgggtggaacctggtgaagctccactccggcaaggacgtcttcttcacgccgcccgagaagtgcgacaccctgctgtgcgacatcggggagagctcccccaacccgacgatcgaggagggccgcaccctccgggtgctgaagatggtggagccctggctgcgcggcaaccagttctgcatcaagatcctcaacccctacatgcccagcgtcgtggagaccctggagcagatgcagcggaagcacgggggcatgctggtgcgcaacccgctctcccggaacagcacccacgagatgtactgggtctcctgcgggaccggcaacatcgtgagcgccgtgaacatgacgtcccgcatgctgctgaaccgcttcaccatggcccaccggaagcccacctacgagcgcgacgtcgacctcggcgcggggacccggcacgtggccgtggagcccgaggtcgccaacctggacatcatcggccagcgcatcgagaacatcaagcacgagcacaagagcacgtggcactacgacgaggacaacccctacaagacctgggcctaccacgggtcctacgaggtgaagccgagcggctccgccagcagcatggtcaacggggtggtgaagctgctcaccaagccctgggacgtcatccccatggtgacccagatcgcgatgacggacaccacccccttcggccagcagcgggtgttcaaggagaaggtcgacacccgcacgccgaaggccaagcggggcaccgcccagatcatggaggtgaccgcccgctggctgtgggggttcctgtcccggaacaagaagccccgcatctgcacccgggaggagttcacgcgcaaggtgcggagcaacgccgcgatcggcgccgtcttcgtggacgagaaccagtggaactccgccaaggaggccgtggaggacgagcgcttctgggacctcgtccagaaggagcgggagctgcacaagcaggggaagtgcgcgacctgcgtgtacaacatgatgggcaagcgcgagaagaagctgggggagttcggcaaggccaagggcagccgggccatctggtacatgtggctcggggcccgcttcctggagttcgaggccctgggcttcatgaacgaggaccactggttctcccgggagaacagcctctccggggtggagggcgaggggctgcacaagctgggctacatcctccgcgacatcagcaagatccccggcgggaacatgtacgcggacgacaccgccggctgggacacccggatcacggaggacgacctgcagaacgaggccaagatcaccgacatcatggagccggagcacgccctgctcgccacctccatcttcaagctgacctaccagaacaaggtcgtgcgcgtgcagcgccccgcgaagaacgggacggtcatggacgtgatcagccggcgcgaccagcggggctccggccaggtggggacctacggcctgaacaccttcaccaacatggaggcccagctcatccgccagatggagagcgaggggatcttcctgccctccgagctggagacgcccaacctcgccgagcgggtcctggactggctggagaagtacggcgtggagcgcctcaagcggatggccatcagcggggacgactgcgtggtcaagccgatcgacgaccgcttcgccaccgcgctgaccgccctgaacgacatgggcaaggtgcggaaggacatcccccagtgggagccctccaagggctggaacgactggcagcaggtccccttctgcagccaccacttccaccagctcatcatgaaggacgggcgcgagatcgtcgtgccgtgccggaaccaggacgagctggtgggccgcgcccgggtctcccagggggccggctggagcctgcgcgagaccgcctgcctcggcaagagctacgcgcagatgtggcagctgatgtacttccaccggcgcgacctgcggctcgccgccaacgccatctgctccgcggtgcccgtggactgggtccccacgagccgcaccacctggtccatccacgcccaccaccagtggatgaccacggaggacatgctgagcgtgtggaaccgggtgtggatcgaggagaacccctggatggaggacaagacccacgtctccagctggggcgacgtgccgtacctgggcaagcgcgaggaccagtggtgcgggtccctcatcggcctgaccgcccgcgccacctgggccagcaacatccaggtggcgatcaaccaggtccggcgcctgatcgggaacgagaactacctcgactacatgacctccatgaagcggttcaagaacgagggcgaccccgagggggccctgtggtga

SEQ ID NO: 8550 - RNA, 9879 nt, synthetic construct
  misc_feature 1..9879: note = derived and/or modified CDS sequence (opt1) from DENV-1__FJ882570__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgccggggtgaacatgtgcaccctcatcgccatggacctgggcgagctgtgcgaggacaccatgacctacaagtgcccccgcatcaccgaggccgagcccgacgacgtggactgctggtgcaacgccaccgacacctgggtgacctacgggacctgcagccagacgggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgggaagggcgtcacgcagaacgggcggctgatcaccgccaacccgatcgtgaccgacaaggagaagcccgtgaacatcgaggccgagccgcccttcggcgagtcctacatcgtcatcggcgcgggggagaaggccctgaagctcagctggttcaagaagggctccagcatcgggaagatgttcgaggccaccgcccgcggcgcccggcgcatggcgatcctgggggacacggcctgggacttcggctccatcggcggggtgttcaccagcgtgggcaagctggtccaccagatcttcgggaccgcctacggcgtgctgttctccggggtgagctggaccatgaagatcggcatcggcgtcctgctgacgtggctcgggctgaactcccgcagcacctccctgagcatgacctgcatcgccgtgggcctcgtgaccctgtacctgggggtcatggtgcaggccgactccggctgcgtgatcaactggaaggggcgggagctcaagtgcggcagcggcatcttcgtcacgaacgaggtgcacacctggaccgagcagtacaagttccaggcggacagcccgaagcgcctgtccgccgccatcgggaaggcctgggaggagggcgtgtgcgggatccggagcgccacccgcctggagaacatcatgtggaagcagatctccaacgagctcaaccacatcctgctggagaacggcatgaagttcaccgtcgtggtgggggacgtcgtgggcatcctcgcgcagggcaagaagatgatccggccccagcccatggagcacaagtacagctggaagtcctgggggaaggccaagatcatcggcgccgacgtgcagaacacgaccttcatcatcgacgggcccaacaccccggagtgccccgacgaccagcgcgcctggaacatctgggaggtcgaggactacggcttcggcatcttcaccacgaacatctggctgaagctgcgggacagctacacccaggtgtgcgaccaccgcctcatgtccgcggccatcaaggacagcaaggccgtgcacgccgacatggggtactggatcgagtccgagaagaacgagacctggaagctggcccgggcgagcttcatcgaggtcaagacctgcatctggcccaagtcccacacgctgtggagcaacggcgtgctcgagtccgagatgatcatccccaagatctacgggggcccgatcagccagcacaactaccgccccgggtacttcacccagaccgccggcccctggcacctgggcaagctggagctcgacttcgacctgtgcgaggggaccacggtggtcgtggacgagcactgcggcaaccgggggccgtccctgcgcaccaccaccgtgacgggcaagatcatccacgagtggtgctgccggagctgcaccctgccgcccctccgcttcaagggggaggacggctgctggtacggcatggagatccggcccgtcaaggagaaggaggagaacctggtgaagtccatggtgagcgccgggagcggcgaggtcgactccttcagcctcgggctgctgtgcacctccatcatgatcgaggaggtgatgcgcagccggtggtcccgcaagatgctcatgaccggcacgctggccgtgttcctgctcctgatcatggggcagctgacctggaacgacctcatccggctgtgcatcatggtcggcgccaacgcgagcgaccgcatgggcatggggaccacctacctggccctcatggccacgttcaagatgcgcccgatgttcgccgtgggcctgctgttccggcgcctcacctcccgggaggtgctgctgctcaccatcgggctgagcctggtcgcctccgtggagctccccaacagcctggaggagctgggcgacggcctcgcgatggggatcatgatcctgaagctgctcaccgacttccagtcccaccagctgtgggccacgctgctcagcctgaccttcatcaagaccaccctgtccctccactacgcctggaagacgatggccatggtcctgagcatcgtgtccctgttccccctctgcctgagcaccacctcccagaagaccacgtggctgcccgtgctcctgggcagcctggggtgcaagccgctcaccatgttcctgatcgcggagaacaagatctggggccgcaagtcctggcccctgaacgaggggatcatggccgtcggcgtggtgagcatcctcctgagctccctgctcaagaacgacgtccccctggccggccccctgatcgccgggggcatgctcatcgcctgctacgtgatcagcgggtccagcgcggacctgtccctggagaaggccgccgaggtgagctgggaggaggaggccgagcactccggcgccagccacaacatcttcgtcgaggtgcaggacgacgggaccatgaagatcaaggacgaggagcgggacgacaccctcaccatcctgctgaaggcgacgctcctggccgtgtccggcgtctacccgctgagcatccccgccaccctcttcgtgtggtacttctggcagaagaagaagcagcgctccggcgtgctgtgggacacccccagcccgcccgaggtcgagcgggccgccctggacgacgggatctaccgcatcatgcagcggggcctgctcgggcgctcccaggtgggcgtgggggtcttccaggagaacgtgttccacaccatgtggcacgtgacgcggggcgcggtcctgatgtaccagggcaagcgcctggagcccagctgggcctccgtgaagaaggacctcatcagctacgggggcgggtggcggctgcagggctcctggaacaccggggaggaggtgcaggtcatcgccgtggagcccggcaagaaccccaagaacgtgcagaccgcccccggcaccttcaagacgcccgagggggaggtcggcgccatcgcgctggacttcaagcccgggaccagcggctcccccatcgtgaaccgcgagggcaagatcgtggggctctacggcaacggggtcgtgaccaccagcggcacgtacgtgagcgccatcgcccaggccaaggcgtcccaggaggggccgctgcccgagatcgaggacgaggtcttccggaagcgcaacctgaccatcatggacctccaccccggcagcggcaagacccggcgctacctgccggccatcgtgcgggaggccatcaagcgcaagctgcggaccctcatcctggcccccacgcgcgtggtcgcctccgagatggcggaggccctgaaggggatgcccatccgctaccagaccaccgccgtcaagagcgagcacaccggcaaggagatcgtggacctcatgtgccacgccacgttcaccatgcggctgctgtcccccgtccgcgtgccgaactacaacatgatcatcatggacgaggcccacttcaccgaccccagctccatcgcggcccgggggtacatcagcacccgcgtgggcatgggggaggccgccgccatcttcatgacggcgacgccgcccggctccgtcgaggccttcccgcagagcaacgccgtgatccaggacgaggagcgggacatccccgagcgctcctggaacagcggctacgagtggatcaccgacttccccgggaagaccgtgtggttcgtcccctccatcaagagcggcaacgacatcgccaactgcctccggaagaacgggaagcgcgtgatccagctgtcccggaagacgttcgacaccgagtaccagaagaccaagaacaacgactgggactacgtggtcaccacggacatcagcgagatgggcgcgaacttccgcgccgaccgggtgatcgacccgcgccggtgcctgaagcccgtgatcctcaaggacgggcccgagcgcgtcatcctggccggccccatgccggtgaccgtcgcctccgccgcgcagcggcgcggccggatcgggcgcaaccacaacaaggagggcgaccagtacatctacatggggcagcccctgaacaacgacgaggaccacgcccactggaccgaggccaagatgctcctggacaacatcaacacccccgagggcatcatccccgccctgttcgagccggagcgggagaagtccgccgcgatcgacggggagtaccgcctccgcggcgaggcccggaagacgttcgtggagctgatgcgccggggcgacctgcccgtgtggctctcctacaaggtcgccagcgaggggttccagtacagcgaccgccggtggtgcttcgacggcgagcgcaacaaccaggtgctggaggagaacatggacgtggagatctggaccaaggagggggagcggaagaagctgcgcccccggtggctcgacgcccgcacctactccgaccccctggccctgcgggagttcaaggagttcgcggccggccgccggagcgtctccggcgacctcatcctggagatcgggaagctgccgcagcacctcacccagcgcgcccagaacgccctggacaacctggtgatgctccacaacagcgagcagggcgggcgggcgtaccgccacgccatggaggagctgcccgacacgatcgagaccctgatgctcctggccctgatcgccgtgctcaccggcggggtcaccctgttcttcctgtccggccggggcctcgggaagaccagcatcggcctgctgtgcgtgatggcctccagcgtgctcctgtggatggcgtccgtcgagccccactggatcgccgccagcatcatcctggagttcttcctcatggtgctgctgatccccgagccggaccgccagcggacgccccaggacaaccagctcgcctacgtggtcatcgggctgctgttcatcatcctcaccgtggccgcgaacgagatgggcctgctggagaccaccaagaaggacctcgggatcggccacgtggccgtcgagaaccaccaccacgccacgatgctggacgtggacctgcaccccgcctccgcctggaccctctacgcggtggccaccaccatcatcacgccgatgatgcgccacaccatcgagaacaccaccgccaacatcagcctgacggccatcgccaaccaggcggccatcctgatgggcctcgacaaggggtggcccatctccaagatggacatcggcgtccccctgctggccctcgggtgctacagccaggtgaaccccctgaccctgaccgccgcggtgctcatgctggtcgcccactacgccatcatcggcccggggctgcaggccaaggccacccgggaggcgcagaagcgcacggccgccggcatcatgaagaaccccaccgtggacggcatcgtggccatcgacctcgaccccgtcgtgtacgacgccaagttcgagaagcagctggggcagatcatgctgctcatcctgtgcacctcccagatcctgctcatgcgcaccacgtgggcgctgtgcgagagcatcaccctggccaccggccccctcaccacgctgtgggaggggtccccgggcaagttctggaacaccaccatcgccgtgagcatggccaacatcttccggggctcctacctggccggggcgggcctcgccttcagcctgatgaagtccctcgggggcgggcgccgggggaccggcgcccagggggagacgctcggcgagaagtggaagcgccagctgaaccagctgtccaagagcgagttcaacatctacaagcggtccgggatcatggaggtcgaccgcagcgaggccaaggagggcctcaagcgcggggagaccacccgccacgcggtgtcccggggcaccgccaagctgcgctggttcgtggagcggaacctggtcaagcccgagggcaaggtgatcgacctggggtgcggccgcgggggctggagctactactgcgccgggctcaagaaggtgacggaggtcaagggctacaccaagggcgggcccggccacgaggagcccatcccgatggccacctacgggtggaacctggtgaagctgcactccggcaaggacgtgttcttcacgccgcccgagaagtgcgacacgctcctgtgcgacatcggggagagctcccccaacccgaccatcgaggagggccggaccctgcgcgtcctcaagatggtggagccctggctgcggggcaaccagttctgcatcaagatcctgaacccctacatgcccagcgtggtcgagaccctcgagcagatgcagcgcaagcacgggggcatgctggtgcggaacccgctgtcccgcaacagcacccacgagatgtactgggtgtcctgcgggacgggcaacatcgtcagcgccgtgaacatgacctcccggatgctcctgaaccgcttcaccatggcgcaccgcaagcccacctacgagcgggacgtggacctgggcgccgggacgcgccacgtcgccgtggagcccgaggtggccaacctcgacatcatcggccagcggatcgagaacatcaagcacgagcacaagagcacctggcactacgacgaggacaacccctacaagacctgggcctaccacgggtcctacgaggtcaagccgagcggctccgcgagcagcatggtgaacggggtcgtgaagctgctgaccaagccctgggacgtgatccccatggtcacgcagatcgccatgaccgacaccacccccttcggccagcagcgcgtgttcaaggagaaggtggacacgcggaccccgaaggccaagcgcggcaccgcccagatcatggaggtcaccgcccggtggctctgggggttcctgtcccgcaacaagaagccccggatctgcacgcgcgaggagttcacccggaaggtgcgcagcaacgcggccatcggcgccgtgttcgtcgacgagaaccagtggaactccgccaaggaggcggtggaggacgagcggttctgggacctggtgcagaaggagcgcgagctccacaagcaggggaagtgcgcgacctgcgtctacaacatgatgggcaagcgggagaagaagctgggggagttcggcaaggccaagggcagccgcgccatctggtacatgtggctgggggcccggttcctcgagttcgaggcgctgggcttcatgaacgaggaccactggttctcccgcgagaacagcctgtccggggtggagggcgaggggctccacaagctgggctacatcctgcgggacatcagcaagatccccggcgggaacatgtacgccgacgacaccgccggctgggacacgcgcatcaccgaggacgacctccagaacgaggccaagatcaccgacatcatggagccggagcacgccctgctggcgacctccatcttcaagctcacgtaccagaacaaggtggtccgggtgcagcgccccgccaagaacgggaccgtgatggacgtcatcagccgccgggaccagcgcggctccggccaggtggggacctacggcctgaacaccttcacgaacatggaggcccagctgatccggcagatggagagcgaggggatcttcctcccctccgagctggagacccccaacctggccgagcgcgtgctcgactggctggagaagtacggcgtcgagcggctgaagcgcatggccatcagcggggacgactgcgtggtgaagccgatcgacgaccggttcgcgaccgccctcaccgccctgaacgacatgggcaaggtccgcaaggacatcccccagtgggagccctccaagggctggaacgactggcagcaggtccccttctgcagccaccacttccaccagctgatcatgaaggacgggcgggagatcgtggtcccgtgccgcaaccaggacgagctcgtgggccgggcccgcgtgtcccagggggccggctggagcctgcgggagacggcgtgcctgggcaagagctacgcccagatgtggcagctcatgtacttccaccgccgggacctgcgcctggccgccaacgcgatctgctccgccgtccccgtggactgggtgcccaccagccggaccacctggtccatccacgcccaccaccagtggatgacgaccgaggacatgctcagcgtctggaaccgcgtgtggatcgaggagaacccctggatggaggacaagacccacgtgtccagctggggcgacgtcccgtacctgggcaagcgggaggaccagtggtgcgggtccctgatcggcctcaccgcccgcgccacctgggcgagcaacatccaggtggccatcaaccaggtgcgccggctgatcgggaacgagaactacctggactacatgacgtccatgaagcgcttcaagaacgagggcgaccccgagggggccctctggtga

SEQ ID NO: 8551 - RNA, 9879 nt, synthetic construct
  misc_feature 1..9879: note = derived and/or modified CDS sequence (opt1) from DENV-1__GQ199834__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgcgggggtgaacatgtgcaccctcatcgccatggacctgggcgagctgtgcgaggacaccatgacctacaagtgcccccgcatcaccgaggccgagcccgacgacgtggactgctggtgcaacgccaccgacacctgggtcacctacgggacctgcagccagacgggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggagctggcggagacgcagcacggcaccgtcctggtgcagatcaagtacgagggcaccgacgccccctgcaagatccccttcagcacccaggacgagaagggggtgacgcagaacggccggctgatcaccgccaacccgatcgtcaccgacaaggagaagcccgtgaacatcgaggccgagccgcccttcggggagtcctacatcgtgatcggcgcgggcgagaaggccctcaagctgagctggttcaagaaggggtccagcatcggcaagatgttcgaggccaccgcccgcggggcccggcgcatggcgatcctgggcgacacggcctgggacttcgggtccatcggcggcgtcttcaccagcgtggggaagctcgtgcaccagatcttcggcaccgcctacggggtcctgttctccggcgtgagctggaccatgaagatcgggatcggcgtgctgctcacgtggctgggcctgaactcccgcagcacctccctcagcatgacctgcatcgccgtcgggctggtgaccctgtacctcggcgtgatggtccaggccgactccgggtgcgtgatcaactggaagggccgggagctgaagtgcgggagcggcatcttcgtgacgaacgaggtccacacctggaccgagcagtacaagttccaggcggacagcccgaagcgcctgtccgccgccatcggcaaggcctgggaggagggggtgtgcggcatccggagcgccacccgcctcgagaacatcatgtggaagcagatctccaacgagctgaaccacatcctgctcgagaacgggatgaagttcaccgtggtcgtgggcgacgtggacgggatcctggcgcagggcaagaagatgatccggccccagcccatggagcacaagtacagctggaagtcctggggcaaggccaagatcatcggggccgacgtccagaacacgaccttcatcatcgacggccccaacaccccggagtgccccgacgaccagcgcgcctggaacatctgggaggtggaggactacgggttcggcatcttcaccacgaacatctggctgaagctccgggacagctacacccaggtgtgcgaccaccgcctgatgtccgcggccatcaaggacagcaaggccgtccacgccgacatgggctactggatcgagtccgagaagaacgagacctggaagctggcccgggcgagcttcatcgaggtgaagacctgcatctggcccaagtcccacacgctctggagcaacggggtgctggagtccgagatgatcatccccaagatctacggcgggccgatcagccagcacaactaccgccccggctacttcacccagaccgccgggccctggcacctgggcaagctcgagctggacttcgacctgtgcgagggcaccacggtcgtggtggacgagcactgcgggaaccggggcccgtccctccgcaccaccaccgtcacggggaagatcatccacgagtggtgctgccggagctgcaccctgccgcccctgcgcttcaagggcgaggacgggtgctggtacggcatggagatccggcccgtgaaggagaaggaggagaacctcgtgaagtccatggtcagcgccggcagcggggaggtggactccttcagcctgggcctgctctgcatctccatcatgatcgaggaggtgatgcgcagccggtggtcccgcaagatgctgatgaccgggaccctggccgtcttcctcctgctgatcatgggccagctcacgtggaacgacctgatccggctgtgcatcatggtgggggccaacgcgagcgaccgcatgggcatgggcaccacctacctcgccctgatggccaccttcaagatgcgcccgatgttcgccgtggggctcctgttccggcgcctgacgtcccgggaggtcctgctcctgaccatcgggctgagcctcgtggcctccgtggagctgcccaacagcctggaggagctcggggacggcctggcgatgggcatcatgatcctgaagctcctgaccgacttccagtcccaccagctgtgggccaccctcctgagcctgacgttcatcaagaccaccctctccctgcactacgcctggaagaccatggccatggtcctgagcatcgtgtccctcttccccctgtgcctgagcacgacctcccagaagaccacctggctccccgtcctgctggggagcctcggctgcaagccgctgacgatgttcctgatcgcggagaacaagatctgggggcgcaagtcctggcccctcaacgagggcatcatggccgtgggggtggtcagcatcctgctgagctccctcctgaagaacgacgtgcccctggccggccccctcatcgccggcgggatgctgatcgcctgctacgtgatcagcggctccagcgcggacctgtccctcgagaaggccgccgaggtcagctgggaggaggaggccgagcactccggggccagccacaacatcctggtggaggtgcaggacgacggcaccatgaagatcaaggacgaggagcgggacgacaccctgaccatcctcctgaaggcgaccctgctcgccgtctccggggtgtacccgctgagcatccccgccacgctgttcgtgtggtacttctggcagaagaagaagcagcgctccggcgtcctgtgggacacccccagcccgcccgaggtggagcgggccgtgctcgacgacggcatctaccgcatcatgcagcgggggctgctgggccgctcccaggtcggggtgggcgtgttccaggagaacgtcttccacaccatgtggcacgtgacccgcggggccgtgctcatgtaccagggcaagcgcctggagcccagctgggcgtccgtcaagaaggacctgatcagctacggcgggggctggcggctccaggggtcctggaacacgggcgaggaggtccaggtgatcgccgtcgagcccgggaagaaccccaagaacgtgcagaccgcccccggcaccttcaagacccccgagggcgaggtgggggccatcgccctggacttcaagcccggcacgagcgggtcccccatcgtcaaccgcgagggcaagatcgtgggcctgtacgggaacggcgtggtcaccaccagcgggacctacgtgagcgcgatcgcccaggccaaggcctcccaggagggcccgctccccgagatcgaggacgaggtgttccggaagcgcaacctgacgatcatggacctgcaccccgggagcggcaagacccggcgctacctcccggcgatcgtccgggaggccatcaagcgcaagctgcggaccctgatcctcgcccccacccgcgtggtggcctccgagatggccgaggcgctgaagggcatgcccatccgctaccagacgaccgccgtcaagagcgagcacaccgggaaggagatcgtggacctgatgtgccacgccaccttcacgatgcggctcctgtcccccgtgcgcgtcccgaactacaacatgatcatcatggacgaggcccacttcaccgaccccagctccatcgccgcgcggggctacatcagcacccgcgtggggatgggcgaggccgccgccatcttcatgaccgccacgccgcccgggtccgtggaggcgttcccgcagagcaacgccgtcatccaggacgaggagcgggacatccccgagcgctcctggaacagcggctacgagtggatcaccgacttccccggcaagaccgtgtggttcgtgccctccatcaagagcgggaacgacatcgccaactgcctgcggaagaacggcaagcgcgtcatccagctctcccggaagaccttcgacacggagtaccagaagaccaagaacaacgactgggactacgtggtgaccaccgacatcagcgagatgggggccaacttccgcgcggaccgggtcatcgacccgcgccggtgcctgaagcccgtgatcctgaaggacggccccgagcgcgtgatcctcgccgggcccatgccggtcacggtggcctccgccgcccagcggcgcggccggatcggccgcaaccacaacaaggagggggaccagtacatctacatgggccagcccctgaacaacgacgaggaccacgcgcactggaccgaggccaagatgctgctcgacaacatcaacacccccgaggggatcatccccgccctgttcgagccggagcgggagaagtccgccgccatcgacggcgagtaccgcctgcgcggggaggcgcggaagaccttcgtcgagctcatgcgccggggcgacctgcccgtgtggctgtcctacaaggtggccagcgagggcttccagtacagcgaccgccggtggtgcttcgacggggagcgcaacaaccaggtcctcgaggagaacatggacgtggagatctggacgaaggagggcgagcggaagaagctgcgcccccggtggctggacgcccgcacctactccgaccccctcgccctgcgggagttcaaggagttcgccgcggggcgccggagcgtgtccggcgacctgatcctcgagatcggcaagctgccgcagcacctgacccagcgcgcccagaacgccctcgacaacctggtcatgctgcacaacagcgagcagggcgggcgggcctaccgccacgcgatggaggagctccccgacaccatcgagacgctgatgctgctcgccctgatcgccgtgctgaccgggggcgtgaccctcttcttcctgtccgggcggggcctgggcaagaccagcatcgggctcctgtgcgtcatggcctccagcgtgctgctctggatggcctccgtggagccccactggatcgcggccagcatcatcctggagttcttcctgatggtcctcctgatccccgagccggaccgccagcggacgccccaggacaaccagctggcctacgtggtgatcggcctcctgttcatgatcctgacggtcgccgccaacgagatggggctcctggagaccaccaagaaggacctgggcatcgggcacgtggcggtggagaaccaccaccacgccaccatgctcgacgtcgacctgcaccccgcctccgcctggacgctgtacgccgtggcgaccaccatcatcaccccgatgatgcgccacacgatcgagaacaccaccgccaacatcagcctcaccgccatcgccaaccaggccgcgatcctgatgggcctggacaagggctggcccatctccaagatggacatcggggtgcccctcctggccctgggctgctacagccaggtcaaccccctcacgctgaccgccgccgtgctgatgctcgtggcgcactacgccatcatcgggccgggcctgcaggccaaggccacccgggaggcccagaagcgcaccgcggccgggatcatgaagaaccccacggtcgacggcatcgtggccatcgacctggaccccgtggtctacgacgccaagttcgagaagcagctcggccagatcatgctgctgatcctctgcacctcccagatcctgctgatgcgcaccacctgggccctctgcgagagcatcacgctggcgaccgggcccctgaccaccctctgggagggctccccggggaagttctggaacacgaccatcgccgtgagcatggccaacatcttccggggctcctacctggccggcgccgggctggcgttcagcctcatgaagtccctgggcgggggccgccgggggaccggcgcccagggcgagaccctgggggagaagtggaagcgccagctcaaccagctgtccaagagcgagttcaacatctacaagcggtccggcatcatggaggtggaccgcagcgaggccaaggaggggctgaagcggggcgagacgacccgccacgccgtctcccgggggaccgcgaagctgcgctggttcgtggagcggaacctcgtgaagcccgagggcaaggtcatcgacctgggctgcgggcgcggcgggtggagctactactgcgccggcctgaagaaggtgaccgaggtgaaggggtacacgaagggcggccccgggcacgaggagcccatcccgatggccacctacggctggaacctcgtcaagctgcactccgggaaggacgtgttcttcacgccgcccgagaagtgcgacaccctgctctgcgacatcggcgagagctcccccaacccgacgatcgaggaggggcggaccctgcgcgtgctgaagatggtcgagccctggctccggggcaaccagttctgcatcaagatcctgaacccctacatgcccagcgtggtggagaccctggagcagatgcagcgcaagcacggcgggatgctcgtccggaacccgctgtcccgcaacagcacccacgagatgtactgggtgtcctgcggcaccgggaacatcgtgagcgccgtcaacatgacgtcccggatgctgctcaaccgcttcaccatggcccaccgcaagcccacctacgagcgggacgtggacctgggcgcgggcacccgccacgtggccgtcgagcccgaggtggccaacctggacatcatcgggcagcggatcgagaacatcaagcacgagcacaagagcacgtggcactacgacgaggacaacccctacaagacctgggcctaccacggctcctacgaggtgaagccgagcgggtccgccagcagcatggtcaacggcgtggtcaagctcctgaccaagccctgggacgtgatccccatggtgacccagatcgcgatgacggacaccacccccttcgggcagcagcgcgtcttcaaggagaaggtggacacccggacgccgaaggccaagcgcggcaccgcccagatcatggaggtgaccgcccggtggctgtggggcttcctctcccgcaacaagaagccccggatctgcacccgcgaggagttcacgcggaaggtccgcagcaacgccgcgatcggggccgtgttcgtggacgagaaccagtggaactccgccaaggaggccgtcgaggacgagcggttctgggacctggtgcagaaggagcgcgagctgcacaagcagggcaagtgcgcgacctgcgtgtacaacatgatggggaagcgggagaagaagctcggcgagttcgggaaggccaagggcagccgcgccatctggtacatgtggctgggcgcccggttcctggagttcgaggccctcgggttcatgaacgaggaccactggttctcccgcgagaacagcctgtccggcgtcgagggggagggcctgcacaagctcgggtacatcctgcgggacatcagcaagatccccggcggcaacatgtacgcggacgacaccgccgggtgggacacccgcatcacggaggacgacctgcagaacgaggccaagatcaccgacatcatggagccggagcacgccctcctggccacctccatcttcaagctgacctaccagaacaaggtggtgcgggtccagcgccccgcgaagaacggcacggtgatggacgtgatcagccgccgggaccagcgcgggtccggccaggtcggcacctacgggctcaacaccttcaccaacatggaggcccagctgatccggcagatggagagcgagggcatcttcctgccctccgagctcgagacgcccaacctggccgagcgcgtgctggactggctcgagaagtacggggtggagcggctgaagcgcatggccatcagcggcgacgactgcgtcgtgaagccgatcgacgaccggttcgccaccgcgctgaccgccctcaacgacatggggaaggtgcgcaaggacatcccccagtgggagccctccaagggctggaacgactggcagcaggtccccttctgcagccaccacttccaccagctgatcatgaaggacggccgggagatcgtggtgccgtgccgcaaccaggacgagctggtcgggcgggcccgcgtgtcccagggcgccgggtggagcctccgggagaccgcctgcctgggcaagagctacgcgcagatgtggcagctgatgtacttccaccgccgggacctccgcctggccgccaacgccatctgctccgcggtgcccgtcgactgggtgcccacgagccggaccacctggtccatccacgcccaccaccagtggatgaccacggaggacatgctgagcgtgtggaaccgcgtctggatcgaggagaacccctggatggaggacaagacccacgtgtccagctggggcgacgtgccgtacctcggcaagcgggaggaccagtggtgcggctccctgatcgggctgaccgcccgcgccacctgggccagcaacatccaggtcgcgatcaaccaggtgcgccggctcatcggcaacgagaactacctggactacatgacctccatgaagcgcttcaagaacgagggggaccccgagggcgccctgtggtga

SEQ ID NO: 8552 - RNA, 9879 nt, synthetic construct
  misc_feature 1..9879: note = derived and/or modified CDS sequence (opt1) from DENV-1__GQ199835__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgccggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtgacctacgggacctgcagccagacgggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtggggaagctggtccaccagatcttcggcaccgcctacggggtgctgttctccggcgtgagctggaccatgaagatcgggatcggcgtcctgctgacgtggctcggcctgaactcccgcagcacctccctgagcatgacctgcatcgccgtggggctcgtgaccctgtacctgggcgtcatggtgcaggccgactccgggtgcgtgatcaactggaagggccgggagctcaagtgcgggagcggcatcttcgtcacgaacgaggtgcacacctggaccgagcagtacaagttccaggcggacagcccgaagcgcctgtccgccgccatcggcaaggcctgggaggagggggtgtgcggcatccggagcgccacccgcctggagaacatcatgtggaagcagatctccaacgagctcaaccacatcctgctggagaacgacatgaagttcaccgtcgtggtgggggacgtcgtgggcatcctcgcgcaggggaagaagatgatccggccccagcccatggagcacaagtacagctggaagtcctggggcaaggccaagatcatcggcgccgacgtgcagaacacgaccttcatcatcgacgggcccaacaccccggagtgccccgacgaccagcgcgcctggaacatctgggaggtcgaggactacggcttcgggatcttcaccacgaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacctgcatctggcccaagtcccacacgctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcaccacggtggtcgtggacgagcactgcggcaaccgggggccgtccctgcgcaccaccaccgtgacgggcaagatcatccacgagtggtgctgccggagctgcaccctgccgcccctccgcttcaagggggaggacggctgctggtacgggatggagatccggcccgtcaaggagaaggaggagaacctggtgaagtccatggtgagcgccggcagcggcgaggtcgactccttcagcctcgggctgctgtgcatctccatcatgatcgaggaggtgatgcgcagccggtggtcccgcaagatgctcatgaccggcaccctggccgtgttcctgctcctgatcatggggcagctgacgtggaacgacctcatccggctgtgcatcatggtcggcgccaacgcgagcgaccgcatggggatgggcaccacctacctgaccctcatggccacgttcaagatgcgcccgatgttcgccgtggggctgctgctccggcgcctgacctcccgggaggtgctgctcctgaccatcgggctgagcctcgtcgcctccgtggagctgcccaacagcctggaggagctcggcgacgggctggccatgggcatcatgatcctgaagctcctgaccgacttccagtcccaccagctgtgggcgacgctcctgagcctgaccttcatcaagaccaccctctccctgcactacgcctggaagacgatggccatggtcctgagcatcgtgtccctcttccccctgtgcctgagcaccacctcccagaagaccacgtggctccccgtgctgctgggcagcctcgggtgcaagccgctgaccatgttcctgatcgccgagaacaagatctggggccgcaagtcctggcccctcaacgaggggatcatggcggtcggcgtggtgagcatcctgctgagctccctcctgaagaacgacgtccccctggccgggcccctcatcgccggcggcatgctgatcgcctgctacgtgatcagcgggtccagcgccgacctgtccctcgagaaggcggccgaggtgagctgggaggaggaggccgagcactccggcgccagccacaacatcctggtcgaggtgcaggacgacgggaccatgaagatcaaggacgaggagcgggacgacaccctgaccatcctcctgaaggccacgctgctcgcggtgtccggcgtctacccgctgagcatccccgccaccctgttcgtgtggtacttctggcagaagaagaagcagcgctccggggtgctgtgggacacccccagcccgcccgaggtcgagcgggccgtgctcgacgacggcatctaccgcatcatgcagcggggcctgctggggcgctcccaggtgggcgtcggggtgttccaggagaacgtgttccacaccatgtggcacgtcacgcggggcgccgtgctcatgtaccaggggaagcgcctggagcccagctgggcctccgtgaagaaggacctgatcagctacggcggcgggtggcggctccagggctcctggaacaccggggaggaggtccaggtgatcgcggtggagcccggcaagaaccccaagaacgtccagaccgcccccgggaccttcaagacgcccgagggcgaggtgggcgccatcgccctggacttcaagcccgggaccagcggctcccccatcgtgaaccgcgaggggaagatcgtcggcctgtacggcaacggggtggtgaccaccagcggcacgtacgtcagcgccatcgcgcaggccaaggcctcccaggaggggccgctccccgagatcgaggacgaggtgttccggaagcgcaacctgaccatcatggacctgcaccccggcagcgggaagacccggcgctacctcccggccatcgtgcgggaggcgatcaagcgcaagctgcggaccctgatcctcgcccccacgcgcgtcgtggcctccgagatggccgaggccctgaagggcatgcccatccgctaccagaccaccgcggtcaagagcgagcacaccggcaaggagatcgtcgacctgatgtgccacgccacgttcaccatgcggctcctgtcccccgtgcgcgtgccgaactacaacatgatcatcatggacgaggcccacttcaccgaccccagctccatcgccgcccgggggtacatcagcacccgcgtcggcatgggggaggcggccgccatcttcatgacggccacgccgcccggctccgtggaggccttcccgcagagcaacgcggtgatccaggacgaggagcgggacatccccgagcgctcctggaacagcgggtacgagtggatcaccgacttccccggcaagaccgtctggttcgtgccctccatcaagagcggcaacgacatcgccaactgcctgcggaagaacgggaagcgcgtgatccagctctcccggaagacgttcgacaccgagtaccagaagaccaagaacaacgactgggactacgtcgtgaccacggacatcagcgagatgggcgccaacttccgcgccgaccgggtgatcgacccgcgccggtgcctgaagcccgtcatcctgaaggacgggcccgagcgcgtgatcctcgcgggccccatgccggtcaccgtggcctccgccgcccagcggcgcgggcggatcggccgcaaccacaacaaggagggcgaccagtacatctacatggggcagcccctgaacaacgacgaggaccacgcccactggaccgaggcgaagatgctgctcgacaacatcaacacccccgagggcatcatccccgccctgttcgagccggagcgggagaagtccgccgccatcgacggggagtaccgcctgcgcggcgaggcccggaagacgttcgtggagctcatgcgccgcggggacctgcccgtctggctgtcctacaaggtggcgagcgagggcttccagtacagcgaccgccggtggtgcttcgacggcgagcgcaacaaccaggtgctcgaggagaacatggacgtcgagatctggaccaaggagggggagcggaagaagctgcgcccccggtggctggacgcccgcacctactccgaccccctcgccctgcgggagttcaaggagttcgccgccggccgccggagcgtgtccggggacctgatcctcgagatcggcaagctgccgcagcacctgacccagcgcgcgcagaacgccctcgacaacctggtgatgctgcacaacagcgagcagggcgggcgggcctaccgccacgccatggaggagctccccgacacgatcgagaccctgatgctgctcgcgctgatcgccgtcctgaccggcggggtgaccctcttcttcctgtccggccgggggctgggcaagaccagcatcggcctcctgtgcgtgatggcctccagcgtcctgctctggatggcctccgtggagccccactggatcgccgcgagcatcatcctggagttcttcctgatggtgctcctgatccccgagccggaccgccagcggacgccccaggacaaccagctggcctacgtcgtgatcgggctcctgttcatgatcctgaccgtggccgccaacgagatgggcctcctggagaccaccaagaaggacctggggatcggccacgtcgccgtggagaaccaccaccacgcgacgatgctcgacgtggacctgcaccccgcctccgcctggaccctgtacgccgtcgccaccaccatcatcacgccgatgatgcgccacaccatcgagaacaccaccgcgaacatcagcctcacggccatcgccaaccaggccgccatcctgatggggctggacaagggctggcccatctccaagatggacatcggcgtgcccctcctggcgctggggtgctacagccaggtgaaccccctcaccctgaccgccgccgtcctgatgctcgtggcccactacgcgatcatcggcccggggctgcaggccaaggccacccgggaggcccagaagcgcacggccgcgggcatcatgaagaaccccaccgtggacgggatcgtcgccatcgacctggaccccgtggtgtacgacgccaagttcgagaagcagctcggccagatcatgctgctgatcctctgcacctcccagatcctgctgatgcgcaccacgtgggccctctgcgagagcatcaccctggccaccggccccctgaccacgctctgggaggggtccccgggcaagttctggaacaccaccatcgcggtcagcatggccaacatcttccgggggtcctacctggccggcgccggcctggccttcagcctcatgaagtccctcgggggcgggcgccgggggaccggggcgcagggcgagacgctgggcgagaagtggaagcgccagctcaaccagctgtccaagagcgagttcaacatctacaagcggtccgggatcatggaggtggaccgcagcgaggccaaggagggcctgaagcgcggggagaccacccgccacgccgtgtcccggggcaccgccaagctgcgctggttcgtcgagcggaacctcgtgaagcccgaggggaaggtgatcgacctgggctgcggccgcgggggctggagctactactgcgcggggctgaagaaggtcacggaggtgaagggctacaccaagggcgggcccggccacgaggagcccatcccgatggccacctacgggtggaacctcgtgaagctgcactccggcaaggacgtcttcttcacgccgcccgagaagtgcgacacgctgctctgcgacatcggggagagctcccccaacccgaccatcgaggagggccggaccctgcgcgtgctgaagatggtggagccctggctccgggggaaccagttctgcatcaagatcctgaacccctacatgcccagcgtcgtggagaccctggagcagatgcagcgcaagcacggcggcatgctcgtgcggaacccgctgtcccgcaacagcacccacgagatgtactgggtctcctgcgggacgggcaacatcgtgagcgccgtgaacatgacctcccggatgctgctcaaccgcttcaccatggcccaccgcaagcccacctacgagcgggacgtcgacctgggggccggcacgcgccacgtggcggtggagcccgaggtcgccaacctggacatcatcggccagcggatcgagaacatcaagcacgagcacaagagcacctggcactacgacgaggacaacccctacaagacctgggcctaccacgggtcctacgaggtgaagccgagcggctccgccagcagcatggtcaacggggtggtgaagctcctgaccaagccctgggacgtcatccccatggtgacgcagatcgccatgaccgacaccacccccttcggccagcagcgcgtgttcaaggagaaggtcgacacgcggaccccgaaggcgaagcgcgggaccgcccagatcatggaggtgaccgcccggtggctgtggggcttcctctcccgcaacaagaagccccggatctgcacgcgcgaggagttcacccggaaggtgcgcagcaacgccgccatcggcgcggtcttcgtggacgagaaccagtggaactccgccaaggaggccgtggaggacgagcggttctgggacctggtccagaaggagcgcgagctgcacaagcaggggaagtgcgcgacctgcgtgtacaacatgatgggcaagcgggagaagaagctcggggagttcggcaaggcgaaggggagccgcgccatctggtacatgtggctgggcgcccggttcctggagttcgaggccctcggcttcatgaacgaggaccactggttctcccgcgagaacagcctgtccggggtggagggcgaggggctgcacaagctcggctacatcctgcgggacatcagcaagatccccgggggcaacatgtacgccgacgacaccgcgggctgggacacgcgcatcaccgaggacgacctgcagaacgaggccaagatcaccgacatcatggagccggagcacgccctcctggccacctccatcttcaagctgacgtaccagaacaaggtcgtgcgggtgcagcgccccgccaagaacgggaccgtcatggacgtgatcagccgccgggaccagcgcggctccggccaggtgggcacctacggcctcaacaccttcacgaacatggaggcgcagctgatccggcagatggagagcgaggggatcttcctgccctccgagctcgagacccccaacctggccgagcgcgtcctggactggctcgagaagtacggcgtggagcggctgaagcgcatggccatcagcggggacgactgcgtggtcaagccgatcgacgaccggttcgccaccgccctgaccgcgctcaacgacatgggcaaggtgcgcaaggacatcccccagtgggagccctccaaggggtggaacgactggcagcaggtccccttctgcagccaccacttccaccagctgatcatgaaggacggccgggagatcgtcgtgccgtgccgcaaccaggacgagctggtgggccgggcccgcgtctcccagggggccggctggagcctccgggagacggcctgcctgggcaagagctacgcccagatgtggcagctgatgtacttccaccgccgggacctccgcctggcggccaacgccatctgctccgccgtgcccgtggactgggtccccaccagccggaccacctggtccatccacgcgcaccaccagtggatgacgaccgaggacatgctgagcgtgtggaaccgcgtgtggatcgaggagaacccctggatggaggacaagacccacgtctccagctggggcgacgtgccgtacctcgggaagcgggaggaccagtggtgcggctccctgatcggcctgaccgcccgcgccacctgggccagcaacatccaggtggccatcaaccaggtccgccggctcatcgggaacgagaactacctggactacatgacgtccatgaagcgcttcaagaacgagggcgaccccgagggggcgctgtggtga

SEQ ID NO: 8553 - RNA, 9879 nt, synthetic construct
  misc_feature 1..9879: note = derived and/or modified CDS sequence (opt1) from DENV-1__FJ898386__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgcgggggtgaacatgtgcaccctcatcgccatggacctgggggagctgtgcgaggacaccatgacctacaagtgcccccggatcaccgaggccgagcccgacgacgtggactgctggtgcaacgccaccgacacctgggtgacctacgggacctgcagccagacgggggagcaccggcgcgacaagcggagcgtggccctcgcgccccacgtgggcctggggctggagacccgcaccgagacctggatgtccagcgagggcgcctggaagcagatccagcgggtggagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtggggaagctggtccaccagatcttcggcaccgcctacggggtcctgttctccggcgtgagctggaccatgaagatcgggatcggcgtcctgctgacgtggctcggcctgaactcccgcagcacctccctgagcatgacctgcatcgccgtggggctcgtgaccctgtacctgggcgtcatggtgcaggccgactccgggtgcgtgatcaactggaagggccgggagctcaagtgcgggagcggcatcttcgtcacgaacgaggtgcacacctggaccgagcagtacaagttccaggcggacagcccgaagcgcctgtccgccgccatcggcaaggcctgggaggagggggtgtgcggcatccggagcgccacccgcctggagaacatcatgtggaagcagatctccaacgagctcaaccacatcctgctggagaacgacatgaagttcaccgtcgtggtgggggacgtcgtgggcatcctcgcgcaggggaagaagatgatccggccccagcccatggagcacaagtacagctggaagtcctggggcaaggccaagatcatcggcgccgacgtgcagaacacgaccttcatcatcgacgggcccaacaccccggagtgccccgacgaccagcgcgcctggaacatctgggaggtcgaggactacggcttcgggatcttcaccacgaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacctgcatctggcccaagtcccacacgctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcaccacggtggtcgtggacgagcactgcggcaaccgggggccgtccctgcgcaccaccaccgtgacgggcaagatcatccacgagtggtgctgccggagctgcaccctgccgcccctccgcttcaagggggaggacggctgctggtacgggatggagatccggcccgtcaaggagaaggaggagaacctggtgaagtccatggtgagcgccggcagcggcgaggtcgactccttcagcctcgggctgctgtgcatctccatcatgatcgaggaggtgatgcgcagccggtggtcccgcaagatgctcatgaccggcaccctggccgtgttcctgctcctgatcatggggcagctgacgtggaacgacctcatccggctgtgcatcatggtcggcgccaacgcgagcgaccgcatggggatgggcaccacctacctggccctcatggccaccttcaagatgcgcccgatgttcgccgtgggcctgctgttccggcgcctcacgtcccgggaggtgctgctgctcaccatcgggctgagcctggtcgcctccgtggagctccccaacagcctggaggagctgggcgacgggctcgcgatgggcatcatgatcctgaagctgctcaccgacttccagtcccaccagctgtgggccaccctgctcagcctgacgttcatcaagaccaccctgtccctccactacgcctggaagaccatggccatggtcctgagcatcgtgtccctgttccccctctgcctgagcacgacctcccagaagaccacctggctgcccgtgctcctgggcagcctggggtgcaagccgctcacgatgttcctgatcgcggagaacaagatctggggccgcaagtcctggcccctgaacgaggggatcatggccgtcggcgtggtgagcatcctcctgagctccctgctcaagaacgacgtccccctggccgggcccctgatcgccggcggcatgctcatcgcctgctacgtgatcagcgggtccagcgcggacctgtccctggagaaggccgccgaggtgagctgggaggaggaggccgagcactccggcgccagccacaacatcctcgtcgaggtgcaggacgacgggaccatgaagatcaaggacgaggagcgggacgacaccctgaccatcctgctcaaggcgaccctgctggccgtgtccggcgtctacccgctcagcatccccgccacgctgttcgtgtggtacttctggcagaagaagaagcagcgctccggggtgctgtgggacacccccagcccgcccgaggtcgagcgggccgtgctggacgacggcatctaccgcatcatgcagcggggcctcctggggcgctcccaggtgggcgtcggggtgttccaggagaacgtgttccacaccatgtggcacgtcacccggggcgccgtgctgatgtaccaggggaagcgcctcgagcccagctgggcgtccgtgaagaaggacctgatcagctacggcggcgggtggcggctgcagggctcctggaacacgggggaggaggtccaggtgatcgccgtggagcccggcaagaaccccaagaacgtccagaccgcccccgggaccttcaagacccccgagggcgaggtgggcgccatcgccctcgacttcaagcccgggacgagcggctcccccatcgtgaaccgcgaggggaagatcgtcggcctgtacggcaacggggtggtgaccaccagcggcacctacgtcagcgcgatcgcccaggccaaggcctcccaggaggggccgctgcccgagatcgaggacgaggtgttccggaagcgcaacctcacgatcatggacctgcaccccggcagcgggaagacccggcgctacctgccggcgatcgtgcgggaggccatcaagcgcaagctccggaccctgatcctggcccccacccgcgtcgtggcctccgagatggccgaggcgctcaagggcatgcccatccgctaccagacgaccgccgtcaagagcgagcacaccggcaaggagatcgtcgacctgatgtgccacgccaccttcacgatgcggctgctctcccccgtgcgcgtgccgaactacaacatgatcatcatggacgaggcccacttcaccgaccccagctccatcgccgcgcgggggtacatcagcacccgcgtcggcatgggggaggccgccgccatcttcatgaccgccacgccgcccggctccgtggaggcgttcccgcagagcaacgccgtgatccaggacgaggagcgggacatccccgagcgctcctggaacagcgggtacgagtggatcaccgacttccccggcaagaccgtctggttcgtgccctccatcaagagcggcaacgacatcgccaactgcctgcggaagaacgggaagcgcgtgatccagctgtcccggaagaccttcgacacggagtaccagaagaccaagaacaacgactgggactacgtcgtgaccaccgacatcagcgagatgggcgccaacttccgcgcggaccgggtgatcgacccgcgccggtgcctcaagcccgtcatcctgaaggacgggcccgagcgcgtgatcctggccggccccatgccggtcacggtggcctccgccgcccagcggcgcgggcggatcggccgcaaccacaacaaggagggcgaccagtacatctacatggggcagcccctcaacaacgacgaggaccacgcgcactggaccgaggccaagatgctgctggacaacatcaacacccccgagggcatcatccccgccctcttcgagccggagcgggagaagtccgccgccatcgacggggagtaccgcctgcgcggcgaggcgcggaagaccttcgtggagctgatgcgccgcggggacctccccgtctggctgtcctacaaggtggccagcgagggcttccagtacagcgaccgccggtggtgcttcgacggcgagcgcaacaaccaggtgctggaggagaacatggacgtcgagatctggacgaaggagggggagcggaagaagctccgcccccggtggctggacgcccgcacctactccgaccccctggccctccgggagttcaaggagttcgccgcgggccgccggagcgtgtccggggacctgatcctggagatcggcaagctcccgcagcacctgacccagcgcgcccagaacgccctggacaacctcgtgatgctgcacaacagcgagcagggcgggcgggcctaccgccacgcgatggaggagctgcccgacaccatcgagacgctcatgctgctggccctcatcgccgtcctgaccggcggggtgaccctgttcttcctctccggccgggggctgggcaagaccagcatcggcctgctctgcgtgatggcctccagcgtcctgctgtggatggcctccgtggagccccactggatcgcggccagcatcatcctcgagttcttcctgatggtgctgctcatccccgagccggaccgccagcggacgccccaggacaaccagctggcctacgtcgtgatcgggctcctcttcatgatcctgacggtggccgccaacgagatgggcctgctcgagaccaccaagaaggacctggggatcggccacgtcgcggtggagaaccaccaccacgccaccatgctggacgtggacctccaccccgcctccgcctggacgctgtacgccgtcgcgaccaccatcatcaccccgatgatgcgccacacgatcgagaacaccaccgccaacatcagcctgaccgccatcgccaaccaggccgcgatcctcatggggctggacaagggctggcccatctccaagatggacatcggcgtgcccctgctcgccctggggtgctacagccaggtgaaccccctgacgctcaccgccgccgtcctgatgctggtggcgcactacgccatcatcggcccggggctccaggccaaggccacccgggaggcccagaagcgcaccgcggccggcatcatgaagaaccccacggtggacgggatcgtcgccatcgacctggaccccgtggtgtacgacgccaagttcgagaagcagctgggccagatcatgctcctgatcctgtgcacctcccagatcctcctgatgcgcaccacctgggccctgtgcgagagcatcacgctcgcgaccggccccctgaccaccctgtgggaggggtccccgggcaagttctggaacacgaccatcgccgtcagcatggccaacatcttccgggggtcctacctcgccggcgccggcctggcgttcagcctgatgaagtccctcgggggcgggcgccggggcaccggggcccagggcgagaccctgggcgagaagtggaagcgccagctgaaccagctctccaagagcgagttcaacatctacaagcggtccgggatcatggaggtggaccgcagcgaggccaaggagggcctgaagcgcggggagacgacccgccacgccgtgtcccggggcaccgcgaagctgcgctggttcgtcgagcggaacctggtgaagcccgaggggaaggtgatcgacctcggctgcggccgcgggggctggagctactactgcgccgggctgaagaaggtcaccgaggtgaagggctacacgaagggcgggcccggccacgaggagcccatcccgatggccacctacgggtggaacctggtgaagctccactccggcaaggacgtcttcttcacgccgcccgagaagtgcgacaccctgctgtgcgacatcggggagagctcccccaacccgacgatcgaggagggccggaccctccgcgtgctgaagatggtggagccctggctgcgggggaaccagttctgcatcaagatcctcaacccctacatgcccagcgtcgtggagaccctggagcagatgcagcgcaagcacggcggcatgctggtgcggaacccgctctcccgcaacagcacccacgagatgtactgggtctcctgcgggaccggcaacatcgtgagcgccgtgaacatgacgtcccggatgctgctgaaccgcttcaccatggcccaccgcaagcccacctacgagcgggacgtcgacctcggggcgggcacccgccacgtggccgtggagcccgaggtcgccaacctggacatcatcggccagcggatcgagaacatcaagcacgagcacaagagcacgtggcactacgacgaggacaacccctacaagacctgggcctaccacgggtcctacgaggtgaagccgagcggctccgccagcagcatggtcaacggggtggtgaagctgctcaccaagccctgggacgtcatccccatggtgacccagatcgcgatgacggacaccacccccttcggccagcagcgcgtgttcaaggagaaggtcgacacccggacgccgaaggccaagcgcgggaccgcccagatcatggaggtgaccgcccggtggctgtggggcttcctgtcccgcaacaagaagccccggatctgcacccgcgaggagttcacgcggaaggtgcgcagcaacgccgcgatcggcgccgtcttcgtggacgagaaccagtggaactccgccaaggaggccgtggaggacgagcggttctgggacctcgtccagaaggagcgcgagctgcacaagcaggggaagtgcgcgacctgcgtgtacaacatgatgggcaagcgggagaagaagctgggggagttcggcaaggccaaggggagccgcgccatctggtacatgtggctcggcgcccggttcctggagttcgaggccctgggcttcatgaacgaggaccactggttctcccgcgagaacagcctctccggggtggagggcgaggggctgcacaagctgggctacatcctccgggacatcagcaagatccccgggggcaacatgtacgcggacgacaccgccggctgggacacccgcatcacggaggacgacctgcagaacgaggccaagatcaccgacatcatggagccggagcacgccctgctcgccacctccatcttcaagctgacctaccagaacaaggtcgtgcgggtgcagcgccccgcgaagaacgggacggtcatggacgtgatcagccgccgggaccagcgcggctccggccaggtgggcacctacggcctgaacaccttcaccaacatggaggcccagctcatccggcagatggagagcgaggggatcttcctgccctccgagctggagacgcccaacctcgccgagcgcgtcctggactggctggagaagtacggcgtggagcggctcaagcgcatggccatcagcggggacgactgcgtggtcaagccgatcgacgaccggttcgccaccgcgctgaccgccctgaacgacatgggcaaggtgcgcaaggacatcccccagtgggagccctccaaggggtggaacgactggcagcaggtccccttctgcagccaccacttccaccagctcatcatgaaggacggccgggagatcgtcgtgccgtgccgcaaccaggacgagctggtgggccgggcccgcgtctcccagggggccggctggagcctgcgggagaccgcctgcctcggcaagagctacgcgcagatgtggcagctgatgtacttccaccgccgggacctgcgcctcgccgccaacgccatctgctccgcggtgcccgtggactgggtccccacgagccggaccacctggtccatccacgcccaccaccagtggatgaccacggaggacatgctgagcgtgtggaaccgcgtgtggatcgaggagaacccctggatggaggacaagacccacgtctccagctgggaggacgtgccgtacctgggcaagcgggaggaccagtggtgcgggtccctcatcggcctgaccgcccgcgccacctgggccagcaacatccaggtggcgatcaaccaggtccgccggctgatcggcaacgagaactacctcgactacatgacctccatgaagcgcttcaagaacgagggggaccccgagggcgccttctggtga

SEQ ID NO: 8554 - RNA, 9879 nt, synthetic construct
  misc_feature 1..9879: note = derived and/or modified CDS sequence (opt1) from DENV-1__FJ898387__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagaccagcgccggggtgaacatgtgcaccctcatcgccatggacctgggcgagttctgcgaggacacgatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagaccgtccagtacgagaacctgaagtacagcgtgatcgtgaccgtccacacgggcgaccagcaccaggtggggaacgagtccaccgagcacggcaccaccgcgaccatcacgccccaggcccccagcaccgagatccagctgaccgactacggggccctcaccctggactgcagcccccggacgggcctggacttcaacgagatggtcctcctgaccatgaaggagaagtcctggctggtgcacaagcagtggttcctcgacctgccgctgccctggaccagcggggcctccaccagccaggagacgtggaaccggaaggacctcctggtgaccttcaagaccgcccacgcgaagaagcaggaggtcgtggtgctgggctcccaggagggcgccatgcacaccgccctcacgggggccaccgagatccagaccagcggcaccacgaccatcttcgccgggcacctgaagtgccgcctgaagatggacaagctcaccctgaagggcatgtcctacgtcatgtgcaccgggagcttcaagctggagaaggaggtggcggagacgcagcacggcaccgtgctcgtccagatcaagtacgagggcaccgacgccccctgcaagatccccttctccacccaggacgagaagggggtgacgcagaacggccggctgatcaccgccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacacggcctgggacttcgggagcatcggcggcgtgttcacctccgtcgggaagctggtgcaccagatcttcggcaccgcctacggggtgctgttcagcggcgtctcctggaccatgaagatcgggatcggcgtgctcctgacgtggctgggcctcaacagccgctccaccagcctgtccatgacctgcatcgccgtggggctggtcaccctctacctgggcgtgatggtgcaggccgacagcgggtgcgtcatcaactggaagggccgggagctgaagtgcgggagcggcatcttcgtgacgaacgaggtgcacacctggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagttcaccgtggtggtcggggacgtggcgggcatcctggcccaggggaagaagatgatccggccccagcccatggagtacaagtactcctggaagtcctggggcaaggccaagatcatcggcgccgacgtgcagaacacgaccttcatcatcgacgggcccaacaccccggagtgccccgacgaccagcgcgcgtggaacatctgggaggtcgaggactacggcttcgggatcttcaccacgaacatctggctcaagctgcgggactcctacacccaggtgtgcgaccaccgcctgatgagcgccgccatcaaggactccaaggccgtgcacgccgacatgggctactggatcgagagcgagaagaacgagacctggaagctcgcgcgggcctccttcatcgaggtcaagacctgcatctggcccaagagccacacgctgtggtccaacggcgtgctggagagcgagatgatcatccccaagatctacgggggcccgatctcccagcacaactaccgccccgggtacttcacccagaccgccggcccctggcacctcgggaagctggagctggacttcgacctctgcgagggcaccacggtggtcgtggacgagcactgcggcaaccgggggccgagcctgcgcaccaccaccgtgacgggcaagatcatccacgagtggtgctgccggtcctgcaccctgccgcccctgcgcttcaagggggaggacggctgctggtacgggatggagatccggcccgtcaaggagaaggaggagaacctggtcaagagcatggtgagcgccggctccggcgaggtcgacagcttctccctggggctcctgtgcatcagcatcatgatcgaggaggtgatgcgctcccggtggagccgcaagatgctgatgaccggcaccctcgccgtgttcttcctgctgatcatggggcagctcacgtggaacgacctgatccggctgtgcatcatggtcggcgcgaacgcctccgaccgcatggggatgggcaccacctacctcgccctgatggccaccttcaagatgcgcccgatgttcgccgtggggctcctgttccggcgcctgacgagccgggaggtgctgctcctgaccatcgggctgtccctcgtcgcgagcgtggagctgcccaactccctggaggagctcggcgacgggctggccatgggcatcatgatcctgaagctcctgaccgacttccagagccaccagctgtgggccaccctcctgtccctgacgttcatcaagaccaccttcagcctccactacgcctggaagaccatggcgatggtcctgtccatcgtgagcctgttccccctctgcctgtccacgaccagccagaagaccacctggctgcccgtgctcctgggctccctggggtgcaagccgctcacgatgttcctgatcgccgagaacaagatctggggccgcaagagctggcccctgaacgaggggatcatggccgtcggcatcgtgagcatcctcctgtccagcctgctcaagaacgacgtgcccctggccgggcccctgatcgccggcggcatgctcatcgcgtgctacgtcatctccgggagctccgccgacctgagcctggagaaggccgccgaggtgtcctgggaggaggaggccgagcacagcggcgcgtcccacaacatcctcgtggaggtccaggacgacgggaccatgaagatcaaggacgaggagcgggacgacaccctgaccatcctgctcaaggccaccctgctggccgtgagcggcgtgtacccgctctccatccccgccacgctgttcgtctggtacttctggcagaagaagaagcagcgcagcggggtgctgtgggacacccccagcccgcccgaggtggagcgggccgtcctcgacgacggcatctaccgcatcatgcagcggggcctgctggggcgcagccaggtgggcgtgggggtcttccaggagaacgtgttccacaccatgtggcacgtgacccggggcgcggtcctgatgtaccaggggaagcgcctcgagccctcctgggccagcgtgaagaaggacctgatctcctacggcggcgggtggcggctgcagggcagctggaacacgggggaggaggtgcaggtcatcgccgtggagcccggcaagaaccccaagaacgtgcagaccgcccccgggaccttcaagacctccgagggcgaggtcggcgccatcgcgctcgacttcaagcccgggacgagcggcagccccatcgtgaaccgcgaggggaagatcgtgggcctgtacggcaacggggtcgtgaccacctccggcacctacgtgagcgccatcgcccaggccaaggcgtcccaggaggggcccctgccggagatcgaggacgaggtcttccggaagcgcaacctcacgatcatggacctgcaccccggcagcgggaagacccggcgctacctgcccgccatcgtgcgggaggccatcaagcgcaagctccggaccctgatcctggccccgacccgcgtggtcgcctccgagatggcggaggccctcaagggcatgcccatccgctaccagacgaccgccgtcaagagcgagcacaccggcaaggagatcgtggacctgatgtgccacgccaccttcacgatgcggctgctctcccccgtccgcgtgcccaactacaacatgatcatcatggacgaggcccacttcaccgacccgagctccatcgcggcccgggggtacatcagcacccgcgtgggcatgggggaggccgccgccatcttcatgaccgcgacgccgcccggctccgtcgaggccttcccccagagcaacgccgtgatccaggacgaggagcgggacatcccggagcgctcctggaacagcgggtacgagtggatcaccgacttccccggcaagaccgtgtggttcgtcccctccatcaagagcggcaacgacatcgccaactgcctgcggaagaacgggaagcgcgtgatccagctgtcccggaagaccttcgacacggagtaccagaagaccaagaacaacgactgggactacgtggtcaccaccgacatcagcgagatgggcgcgaacttccgcgccgaccgggtgatcgacccccgccggtgcctcaagccggtgatcctgaaggacgggcccgagcgcgtcatcctggccggccccatgcccgtgacggtcgcctccgccgcgcagcggcgcgggcggatcggccgcaaccacaacaaggagggcgaccagtacatctacatggggcagccgctcaacaacgacgaggaccacgcccactggaccgaggccaagatgctgctggacaacatcaacacccccgagggcatcatccccgccctcttcgagcccgagcgggagaagtccgccgcgatcgacggggagtaccgcctgcgcggcgaggcccggaagaccttcgtggagctgatgcgccgcggggacctcccggtgtggctgagctacaaggtcgcctccgagggcttccagtacagcgaccgccggtggtgcttcgacggcgagcgcaacaaccaggtgctggaggagaacatggacgtggagatctggacgaaggagggggagcggaagaagctccgcccccggtggctggacgcccgcacctactccgaccccctggccctccgggagttcaaggagttcgcggccggccgccggagcgtctccggggacctgatcctggagatcggcaagctcccccagcacctgacccagcgcgcccagaacgccctggacaacctcgtgatgctgcacaacagcgagcagggcgggcgggcgtaccgccacgccatggaggagctgccggacaccatcgagacgctcatgctgctggccctcatcgccgtgctgaccggcggggtcaccctgttcttcctctccggccgggggctgggcaagaccagcatcggcctgctctgcgtgatggcctccagcgtgctgctgtggatggcgtccgtcgagccccactggatcgccgccagcatcatcctcgagttcttcctgatggtgctgctcatccccgagcccgaccgccagcggaccccgcaggacaaccagctggcctacgtggtcatcgggctcctcttcatgatcctgacggtggccgcgaacgagatgggcctgctcgagaccaccaagaaggacctggggatcggccacgtggccgtcgagaaccaccaccacgccgccatgctggacgtggacctccaccccgcctccgcgtggaccctgtacgccgtggccacgaccatcatcacccccatgatgcgccacaccatcgagaacacgaccgccaacatcagcctgaccgccatcgcgaaccaggccgccatcctcatggggctggacaagggctggccgatctccaagatggacatcggcgtccccctgctcgccctggggtgctacagccaggtgaaccccctgaccctcacggcggccgtgctgatgctggtcgcccactacgccatcatcggccccgggctccaggccaaggcgacccgggaggcccagaagcgcaccgccgccggcatcatgaagaacccgaccgtggacgggatcgtggccatcgacctggaccccgtcgtgtacgacacgaagttcgagaagcagctgggccagatcatgctcctgatcctgtgcacctcccagatcctcctgatgcgcaccacctgggcgctgtgcgagagcatcacgctcgccaccggccccctgaccaccctgtgggaggggtcccccggcaagttctggaacacgaccatcgccgtgagcatggccaacatcttccgggggagctacctcgccggcgcgggcctggccttctccctgatgaagtccctcgggggcgggcgccggggcaccggggcccagggcgagaccctgggcgagaagtggaagcgccagctgaaccagctctccaagagcgagttcaacacgtacaagcggtccgggatcatggaggtcgaccgcagcgaggccaaggagggcctgaagcgcggggagaccaccaagcacgcggtgtcccgcggcaccgccaagctgcggtggttcgtggagcgcaacctcgtcaagccggaggggaaggtgatcgacctgggctgcggccgcggcgggtggagctactactgcgccgggctgaagaaggtgacggaggtcaaggggtacaccaagggcgggcccggccacgaggagcccatccccatggccacctacgggtggaacctggtgaagctccactccggcaaggacgtgttcttcatcccgcccgagaagtgcgacaccctgctgtgcgacatcggggagagctcccccaaccccacgatcgaggagggccgcaccctccgggtcctgaagatggtggagccgtggctgcgcgggaaccagttctgcatcaagatcctcaacccctacatgcccagcgtggtcgagaccctggagcagatgcagcggaagcacggcggcatgctggtgcgcaaccccctctcccggaacagcacccacgagatgtactgggtgtcctgcgggaccggcaacatcgtcagcgccgtgaacatgacgtcccgcatgctgctgaaccggttcaccatggcgcaccgcaagccgacctacgagcgcgacgtggacctcggggccggcacccggcacgtcgccgtggagcccgaggtggccaacctggacatcatcggccagcgcatcgagaacatcaagcacgagcacaagagcacgtggcactacgacgaggacaacccctacaagacctgggcctaccacgggtcctacgaggtcaagcccagcggcagcgcgtccagcatggtgaacggggtcgtgaagctgctcaccaagccgtgggacgtgatccccatggtcacccagatcgccatgacggacaccacccccttcggccagcagcgggtgttcaaggagaaggtggacacccgcacgcccaaggccaagcgggggaccgcccagatcatggaggtcaccgccaagtggctgtggggcttcctgtcccgcaacaagaagccgcggatctgcacccgcgaggagttcacgcggaaggtgcgcagcaacgcggccatcggcgccgtgttcgtcgacgagaaccagtggaactccgccaaggaggcggtggaggacgagcggttctgggacctcgtgcaccgcgagcgggagctgcacaagcaggggaagtgcgcgacctgcgtctacaacatgatgggcaagcgcgagaagaagctgggggagttcggcaaggccaaggggagccgggccatctggtacatgtggctcggcgcccgcttcctggagttcgaggcgctgggcttcatgaacgaggaccactggttctcccgggagaacagcctctccggggtggagggcgaggggctgcacaagctgggctacatcctccgcgacatcagcaagatccccgggggcaacatgtacgccgacgacaccgccggctgggacacccggatcacggaggacgacctgcagaacgaggccaagatcaccgacatcatggagcccgagcacgccctgctcgcgaagtccatcttcaagctgacctaccagaacaaggtggtccgcgtgcagcggccggccaagaacgggaccgtgatggacgtcatcagccgccgcgaccagcggggctccggccaggtgggcacgtacggcctgaacaccttcaccaacatggaggcccagctcatccgccagatggagagcgaggggatcttctcccccagcgagctggagacccccaacctggccggccgggtgctcgactggctggagaagcacggggtcgagcgcctgaagcggatggccatctccggcgacgactgcgtggtgaagcccatcgacgaccgcttcgcgacggccctcaccgccctgaacgacatggggaaggtccggaaggacatcccgcagtgggagcccagcaagggctggaacgactggcagcaggtccccttctgcagccaccacttccaccagctgatcatgaaggacggccgcgagatcgtggtcccctgccggaaccaggacgagctcgtggggcgcgcccgggtgtcccagggcgccgggtggagcctgcgcgagaccgcgtgcctgggcaagtcctacgcccagatgtggcagctcatgtacttccaccggcgcgacctgcggctggccgccaacgcgatctgcagcgccgtcccggtggactgggtgcccacctcccgcacgacctggagcatccacgcccaccaccagtggatgaccaccgaggacatgctctccgtctggaaccgggtgtggatcgaggagaacccctggatggaggacaagacgcacatcagctcctggggcgacgtgccctacctgggcaagcgcgaggaccagtggtgcggcagcctgatcgggctcaccgcccgggccacctgggcgaccaacatccaggtcgccatcaaccaggtgcgccgcctgatcggcaacgagaactacctggactacatgacctccatgaagcggttcaagaacgagagcgacccggagggggccctctggtga

SEQ ID NO: 8555 - RNA, 9879 nt, synthetic construct
  misc_feature 1..9879: note = derived and/or modified CDS sequence (opt1) from DENV-1__FJ898389__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgcgggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtgacctacgggacctgctcccagaccggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtggggaagctggtccaccagatcttcggcaccgcctacggggtgctgttctccggcgtgagctggaccatgaagatcgggatcggcgtcctgctgacgtggctcggcctgaactcccgcagcacctccctgagcatgacctgcatcgccgtggggctcgtgaccctgtacctgggcgtcatggtgcaggccgactccgggtgcgtgatcaactggaagggccgggagctcaagtgcgggagcggcatcttcgtcacgaacgaggtgcacacctggaccgagcagtacaagttccaggcggacagcccgaagcgcctgtccgccgccatcggcaaggcctgggaggagggggtgtgcggcatccggagcgccacccgcctggagaacatcatgtggaagcagatctccaacgagctcaaccacatcctgctggagaacgacatgaagttcaccgtcgtggtgggggacgtcgtgggcatcctcgcgcaggggaagaagatgatccggccccagcccatggagcacaagtacagctggaagtcctggggcaaggccaagatcatcggcgccgacgtgcagaacacgaccttcatcatcgacgggcccaacaccccggagtgccccgacgaccagcgcgcctggaacatctgggaggtcgaggactacggcttcgggatcttcaccacgaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacctgcatctggcccaagtcccacacgctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcaccacggtggtcgtggacgagcactgcggcaaccgggggccgtccctgcgcaccaccaccgtgacgggcaagatcatccacgagtggtgctgccggagctgcaccctgccgcccctccgcttcaagggggaggacggctgctggtacgggatggagatccggcccgtcaaggagaaggaggagaacctggtgaagtccatggtgagcgccggcagcggcgaggtcgactccttcagcctcgggctgctgtgcatctccatcatgatcgaggaggtgatgcgcagccggtggtcccgcaagatgctcatgaccggcaccctggccgtgttcctgttcctcatcatggggcagctgacgtggaacgacctgatccggctctgcatcatggtcggcgccaacgcgagcgaccgcatggggatgggcaccacctacctggccctgatggccaccttcaagatgcgcccgatgttcgccgtggggctcctgttccggcgcctgacgtcccgggaggtgctcctgctgaccatcgggctcagcctggtcgcctccgtggagctgcccaacagcctcgaggagctgggcgacgggctggcgatgggcatcatgatcctcaagctgctgaccgacttccagtcccaccagctctgggccaccctgctgagcctcacgttcatcaagaccaccctgtccctgcactacgcctggaagaccatggccatggtcctcagcatcgtgtccctgttccccctgtgcctcagcacgacctcccagaagaccacctggctgcccgtgctgctcggcagcttcgggtgcaagccgctggcgatgttcctgatcgccgagaacaagatctggggccgcaagtcctggcccctcaacgaggggatcatggccgtcggcgtggtgagcatcctgctgagctccctcctgaagaacgacgtccccctggccgggcccctcatcgccggcggcatgctgatcgcgtgctacgtgatcagcgggtccagcgccgacctgtccctcgagaaggccgccgaggtgagctgggaggaggaggccgagcactccggcgcgagccacaacatcctggtcgaggtgcaggacgacgggacgatgaagatcaaggacgaggagcgggacgacaccctgaccatcctcctgaaggccaccctgctcgccgtgtccggcgtctacccgctgagcatccccgccaccctgttcgtgtggtacttctggcagaagaagaagcagcgctccggggtgctctgggacacgcccagcccgcccgaggtcgagcgggccgtgctggacgacggcatctaccgcatcatgcagcggggcctgctggggcgctcccaggtgggcgtcggggtgttccaggagaacgtgttccacaccatgtggcacgtcacccggggcgcggtgctcatgtaccaggggaagcgcctggagcccagctgggcctccgtgaagaaggacctgatcagctacggcggcgggtggcggctccagggctcctggaacaccggggaggaggtccaggtgatcgccgtggagcccggcaagaaccccaagaacgtccagacggcccccgggaccttcaagacccccgagggcgaggtgggcgccatcgcgctggacttcaagcccgggaccagcggctcccccatcgtgaaccgcgaggggaagatcgtcggcctgtacggcaacggggtggtgacgaccagcggcacctacgtcagcgccatcgcccaggccaaggcgtcccaggaggggccgctccccgagatcgaggacgaggtgttccggaagcgcaacctgaccatcatggacctgcaccccggcagcgggaagacgcggcgctacctcccggccatcgtgcgggaggccatcaagcgcaagctgcggaccctgatcctcgcccccacccgcgtcgtggcctccgagatggcggaggccctgaagggcatgcccatccgctaccagaccacggccgtcaagagcgagcacaccggcaaggagatcgtcgacctgatgtgccacgccaccttcaccatgcggctcctgtcccccgtgcgcgtgccgaactacaacatgatcatcatggacgaggcccacttcacggaccccttcagcatcgcggcccgggggtacatctccacccgcgtcggcatgggggaggccgccgccatcttcatgaccgcgacgccgcccggcagcgtggaggccttcccgcagtccaacgccgtgatccaggacgaggagcgggacatccccgagcgcagctggaactccgggtacgagtggatcacggacttccccggcaagaccgtctggttcgtgcccagcatcaagtccggcaacgacatcgccaactgcctgcggaagaacgggaagcgcgtgatccagctcagccggaagaccttcgacaccgagtaccagaagacgaagaacaacgactgggactacgtcgtgaccaccgacatctccgagatgggcgcgaacttccgcgccgaccgggtgatcgacccgcgccggtgcctgaagcccgtcatcctgaaggacgggcccgagcgcgtgatcctcgccggccccatgccggtcaccgtggccagcgccgcgcagcggcgcgggcggatcggccgcaaccacaacaaggagggcgaccagtacatctacatggggcagcccctgaacaacgacgaggaccacgcccactggacggaggccaagatgctgctcgacaacatcaacacccccgagggcatcatccccgccctgttcgagccggagcgggagaagtccgccgcgatcgacggggagtaccgcctgcgcggcgaggcccggaagaccttcgtggagctcatgcgccgcggggacctgcccgtctggctgagctacaaggtggcctccgagggcttccagtacagcgaccgccggtggtgcttcgacggcgagcgcaacaaccaggtgctcgaggagaacatggacgtcgagatctggaccaaggagggggagcggaagaagctgcgcccccggtggctggacgcccgcacgtacagcgaccccctcgccctgcgggagttcaaggagttcgcggccggccgccggtccgtgagcggggacctgatcctcgagatcggcaagctgccgcagcacctgacccagcgcgcccagaacgccctcgacaacctggtgatgctgcacaactccgagcagggcgggcgggcgtaccgccacgccatggaggagctccccgacaccatcgagaccctgatgctgctcgccctgatcgccgtcctgacgggcggggtgaccctcttcttcctgagcggccgggggctgggcaagacctccatcggcctcctgtgcgtgatggccagctccgtcctgctctggatggcgagcgtggagccccactggatcgccgcctccatcatcctggagttcttcctgatggtgctcctgatccccgagccggaccgccagcggacgccccaggacaaccagctggcctacgtcgtgatcgggctcctgttcatgatcctgaccgtggccgcgaacgagatgggcctcctggagacgaccaagaaggacctggggatcggccacgtcgccgtggagaaccaccaccacgccaccatgctcgacgtggacctgcaccccgccagcgcctggaccctgtacgcggtcgccacgaccatcatcaccccgatgatgcgccacaccatcgagaacacgaccgccaacatctccctcaccgccatcgccaaccaggcggccatcctgatggggctggacaagggctggcccatcagcaagatggacatcggcgtgcccctcctggccctggggtgctactcccaggtgaaccccctcaccctgacggccgcggtcctgatgctcgtggcccactacgccatcatcggcccggggctgcaggccaaggccacccgggaggcgcagaagcgcaccgccgccggcatcatgaagaaccccaccgtggacgggatcgtcgccatcgacctggaccccgtggtgtacgacgccaagttcgagaagcagctcggccagatcatgctgctgatcctctgcacgagccagatcctgctgatgcgcaccacctgggcgctctgcgagtccatcaccctggccacgggccccctgaccaccctctgggaggggagcccgggcaagttctggaacaccacgatcgccgtctccatggccaacatcttccgggggagctacctggccggcgcgggcctggccttctccctcatgaagtccctcgggggcgggcgccgggggaccggggcccagggcgagaccctgggcgagaagtggaagcgccagctcaaccagctgagcaagtccgagttcaacatctacaagcggagcgggatcatggaggtggaccgctccgaggccaaggagggcctgaagcgcggggagaccacgcgccacgcggtgagccggggcaccgccaagctccgctggttcgtcgagcggaacctggtgaagcccgaggggaaggtgatcgacctgggctgcggccgcgggggctggtcctactactgcgccgggctgaagaaggtcaccgaggtgaagggctacaccaagggcgggcccggccacgaggagcccatcccgatggccacgtacgggtggaacctcgtgaagctgcacagcggcaaggacgtcttcttcacgccgcccgagaagtgcgacaccctgctctgcgacatcggggagtccagccccaacccgaccatcgaggagggccggacgctgcgcgtgctgaagatggtggagccctggctccgggggaaccagttctgcatcaagatcctgaacccctacatgccctccgtcgtggagaccctggagcagatgcagcgcaagcacggcggcatgctcgtgcggaacccgctgagccgcaactccacccacgagatgtactgggtcagctgcgggaccggcaacatcgtgtccgccgtgaacatgaccagccggatgctgctcaaccgcttcacgatggcgcaccgcaagcccacctacgagcgggacgtcgacctgggggccggcacccgccacgtggccgtggagcccgaggtcgccaacctggacatcatcggccagcggatcgagaacatcaagcacgagcacaagtccacctggcactacgacgaggacaacccctacaagacgtgggcctaccacgggagctacgaggtgaagccgtccggcagcgcgtccagcatggtcaacggggtggtgaagctcctgaccaagccctgggacgtcatccccatggtgacccagatcgccatgaccgacacgacccccttcggccagcagcgcgtgttcaaggagaaggtcgacacccggaccccgaaggccaagcgcgggacggcccagatcatggaggtgaccgcccggtggctgtggggcttcctcagccgcaacaagaagccccggatctgcacccgcgaggagttcacccggaaggtgcgctccaacgcggccatcggcgccgtcttcgtggacgagaaccagtggaacagcgccaaggaggcggtggaggacgagcggttctgggacctggtccagaaggagcgcgagctgcacaagcaggggaagtgcgccacgtgcgtgtacaacatgatgggcaagcgggagaagaagctcggggagttcggcaaggccaaggggtcccgcgccatctggtacatgtggctgggcgcccggttcctggagttcgaggcgctcggcttcatgaacgaggaccactggttcagccgcgagaactccctgagcggggtggagggcgaggggctgcacaagctcggctacatcctgcgggacatctccaagatccccgggggcaacatgtacgccgacgacaccgccggctgggacacccgcatcaccgaggacgacctgcagaacgaggccaagatcacggacatcatggagccggagcacgccctcctggcgaccagcatcttcaagctgacctaccagaacaaggtcgtgcgggtgcagcgccccgccaagaacgggaccgtcatggacgtgatctcccgccgggaccagcgcggcagcggccaggtgggcacgtacggcctcaacaccttcaccaacatggaggcccagctgatccggcagatggagtccgaggggatcttcctgcccagcgagctcgagacccccaacctggccgagcgcgtcctggactggctcgagaagtacggcgtggagcggctgaagcgcatggccatctccggggacgactgcgtggtcaagccgatcgacgaccggttcgcgacggccctgaccgccctcaacgacatgggcaaggtgcgcaaggacatcccccagtgggagcccagcaaggggtggaacgactggcagcaggtccccttctgctcccaccacttccaccagctgatcatgaaggacggccgggagatcgtcgtgccgtgccgcaaccaggacgagctggtgggccgggcccgcgtcagccagggggccggctggtccctccgggagaccgcgtgcctgggcaagagctacgcccagatgtggcagctgatgtacttccaccgccgggacctccgcctggccgccaacgcgatctgcagcgccgtgcccgtggactgggtccccacctcccggacgacctggagcatccacgcccaccaccagtggatgaccaccgaggacatgctgtccgtgtggaaccgcgtgtggatcgaggagaacccctggatggaggacaagacgcacgtcagctcctggggcgacgtgccgtacctcgggaagcgggaggaccagtggtgcggcagcctgatcggcctgaccgcccgcgccacctgggcgtccaacatccaggtggccatcaaccaggtccgccggctcatcgggaacgagaactacctggactacatgaccagcatgaagcgcttcaagaacgagggcgaccccgagggggccctgtggtga

SEQ ID NO: 8556 - RNA, 9879 nt, synthetic construct
  misc_feature 1..9879: note = derived and/or modified CDS sequence (opt1) from DENV-1__FJ898390__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgccggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtgacctacgggacctgcagccagacgggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgtgggcgagaaggcgctgaagctcagctggttcaagaaggggtccagcatcggcaagatgttcgaggccaccgcccgcggggcccggcgcatggccatcctgggcgacacggcgtgggacttcgggtccatcggcggcgtgttcaccagcgtcgggaagctggtgcaccagatcttcggcaccgcctacggggtcctgttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggccgactccgggtgcgtcatcaactggaagggccgggagctcaagtgcgggagcggcatcttcgtgacgaacgaggtgcacacctggaccgagcagtacaagttccaggccgacagcccgaagcgcctgtccgcggccatcggcaaggcctgggaggagggggtctgcggcatccggagcgccacccgcctggagaacatcatgtggaagcagatctccaacgagctcaaccacatcctgctggagaacgacatgaagttcaccgtggtggtcggggacgtggtgggcatcctcgcccaggggaagaagatgatccggccccagcccatggagcacaagtacagctggaagtcctggggcaaggcgaagatcatcggcgccgacgtccagaacacgaccttcatcatcgacgggcccaacaccccggagtgccccgacgaccagcgcgcctggaacatctgggaggtggaggactacggcttcgggatcttcaccacgaacatctggctgaagctgcgggacagctacacccaggtgtgcgaccaccgcctcatgtccgccgcgatcaaggacagcaaggccgtccacgccgacatgggctactggatcgagtccgagaagaacgagacctggaagctggcccgggccagcttcatcgaggtgaagacctgcatctggcccaagtcccacacgctgtggagcaacggcgtgctcgagtccgagatgatcatccccaagatctacgggggcccgatcagccagcacaactaccgccccgggtacttcacccagaccgcgggcccctggcacctggggaagctggagctcgacttcgacctgtgcgagggcaccacggtcgtggtggacgagcactgcggcaaccgggggccgtccctgcgcaccaccaccgtcacgggcaagatcatccacgagtggtgctgccggagctgcaccctgccgcccctccgcttcaagggggaggacggctgctggtacgggatggagatccggcccgtgaaggagaaggaggagaacctggtgaagtccatggtcagcgccggcagcggcgaggtggactccttcagcctcgggctgctgtgcatctccatcatgatcgaggaggtgatgcgcagccggtggtcccgcaagatgctcatgaccggcaccctggccgtcttcctgctcctgatcatggggcagctgacgtggaacgacctcatccggctgtgcatcatggtgggcgccaacgccagcgaccgcatggggatgggcaccacctacctggcgctcatggccaccttcaagatgcgcccgatgttcgccgtggggctgctgttccggcgcctcacgtcccgggaggtcctgctgctcaccatcgggctgagcctggtggcctccgtcgagctccccaacagcctggaggagctgggcgacgggctcgccatgggcatcatgatcctgaagctgctcaccgacttccagtcccaccagctgtgggcgaccctgctcagcctgacgttcatcaagaccaccctgtccctccactacgcctggaagaccatggccatggtgctgagcatcgtgtccctgttccccctctgcctgagcacgacctcccagaagaccacctggctgcccgtcctcctgggcagcctggggtgcaagccgctcacgatgttcctgatcgccgagaacaagatctggggccgcaagtcctggcccctgaacgaggggatcatggcggtgggcgtggtcagcatcctcctgagctccctgctcaagaacgacgtgcccctggccgggcccctgatcgccggcggcatgctcatcgcctgctacgtgatcagcgggtccagcgccgacctgtccctggagaaggcggccgaggtcagctgggaggaggaggccgagcactccggcgccagccacaacatcctcgtggaggtgcaggacgacgggaccatgaagatcaaggacgaggagcgggacgacaccctgaccatcctgctcaaggccaccctgctggcggtctccggcgtgtacccgctcagcatccccgccacgctgttcgtgtggtacttctggcagaagaagaagcagcgctccggggtcctgtgggacacccccagcccgcccgaggtggagcgggccgtgctggacgacggcatctaccgcatcatgcagcggggcctcctggggcgctcccaggtcggcgtgggggtgttccaggagaacgtcttccacaccatgtggcacgtgacccggggcgccgtgctgatgtaccaggggaagcgcctcgagcccagctgggcctccgtcaagaaggacctgatcagctacggcggcgggtggcggctgcagggctcctggaacacgggggaggaggtccaggtgatcgcggtcgagcccggcaagaaccccaagaacgtgcagaccgcccccgggaccttcaagacccccgagggcgaggtgggcgccatcgccctcgacttcaagcccgggacgagcggctcccccatcgtcaaccgcgaggggaagatcgtgggcctgtacggcaacggggtggtcaccaccagcggcacctacgtgagcgccatcgcgcaggccaaggcctcccaggaggggccgctgcccgagatcgaggacgaggtgttccggaagcgcaacctcacgatcatggacctgcaccccggcagcgggaagacccggcgctacctgccggccatcgtccgggaggcgatcaagcgcaagctccggaccctgatcctggcccccacccgcgtggtggcctccgagatggccgaggccctcaagggcatgcccatccgctaccagacgaccgcggtcaagagcgagcacaccggcaaggagatcgtggacctgatgtgccacgccaccttcacgatgcggctgctctcccccgtgcgcgtcccgaactacaacatgatcatcatggacgaggcccacttcaccgaccccagctccatcgccgcccgggggtacatcagcacccgcgtgggcatgggggaggcggccgccatcttcatgaccgccacgccgcccggctccgtggaggccttcccgcagagcaacgcggtcatccaggacgaggagcgggacatccccgagcgctcctggaacagcgggtacgagtggatcaccgacttccccggcaagaccgtgtggttcgtgccctccatcaagagcggcaacgacatcgccaactgcctgcggaagaacgggaagcgcgtcatccagctgtcccggaagaccttcgacacggagtaccagaagaccaagaacaacgactgggactacgtggtgaccaccgacatcagcgagatgggcgccaacttccgcgccgaccgggtcatcgacccgcgccggtgcctcaagcccgtgatcctgaaggacgggcccgagcgcgtcatcctggcgggccccatgccggtgacggtggcctccgccgcccagcggcgcgggcggatcggccgcaaccacaacaaggagggcgaccagtacatctacatggggcagcccctcaacaacgacgaggaccacgcccactggaccgaggcgaagatgctgctggacaacatcaacacccccgagggcatcatccccgccctcttcgagccggagcgggagaagtccgccgccatcgacggggagtaccgcctgcgcggcgaggcccggaagaccttcgtcgagctgatgcgccgcggggacctccccgtgtggctgtcctacaaggtggcgagcgagggcttccagtacagcgaccgccggtggtgcttcgacggcgagcgcaacaaccaggtcctggaggagaacatggacgtggagatctggacgaaggagggggagcggaagaagctccgcccccggtggctggacgcccgcacctactccgaccccctggccctccgggagttcaaggagttcgccgccggccgccggagcgtgtccggggacctgatcctggagatcggcaagctcccgcagcacctgacccagcgcgcgcagaacgccctggacaacctcgtcatgctgcacaacagcgagcagggcgggcgggcctaccgccacgccatggaggagctgcccgacaccatcgagacgctcatgctgctggcgctcatcgccgtgctgaccggcggggtgaccctgttcttcctctccggccgggggctgggcaagaccagcatcggcctgctctgcgtcatggcctccagcgtgctgctgtggatggcctccgtggagccccactggatcgccgcgagcatcatcctcgagttcttcctgatggtcctgctcatccccgagccggaccgccagcggacgccccaggacaaccagctggcctacgtggtgatcgggctcctcttcatgatcctgacggtcgccgccaacgagatgggcctgctcgagaccaccaagaaggacctggggatcggccacgtggccgtggagaaccaccaccacgcgaccatgctggacgtcgacctccaccccgcctccgcctggacgctgtacgccgtggccaccaccatcatcaccccgatgatgcgccacacgatcgagaacaccaccgcgaacatcagcctgaccgccatcgccaaccaggccgccatcctcatggggctggacaagggctggcccatctccaagatggacatcggcgtgcccctgctcgcgctggggtgctacagccaggtcaaccccctgacgctcaccgccgccgtgctgatgctggtggcccactacgcgatcatcggcccggggctccaggccaaggccacccgggaggcccagaagcgcaccgccgcgggcatcatgaagaaccccacggtcgacgggatcgtggccatcgacctggaccccgtggtctacgacgccaagttcgagaagcagctgggccagatcatgctcctgatcctgtgcacctcccagatcctcctgatgcgcaccacctgggccctgtgcgagagcatcacgctcgccaccggccccctgaccaccctgtgggaggggtccccgggcaagttctggaacacgaccatcgcggtgagcatggccaacatcttccgggggtcctacctcgccggcgccggcctggccttcagcctgatgaagtccctcgggggcgggcgccggggcaccggggcgcagggcgagaccctgggcgagaagtggaagcgccagctgaaccagctctccaagagcgagttcaacatctacaagcggtccgggatcatggaggtggaccgcagcgaggccaaggagggcctgaagcgcggggagacgacccgccacgccgtctcccggggcaccgccaagctgcgctggttcgtggagcggaacctggtgaagcccgaggggaaggtcatcgacctcggctgcggccgcgggggctggagctactactgcgcggggctgaagaaggtgaccgaggtgaagggctacacgaagggcgggcccggccacgaggagcccatcccgatggccacctacgggtggaacctggtcaagctccactccggcaaggacgtgttcttcacgccgcccgagaagtgcgacaccctgctgtgcgacatcggggagagctcccccaacccgacgatcgaggagggccggaccctccgcgtgctgaagatggtcgagccctggctgcgggggaaccagttctgcatcaagatcctcaacccctacatgcccagcgtggtggagaccctggagcagatgcagcgcaagcacggcggcatgctggtccggaacccgctctcccgcaacagcacccacgagatgtactgggtgtcctgcgggaccggcaacatcgtgagcgccgtcaacatgacgtcccggatgctgctgaaccgcttcaccatggcccaccgcaagcccacctacgagcgggacgtggacctcggggccggcacccgccacgtggcggtcgagcccgaggtggccaacctggacatcatcggccagcggatcgagaacatcaagcacgagcacaagagcacgtggcactacgacgaggacaacccctacaagacctgggcctaccacgggtcctacgaggtcaagccgagcggctccgccagcagcatggtgaacggggtggtcaagctgctcaccaagccctgggacgtgatccccatggtgacccagatcgccatgacggacaccacccccttcggccagcagcgcgtcttcaaggagaaggtggacacccggacgccgaaggcgaagcgcgggaccgcccagatcatggaggtgaccgcccggtggctgtggggcttcctgtcccgcaacaagaagccccggatctgcacccgcgaggagttcacgcggaaggtccgcagcaacgccgccatcggcgcggtgttcgtggacgagaaccagtggaactccgccaaggaggccgtcgaggacgagcggttctgggacctcgtgcagaaggagcgcgagctgcacaagcaggggaagtgcgcgacctgcgtgtacaacatgatgggcaagcgggagaagaagctgggggagttcggcaaggcgaaggggagccgcgccatctggtacatgtggctcggcgcccggttcctggagttcgaggccctgggcttcatgaacgaggaccactggttctcccgcgagaacagcctctccggggtcgagggcgaggggctgcacaagctgggctacatcctccgggacatcagcaagatccccgggggcaacatgtacgccgacgacaccgcgggctgggacacccgcatcacggaggacgacctgcagaacgaggccaagatcaccgacatcatggagccggagcacgccctgctcgccacctccatcttcaagctgacctaccagaacaaggtggtgcgggtccagcgccccgccaagaacgggacggtgatggacgtgatcagccgccgggaccagcgcggctccgggcaggtcggcacctacggcctgaacaccttcaccaacatggaggcgcagctcatccggcagatggagagcgaggggatcttcctgccctccgagctggagacgcccaacctcgccgagcgcgtgctggactggctggagaagcacggcgtggagcggctcaagcgcatggccatcagcggggacgactgcgtcgtgaagccgatcgacgaccggttcgccaccgccctgaccgcgctgaacgacatgggcaaggtgcgcaaggacatcccccagtgggagccctccaaggggtggaacgactggcagcaggtccccttctgcagccaccacttccaccagctcatcatgaaggacggccgggagatcgtggtgccgtgccgcaaccaggacgagctggtcggccgggcccgcgtgtcccagggggccggctggagcctgcgggagaccgcctgcctcggcaagagctacgcccagatgtggcagctgatgtacttccaccgccgggacctgcgcctcgcggccaacgccatctgctccgccgtgcccgtcgactgggtgcccacgagccggaccacctggtccatccacgcgcaccaccagtggatgaccacggaggacatgctgagcgtgtggaaccgcgtctggatcgaggagaacccctggatggaggacaagacccacgtgtccagctggggcgacgtgccgtacctggggaagcgggaggaccagtggtgcggctccctcatcggcctgaccgcccgcgccacctgggccagcaacatccaggtcgccatcaaccaggtgcgccggctgatcgggaacgagaactacctcgactacatgacctccatgaagcgcttcaagaacgagggcgaccccgagggggcgctgtggtga

SEQ ID NO: 8557 - RNA, 9879 nt, synthetic construct
  misc_feature 1..9879: note = derived and/or modified CDS sequence (opt1) from DENV-1__FJ898391__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagaccagcgcgggggtgaacatgtgcaccctcatcgccatggacctgggcgagttctgcgaggacacgatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagaccgtccagtacgagaacctgaagtacagcgtgatcgtgaccgtccacacgggcgaccagcaccaggtggggaacgagtccaccgagcacggcaccaccgcgaccatcacgccccaggcccccagcaccgagatccagctgaccgactacggggccctcaccctggactgcagcccccggacgggcctggacttcaacgagatggtcctcctgaccatgaaggagaagtcctggctggtgcacaagcagtggttcctcgacctgccgctgccctggaccagcggggcctccaccagccaggagacgtggaaccggaaggacctcctggtgaccttcaagaccgcccacgcgaagaagcaggaggtcgtggtgctgggctcccaggagggcgccatgcacaccgccctcacgggggccaccgagatccagaccagcggcaccacgaccatcttcgccgggcacctgaagtgccgcctgaagatggacaagctcaccctgaagggcatgtcctacgtcatgtgcaccgggagcttcaagctggagaaggaggtggcggagacgcagcacggcaccgtgctcgtccagatcaagtacgagggcaccgacgccccctgcaagatccccttctccacccaggacgagaagggggtgacgcagaacggccggctgatcaccgccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacacggcctgggacttcgggagcatcggcggcgtgttcacctccgtcgggaagctggtgcaccagatcttcggcaccgcctacggggtgctgttcagcggcgtctcctggaccatgaagatcgggatcggcgtgctcctgacgtggctgggcctcaacagccgctccaccagcctgtccatgacctgcatcgccgtggggctggtcaccctctacctgggcgtgatggtgcaggccgacagcgggtgcgtcatcaactggaagggccgggagctgaagtgcgggagcggcatcttcgtgacgaacgaggtgcacacctggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagttcaccgtggtggtcggggacgtggcgggcatcctggcccaggggaagaagatgatccggccccagcccatggagtacaagtactcctggaagtcctggggcaaggccaagatcatcggcgccgacgtgcagaacacgaccttcatcatcgacgggcccaacaccccggagtgccccgacgaccagcgcgcgtggaacatctgggaggtcgaggactacggcttcgggatcttcaccacgaacatctggctcaagctgcgggactcctacacccaggtgtgcgaccaccgcctgatgagcgccgccatcaaggactccaaggccgtgcacgccgacatgggctactggatcgagagcgagaagaacgagacctggaagctcgcgcgggcctccttcatcgaggtcaagacctgcatctggcccaagagccacacgctgtggtccaacggcgtgctggagagcgagatgatcatccccaagatctacgggggcccgatctcccagcacaactaccgccccgggtacttcacccagaccgccggcccctggcacctcgggaagctggagctggacttcgacctctgcgagggcaccacggtggtcgtggacgagcactgcggcaaccgggggccgagcctgcgcaccaccaccgtgacgggcaagatcatccacgagtggtgctgccggtcctgcaccctgccgcccctgcgcttcaagggggaggacggctgctggtacgggatggagatccggcccgtcaaggagaaggaggagaacctggtcaagagcatggtgagcgccggctccggcgaggtcgacagcttctccctggggctcctgtgcatcagcatcatgatcgaggaggtgatgcgctcccggtggagccgcaagatgctgatgaccggcaccctcgccgtgttcttcctgctgatcatggggcagctcacgtggaacgacctgatccggctgtgcatcatggtcggcgcgaacgcctccgaccgcatggggatgggcaccacctacctcgccctgatggccaccttcaagatgcgcccgatgttcgccgtggggctcctgttccggcgcctgacgagccgggaggtgctgctcctgaccatcgggctgtccctcgtcgcgagcgtggagctgcccaactccctggaggagctcggcgacgggctggccatgggcatcatgatcctgaagctcctgaccgacttccagagccaccagctgtgggccaccctcctgtccctgacgttcatcaagaccaccttcagcctccactacgcctggaagaccatggcgatggtcctgtccatcgtgagcctgttccccctctgcctgtccacgaccagccagaagaccacctggctgcccgtgctcctgggctccctggggtgcaagccgctcacgatgttcctgatcgccgagaacaagatctggggccgcaagagctggcccctgaacgaggggatcatggccgtcggcatcgtgagcatcctcctgtccagcctgctcaagaacgacgtgcccctggccgggcccctgatcgccggcggcatgctcatcgcgtgctacgtcatctccgggagctccgccgacctgagcctggagaaggccgccgaggtgtcctgggaggaggaggccgagcacagcggcgcgtcccacaacatcctcgtggaggtccaggacgacgggaccatgaagatcaaggacgaggagcgggacgacaccctgaccatcctgctcaaggccaccctgctggccgtgagcggcgtgtacccgctctccatccccgccacgctgttcgtctggtacttctggcagaagaagaagcagcgcagcggggtgctgtgggacacccccagcccgcccgaggtggagcgggccgtcctcgacgacggcatctaccgcatcatgcagcggggcctgctggggcgcagccaggtgggcgtgggggtcttccaggagaacgtgttccacaccatgtggcacgtgacccggggcgcggtcctgatgtaccaggggaagcgcctcgagccctcctgggccagcgtgaagaaggacctgatctcctacggcggcgggtggcggctgcagggcagctggaacacgggggaggaggtgcaggtcatcgccgtggagcccggcaagaaccccaagaacgtgcagaccgcccccgggaccttcaagacctccgagggcgaggtcggcgccatcgcgctcgacttcaagcccgggacgagcggcagccccatcgtgaaccgcgaggggaagatcgtgggcctgtacggcaacggggtcgtgaccacctccggcacctacgtgagcgccatcgcccaggccaaggcgtcccaggaggggcccctgccggagatcgaggacgaggtcttccggaagcgcaacctcacgatcatggacctgcaccccggcagcgggaagacccggcgctacctgcccgccatcgtgcgggaggccatcaagcgcaagctccggaccctgatcctggccccgacccgcgtggtcgcctccgagatggcggaggccctcaagggcatgcccatccgctaccagacgaccgccgtcaagagcgagcacaccggcaaggagatcgtggacctgatgtgccacgccaccttcacgatgcggctgctctcccccgtccgcgtgcccaactacaacatgatcatcatggacgaggcccacttcaccgacccgagctccatcgcggcccgggggtacatcagcacccgcgtgggcatgggggaggccgccgccatcttcatgaccgcgacgccgcccggctccgtcgaggccttcccccagagcaacgccgtgatccaggacgaggagcgggacatcccggagcgctcctggaacagcgggtacgagtggatcaccgacttccccggcaagaccgtgtggttcgtcccctccatcaagagcggcaacgacatcgccaactgcctgcggaagaacgggaagcgcgtgatccagctgtcccggaagaccttcgacacggagtaccagaagaccaagaacaacgactgggactacgtggtcaccaccgacatcagcgagatgggcgcgaacttccgcgccgaccgggtgatcgacccccgccggtgcctcaagccggtgatcctgaaggacgggcccgagcgcgtcatcctggccggccccatgcccgtgacggtcgcctccgccgcgcagcggcgcgggcggatcggccgcaaccacaacaaggagggcgaccagtacatctacatggggcagccgctcaacaacgacgaggaccacgcccactggaccgaggccaagatgctgctggacaacatcaacacccccgagggcatcatccccgccctcttcgagcccgagcgggagaagtccgccgcgatcgacggggagtaccgcctgcgcggcgaggcccggaagaccttcgtggagctgatgcgccgcggggacctcccggtgtggctgagctacaaggtcgcctccgagggcttccagtacagcgaccgccggtggtgcttcgacggcgagcgcaacaaccaggtgctggaggagaacatggacgtggagatctggacgaaggagggggagcggaagaagctccgcccccggtggctggacgcccgcacctactccgaccccctggccctccgggagttcaaggagttcgcggccggccgccggagcgtctccggggacctgatcctggagatcggcaagctcccccagcacctgacccagcgcgcccagaacgccctggacaacctcgtgatgctgcacaacagcgagcagggcgggcgggcgtaccgccacgccatggaggagctgccggacaccatcgagacgctcatgctgctggccctcatcgccgtgctgaccggcggggtcaccctgttcttcctctccggccgggggctgggcaagaccagcatcggcctgctctgcgtgatggcctccagcgtgctgctgtggatggcgtccgtcgagccccactggatcgccgccagcatcatcctcgagttcttcctgatggtgctgctcatccccgagcccgaccgccagcggaccccgcaggacaaccagctggcctacgtggtcatcgggctcctcttcatgatcctgacggtggccgcgaacgagatgggcctgctcgagaccaccaagaaggacctggggatcggccacgtggccgtcgagaaccaccaccacgccgccatgctggacgtggacctccaccccgcctccgcgtggaccctgtacgccgtggccacgaccatcatcacccccatgatgcgccacaccatcgagaacacgaccgccaacatcagcctgaccgccatcgcgaaccaggccgccatcctcatggggctggacaagggctggccgatctccaagatggacatcggcgtccccctgctcgccctggggtgctacagccaggtgaaccccctgaccctcacggcggccgtgctgatgctggtcgcccactacgccatcatcggccccgggctccaggccaaggcgacccgggaggcccagaagcgcaccgccgccggcatcatgaagaacccgaccgtggacgggatcgtggccatcgacctggaccccgtcgtgtacgacgcgaagttcgagaagcagctgggccagatcatgctcctgatcctgtgcacgtcccagatcctcctgatgcgcaccacctgggccctgtgcgagagcatcaccctcgccacgggccccctgaccaccctgtgggaggggtcccccggcaagttctggaacaccacgatcgccgtgagcatggccaacatcttccgggggagctacctcgcgggcgccggcctggccttctccctgatgaagtccctcgggggcgggcgccggggcaccggggcccagggcgagaccctgggcgagaagtggaagcgccagctgaaccagctctccaagagcgagttcaacacctacaagcggtccgggatcatggaggtcgaccgcagcgaggcgaaggagggcctgaagcgcggggagacgaccaagcacgccgtgtcccgcggcaccgccaagctgcggtggttcgtggagcgcaacctcgtcaagccggaggggaaggtgatcgacctgggctgcggccgcggcgggtggagctactactgcgccgggctgaagaaggtgaccgaggtcaaggggtacacgaagggcgggcccggccacgaggagcccatccccatggccacctacgggtggaacctggtgaagctccactccggcaaggacgtgttcttcatcccgcccgagaagtgcgacaccctgctgtgcgacatcggggagagctcccccaaccccaccatcgaggagggccgcacgctccgggtcctgaagatggtggagccgtggctgcgcgggaaccagttctgcatcaagatcctcaacccctacatgcccagcgtggtcgagaccctggagcagatgcagcggaagcacggcggcatgctggtgcgcaaccccctctcccggaacagcacccacgagatgtactgggtgtcctgcgggaccggcaacatcgtcagcgcggtgaacatgacctcccgcatgctgctgaaccggttcacgatggcccaccgcaagccgacctacgagcgcgacgtggacctcggggccggcacccggcacgtcgccgtggagcccgaggtggccaacctggacatcatcggccagcgcatcgagaacatcaagcacgagcacaagagcacctggcactacgacgaggacaacccctacaagacgtgggcgtaccacgggtcctacgaggtcaagcccagcggcagcgcctccagcatggtgaacggggtcgtgaagctgctcaccaagccgtgggacgtgatccccatggtcacccagatcgccatgaccgacacgacccccttcggccagcagcgggtgttcaaggagaaggtggacacccgcacccccaaggccaagcgggggacggcccagatcatggaggtcaccgcgaagtggctgtggggcttcctgtcccgcaacaagaagccgcggatctgcacccgcgaggagttcacccggaaggtgcgcagcaacgccgccatcggcgccgtgttcgtcgacgagaaccagtggaactccgcgaaggaggccgtggaggacgagcggttctgggacctcgtgcaccgcgagcgggagctgcacaagcaggggaagtgcgccacgtgcgtctacaacatgatgggcaagcgcgagaagaagctgggggagttcggcaaggccaaggggagccgggccatctggtacatgtggctcggcgcgcgcttcctggagttcgaggccctgggcttcatgaacgaggaccactggttctcccgggagaacagcctctccggggtggagggcgaggggctgcacaagctgggctacatcctccgcgacatcagcaagatccccgggggcaacatgtacgccgacgacaccgccggctgggacacccggatcaccgaggacgacctgcagaacgaggccaagatcacggacatcatggagcccgagcacgcgctgctcgccaagtccatcttcaagctgacctaccagaacaaggtggtccgcgtgcagcggccggccaagaacgggaccgtgatggacgtcatcagccgccgcgaccagcggggctccggccaggtgggcacctacggcctgaacacgttcaccaacatggaggcccagctcatccgccagatggagagcgaggggatcttctcccccagcgagctggagacccccaacctggccggccgggtgctcgactggctggagaagcacggggtcgagcgcctgaagcggatggcgatctccggcgacgactgcgtggtgaagcccatcgacgaccgcttcgccaccgccctcacggccctgaacgacatggggaaggtccggaaggacatcccgcagtgggagcccagcaagggctggaacgactggcagcaggtccccttctgcagccaccacttccaccagctgatcatgaaggacggccgcgagatcgtggtcccctgccggaaccaggacgagctcgtggggcgcgcccgggtgtcccagggcgcggggtggagcctgcgcgagaccgcctgcctgggcaagtcctacgcccagatgtggcagctcatgtacttccaccggcgcgacctgcggctggccgcgaacgccatctgcagcgccgtcccggtggactgggtgcccacctcccgcaccacgtggagcatccacgcccaccaccagtggatgaccaccgaggacatgctctccgtctggaaccgggtgtggatcgaggagaacccctggatggaggacaagacccacatcagctcctggggcgacgtgccctacctgggcaagcgcgaggaccagtggtgcggcagcctgatcgggctcacggcccgggcgacctgggccaccaacatccaggtcgccatcaaccaggtgcgccgcctgatcggcaacgagaactacctggactacatgacctccatgaagcggttcaagaacgagagcgacccggagggggccctctggtga

SEQ ID NO: 8558 - RNA, 9879 nt, synthetic construct
  misc_feature 1..9879: note = derived and/or modified CDS sequence (opt1) from DENV-1__FJ898392__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgcgggggtgaacatgtgcaccctcatcgccatggacctgggcgagctgtgcgaggacaccatgacctacaagtgcccccgcatcaccgaggccgagcccgacgacgtggactgctggtgcaacgccaccgacacctgggtgacctacgggacctgcagccagacgggcgagcaccggcgcgacaagcggagcgtggccctcgcgccccacgtgggcctggggctggagacccgcaccgagacctggatgtccagcgagggcgcctggaagcagatccagcgggtggagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtggggaagctggtccaccagatcttcggcaccgcctacggggtcctgttctccggcgtgagctggaccatgaagatcgggatcggcgtcctgctgacgtggctcggcctgaactcccgcagcacctccctgagcatgacctgcatcgccgtggggctcgtgaccctgtacctgggcgtcatggtgcaggccgactccgggtgcgtgatcaactggaagggccgggagctcaagtgcgggagcggcatcttcgtcacgaacgaggtgcacacctggaccgagcagtacaagttccaggcggacagcccgaagcgcctgtccgccgccatcggcaaggcctgggaggagggggtgtgcggcatccggagcgccacccgcctggagaacatcatgtggaagcagatctccaacgagctcaaccacatcctgctggagaacgggatgaagttcaccgtcgtggtgggcgacgtcgtggggatcctcgcgcagggcaagaagatgatccggccccagcccatggagcacaagtacagctggaagtcctggggcaaggccaagatcatcggggccgacgtgcagaacacgaccttcatcatcgacggccccaacaccccggagtgccccgacgaccagcgcgcctggaacatctgggaggtcgaggactacgggttcggcatcttcaccacgaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacctgcatctggcccaagtcccacacgctgtggagcaacggggtgctcgagtccgagatgatcatccccaagatctacggcgggccgatcagccagcacaactaccgccccggctacttcacccagaccgccgggccctggcacctgggcaagctggagctcgacttcgacctgtgcgagggcaccacggtggtcgtggacgagcactgcgggaaccggggcccgtccctgcgcaccaccaccgtgacggggaagatcatccacgagtggtgctgccggagctgcaccctgccgcccctccgcttcaagggcgaggacgggtgctggtacggcatggagatccggcccgtcaaggagaaggaggagaacctggtgaagtccatggtgagcgccggcagcggggaggtcgactccttcagcctcggcctgctgtgcacctccatcatgatcgaggaggtgatgcgcagccggtggtcccgcaagatgctcatgaccgggacgctggccgtgttcctgctcctgatcatgggccagctgacctggaacgacctcatccggctgtgcatcatggtcggggccaacgcgagcgaccgcatgggcatgggcaccacctacctggccctcatggccacgttcaagatgcgcccgatgttcgccgtggggctgctgttccggcgcctcacctcccgggaggtgctgctgctcaccatcgggctgagcctggtcgcctccgtggagctccccaacagcctggaggagctgggggacggcctcgcgatgggcatcatgatcctgaagctgctcaccgacttccagtcccaccagctgtgggccacgctgctcagcctgaccttcatcaagaccaccctgtccctccactacgcctggaagacgatggccatggtcctgagcatcgtgtccctgttccccctctgcctgagcaccacctcccagaagaccacgtggctgcccgtgctcctggggagcctgggctgcaagccgctcaccatgttcctgatcgcggagaacaagatctgggggcgcaagtcctggcccctgaacgagggcatcatggccgtcggggtggtgagcatcctcctgagctccctgctcaagaacgacgtccccctggccggccccctgatcgccggcgggatgctcatcgcctgctacgtgatcagcggctccagcgcggacctgtccctggagaaggccgccgaggtgagctgggaggaggaggccgagcactccggggccagccacaacatcctcgtcgaggtgcaggacgacggcaccatgaagatcaaggacgaggagcgggacgacaccctgaccatcctgctcaaggcgacgctgctggccgtgtccggggtctacccgctcagcatccccgccaccctgttcgtgtggtacttctggcagaagaagaagcagcgctccggcgtgctgtgggacacccccagcccgcccgaggtcgagcgggccgtgctggacgacggcatctaccgcatcatgcagcgggggctcctgggccgctcccaggtgggggtcggcgtgttccaggagaacgtgttccacaccatgtggcacgtcacgcgcggggccgtgctgatgtaccagggcaagcgcctcgagcccagctgggcgtccgtgaagaaggacctgatcagctacggcgggggctggcggctgcaggggtcctggaacaccggcgaggaggtccaggtgatcgccgtggagcccgggaagaaccccaagaacgtccagaccgcccccggcaccttcaagacgcccgagggcgaggtgggggccatcgccctcgacttcaagcccggcaccagcgggtcccccatcgtgaaccgcgagggcaagatcgtcggcctgtacgggaacggcgtggtgaccaccagcgggacgtacgtcagcgcgatcgcccaggccaaggcctcccaggagggcccgctgcccgagatcgaggacgaggtgttccggaagcgcaacctcaccatcatggacctgcaccccgggagcggcaagacccggcgctacctgccggcgatcgtgcgggaggccatcaagcgcaagctccggaccctgatcctggcccccacgcgcgtcgtggcctccgagatggccgaggcgctcaagggcatgcccatccgctaccagaccaccgccgtcaagagcgagcacaccgggaaggagatcgtcgacctgatgtgccacgccacgttcaccatgcggctgctctcccccgtgcgcgtgccgaactacaacatgatcatcatggacgaggcccacttcaccgaccccagctccatcgccgcgcggggctacatcagcacccgcgtcgggatgggcgaggccgccgccatcttcatgacggccacgccgcccgggtccgtggaggcgttcccgcagagcaacgccgtgatccaggacgaggagcgggacatccccgagcgctcctggaacagcggctacgagtggatcaccgacttccccggcaagaccgtctggttcgtgccctccatcaagagcgggaacgacatcgccaactgcctgcggaagaacggcaagcgcgtgatccagctgtcccggaagacgttcgacaccgagtaccagaagaccaagaacaacgactgggactacgtcgtgaccacggacatcagcgagatgggggccaacttccgcgcggaccgggtgatcgacccgcgccggtgcctcaagcccgtcatcctgaaggacggccccgagcgcgtgatcctggccgggcccatgccggtcaccgtggcctccgccgcccagcggcgcggccggatcggccgcaaccacaacaaggagggggaccagtacatctacatgggccagcccctcaacaacgacgaggaccacgcgcactggaccgaggccaagatgctgctggacaacatcaacacccccgaggggatcatccccgccctcttcgagccggagcgggagaagtccgccgccatcgacggcgagtaccgcctgcgcggggaggcgcggaagacgttcgtggagctgatgcgccggggcgacctccccgtctggctgtcctacaaggtggccagcgagggcttccagtacagcgaccgccggtggtgcttcgacggggagcgcaacaaccaggtgctggaggagaacatggacgtcgagatctggaccaaggagggcgagcggaagaagctccgcccccggtggctggacgcccgcacctactccgaccccctggccctccgggagttcaaggagttcgccgcggggcgccggagcgtgtccggcgacctgatcctggagatcggcaagctcccgcagcacctgacccagcgcgcccagaacgccctggacaacctcgtgatgctgcacaacagcgagcagggcgggcgggcctaccgccacgcgatggaggagctgcccgacacgatcgagaccctcatgctgctggccctcatcgccgtcctgaccgggggcgtgaccctgttcttcctctccgggcggggcctgggcaagaccagcatcgggctgctctgcgtgatggcctccagcgtcctgctgtggatggcctccgtggagccccactggatcgcggccagcatcatcctcgagttcttcctgatggtgctgctcatccccgagccggaccgccagcggacgccccaggacaaccagctggcctacgtcgtgatcggcctcctcttcatcatcctgaccgtggccgccaacgagatggggctgctcgagaccaccaagaaggacctgggcatcgggcacgtcgcggtggagaaccaccaccacgccacgatgctggacgtggacctccaccccgcctccgcctggaccctgtacgccgtcgcgaccaccatcatcacgccgatgatgcgccacaccatcgagaacaccaccgccaacatcagcctgacggccatcgccaaccaggccgcgatcctcatgggcctggacaagggctggcccatctccaagatggacatcggggtgcccctgctcgccctgggctgctacagccaggtgaaccccctgaccctcaccgccgccgtcctgatgctggtggcgcactacgccatcatcgggccgggcctccaggccaaggccacccgggaggcccagaagcgcacggcggccgggatcatgaagaaccccaccgtggacggcatcgtcgccatcgacctggaccccgtggtgtacgacgccaagttcgagaagcagctgggccagatcatgctcctgatcctgtgcacctcccagatcctcctgatgcgcaccacgtgggccctgtgcgagagcatcaccctcgcgaccgggcccctgaccacgctgtgggagggctccccggggaagttctggaacaccaccatcgccgtcagcatggccaacatcttccggggctcctacctcgccggcgccgggctggcgttcagcctgatgaagtccctcggcgggggccgccgggggaccggcgcccagggcgagacgctgggggagaagtggaagcgccagctgaaccagctctccaagagcgagttcaacatctacaagcggtccggcatcatggaggtggaccgcagcgaggccaaggaggggctgaagcggggcgagaccacccgccacgccgtgtcccgggggaccgcgaagctgcgctggttcgtcgagcggaacctggtgaagcccgagggcaaggtgatcgacctcggctgcgggcgcggcgggtggagctactactgcgccggcctgaagaaggtcacggaggtgaaggggtacaccaagggcggccccgggcacgaggagcccatcccgatggccacctacggctggaacctggtgaagctccactccgggaaggacgtcttcttcacgccgcccgagaagtgcgacacgctgctgtgcgacatcggcgagagctcccccaacccgaccatcgaggaggggcggaccctccgcgtgctgaagatggtggagccctggctgcggggcaaccagttctgcatcaagatcctcaacccctacatgcccagcgtcgtggagaccctggagcagatgcagcgcaagcacggcgggatgctggtgcggaacccgctctcccgcaacagcacccacgagatgtactgggtctcctgcggcacggggaacatcgtgagcgccgtgaacatgacctcccggatgctgctgaaccgcttcaccatggcccaccgcaagcccacctacgagcgggacgtcgacctcggcgcgggcacgcgccacgtggccgtggagcccgaggtcgccaacctggacatcatcgggcagcggatcgagaacatcaagcacgagcacaagagcacctggcactacgacgaggacaacccctacaagacctgggcctaccacggctcctacgaggtgaagccgagcgggtccgccagcagcatggtcaacggcgtggtgaagctgctcaccaagccctgggacgtcatccccatggtgacgcagatcgcgatgaccgacaccacccccttcgggcagcagcgcgtgttcaaggagaaggtcgacacgcggaccccgaaggccaagcgcggcaccgcccagatcatggaggtgaccgcccggtggctgtggggcttcctgtcccgcaacaagaagccccggatctgcacgcgcgaggagttcacccggaaggtgcgcagcaacgccgcgatcggggccgtcttcgtggacgagaaccagtggaactccgccaaggaggccgtggaggacgagcggttctgggacctcgtccagaaggagcgcgagctgcacaagcagggcaagtgcgcgacctgcgtgtacaacatgatggggaagcgggagaagaagctgggcgagttcgggaaggccaagggcagccgcgccatctggtacatgtggctcggcgcccggttcctggagttcgaggccctggggttcatgaacgaggaccactggttctcccgcgagaacagcctctccggcgtggagggggagggcctgcacaagctggggtacatcctccgggacatcagcaagatccccggcggcaacatgtacgcggacgacaccgccgggtgggacacgcgcatcaccgaggacgacctgcagaacgaggccaagatcaccgacatcatggagccggagcacgccctgctcgccacctccatcttcaagctgacgtaccagaacaaggtcgtgcgggtgcagcgccccgcgaagaacggcaccgtcatggacgtgatcagccgccgggaccagcgcgggtccggccaggtgggcacctacgggctgaacaccttcacgaacatggaggcccagctcatccggcagatggagagcgagggcatcttcctgccctccgagctggagacccccaacctcgccgagcgcgtcctggactggctggagaagtacggggtggagcggctcaagcgcatggccatcagcggcgacgactgcgtggtcaagccgatcgacgaccggttcgccaccgcgctgaccgccctgaacgacatggggaaggtgcgcaaggacatcccccagtgggagccctccaagggctggaacgactggcagcaggtccccttctgcagccaccacttccaccagctcatcatgaaggacggccgggagatcgtcgtgccgtgccgcaaccaggacgagctggtggggcgggcccgcgtctcccagggcgccgggtggagcctgcgggagacggcctgcctcggcaagagctacgcgcagatgtggcagctgatgtacttccaccgccgggacctgcgcctcgccgccaacgccatctgctccgcggtgcccgtggactgggtccccaccagccggaccacctggtccatccacgcccaccaccagtggatgacgaccgaggacatgctgagcgtgtggaaccgcgtgtggatcgaggagaacccctggatggaggacaagacccacgtctccagctggggcgacgtgccgtacctgggcaagcgggaggaccagtggtgcggctccctcatcgggctgaccgcccgcgccacctgggccagcaacatccaggtggcgatcaaccaggtccgccggctgatcggcaacgagaactacctcgactacatgacgtccatgaagcgcttcaagaacgagggggaccccgagggcgccctgtggtga

SEQ ID NO: 8559 - RNA, 9879 nt, synthetic construct
  misc_feature 1..9879: note = derived and/or modified CDS sequence (opt1) from DENV-1__FJ898393__SS-prME
  source 1..9879: mol_type = other RNA
agcgtgaccatgctgctcatgctgatgcccaccgccctggccttccacctcaccacccgcggcggggagccccacatgatcgtgaccaagcaggagcggggcaagagcctgctgttcaagaccagcgcgggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtgacctacgggacctgcagccagacgggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccgtgggcggcgtgttcaccagcgtcgggaagctggtgcaccagatcttcggcaccgcctacggggtcctgttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggccgactccgggtgcgtcatcaactggaagggccgggagctcaagtgcgggagcggcatcttcgtgacgaacgaggtgcacacctggaccgagcagtacaagttccaggcggacagcccgaagcgcctgtccgccgccatcggccgggcctgggaggagggggtctgcggcatccgcagcgccacccggctggagaacatcatgtggaagcagatctccaacgagctcaaccacatcctgctggagaacgacatgaagttcaccgtggtggtcggggacgtggtgggcatcctcgcgcaggggaagaagatgatccgcccccagcccatggagcacaagtacagctggaagtcctggggcaaggccaagatcatcggcgccgacgtccagaacacgaccttcatcatcgacgggcccaacaccccggagtgccccgacgaccagcgggcctggaacatctgggaggtggaggactacggcttcgggatcttcaccacgaacatctggctgaagctgcgcgacagctacacccaggtgtgcgaccaccggctcatgtccgcggccatcaaggacagcaaggccgtccacgccgacatgggctactggatcgagtccgagaagaacgagacctggaagctggcccgcgcgagcttcatcgaggtgaagacctgcatctggcccaagtcccacacgctgtggagcaacggcgtgctcgagtccgagatgatcatccccaagatctacgggggcccgatcagccagcacaactaccggcccgggtacttcacccagaccgccggcccctggcacctggggaagctggagctcgacttcgacctgtgcgagggcaccacggtcgtggtggacgagcactgcggcaaccgcgggccgtccctgcggaccaccaccgtcacgggcaagatcatccacgagtggtgctgccgcagctgcaccctgccgcccctccggttcaagggggaggacggctgctggtacgggatggagatccgccccgtgaaggagaaggaggagaacctggtgaagtccatggtcagcgccggcagcggcgaggtggactccttcagcctcgggctgctgtgcatctccatcatgatcgaggaggtgatgcggagccgctggtcccggaagatgctcatgaccggcaccctggccgtcttcctgctcctgatcatggggcagctgacgtggaacgacctcatccgcctgtgcatcatggtgggcgccaacgcgagcgaccgcatggggatgggcaccacctacctggccctcatggccaccttcaagatgcggccgatgttcgccgtgggcctgctgttccgccggctcacgtcccgcgaggtcctgctgctcaccatcgggctgagcctggtggcctccgtcgagctccccaacagcctggaggagctgggcgacgggctcgcgatgggcatcatgatcctgaagctgctcaccgacttccagtcccaccagctgtgggccaccctgctcagcctgacgttcatcaagaccaccctgtccctccactacgcctggaagaccatggccatggtgctgagcatcgcgtccctgttccccctctgcctgagcacgacctcccagaagaccacctggctgcccgtgctcctgggcagcctggggtgcaagccgctcacgatgttcctgatcaccgagaccaagatctggggccggaagtcctggcccctgaacgaggggatcatggccgtcggcgtggtgagcatcctcctgagctccctgctcaagaacgacgtccccctggccgggcccctgatcgccggcggcatgctcatcgcctgctacgtgatcagcgggtccagcgcggacctgtccctggagaaggccgccgaggtgagctgggaggaggaggccgagcactccggcgccagccacaacatcctcgtcgtggtgcaggacgacgggaccatgaagatcaaggacgaggagcgcgacgacaccctgacgatcctgctcaaggcgaccctgctggccgtctccggcgtgtacccgctcagcatccccgccaccctgttcgtgtggtacttctggcagaagaagaagcagcggtccggggtcctgtgggacacccccagcccgcccgaggtggagcgcgccgtgctggacgacggcatctaccggatcatgcagcgcggcctcctggggcggtcccaggtcggcgtgggggtgttccaggagaacgtcttccacacgatgtggcacgtgacccgcggcgccgtgctgatgtaccaggggaagcggctcgagcccagctgggcgtccgtcaagaaggacctgatcagctacggcggcgggtggcgcctgcagggctcctggaacaccggggaggaggtccaggtgatcgccgtcgagcccggcaagaaccccaagaacgtgcagaccgcccccgggacgttcaagacccccgagggcgaggtgggcgccatcgccctcgacttcaagcccgggaccagcggctcccccatcgtcaaccgggaggggaagatcgtgggcctgtacggcaacggggtggtcaccacgagcggcacctacgtgagcgcgatcgcccaggccaaggcctcccaggaggggccgctgcccgagatcgaggacgaggtgttccgcaagcggaacctcaccatcatggacctgcaccccggcagcgggaagacccgccggtacctgccggcgatcgtccgcgaggccatcaagcggaagctccgcacgctgatcctggcccccacccgcgtggtggcctccgagatggccgaggcgctcaagggcatgcccatccggtaccagaccaccgccgtcaagagcgagcacacgggcaaggagatcgtggacctgatgtgccacgccaccttcaccatgcgcctgctctcccccgtgcgggtcccgaactacaacatgatcatcatggacgaggcccacttcaccgaccccagctccatcgccgcgcgcgggtacatcagcacgcgggtgggcatgggggaggccgccgccatcttcatgaccgccacgccgcccggctccgtggaggcgttcccgcagagcaacgccgtcatccaggacgaggagcgcgacatccccgagcggtcctggaacagcgggtacgagtggatcaccgacttccccggcaagacggtgtggttcgtgccctccatcaagagcggcaacgacatcgccaactgcctgcgcaagaacgggaagcgggtcatccagctgtcccgcaagaccttcgacaccgagtaccagaagaccaagaacaacgactgggactacgtggtgacgaccgacatcagcgagatgggcgccaacttccgggcggaccgcgtcatcgacccgcggcgctgcctcaagcccgtgatcctgaaggacgggcccgagcgggtcatcctggccggccccatgccggtgaccgtggcctccgccgcccagcgccgggggcgcatcggccggaaccacaacaaggagggcgaccagtacatctacatggggcagcccctcaacaacgacgaggaccacgcgcactggaccgaggccaagatgctgctggacaacatcaacacgcccgagggcatcatccccgccctcttcgagccggagcgcgagaagtccgccgccatcgacggggagtaccgcctgcggggcgaggcgcgcaagaccttcgtcgagctgatgcggcgcggggacctccccgtgtggctgtcctacaaggtggccagcgagggcttccagtacagcgaccggcgctggtgcttcgacggcgagcggaacaaccaggtcctggaggagaacatggacgtggagatctggaccaaggagggggagcgcaagaagctccggccccgctggctggacgcccggacctactccgaccccctggccctccgcgagttcaaggagttcgccgcgggccggcgcagcgtgtccggggacctgatcctggagatcggcaagctcccgcagcacctgacgcagcgggcccagaacgccctggacaacctcgtcatgctgcacaacagcgagcagggcgggcgcgcctaccggcacgcgatggaggagctgcccgacaccatcgagaccctcatgctgctggccctcatcgccgtgctgaccggcggggtgaccctgttcttcctctccggccgcgggctgggcaagacgagcatcggcctgctctgcgtcatggcctccagcgtgctgctgtggatggcctccgtggagccccactggatcgcggccagcatcatcctcgagttcttcctgatggtcctgctcatccccgagccggaccggcagcgcacgccccaggacaaccagctggcctacgtggtgatcgggctcctcttcatgatcctgaccgtcgccgccaacgagatgggcctgctcgagaccacgaagaaggacctggggatcggccacgtggcggtggagaaccaccaccacgccaccatgctggacgtcgacctccaccccgcctccgcctggaccctgtacgccgtggcgaccacgatcatcaccccgatgatgcggcacaccatcgagaacaccacggccaacatcagcctgaccgccatcgccaaccaggccgcgatcctcatggggctggacaagggctggcccatctccaagatggacatcggcgtgcccctgctcgccctggggtgctacagccaggtcaaccccctgaccctcaccgccgccgtgctgatgctggtggcgcactacgccatcatcggcccggggctccaggccaaggccacgcgcgaggcccagaagcgcaccgcggccggcatcatgaagaaccccaccgtcgacgggatcgtggccatcgacctggaccccgtggtctacgacgccaagttcgagaagcagctgggccagatcatgctcctgatcctgtgcacctcccagatcctcctgatgcggacgacctgggccctgtgcgagagcatcaccctcgcgaccggccccctgacgaccctgtgggaggggtccccgggcaagttctggaacaccaccatcgccgtgagcatggccaacatcttccgcgggtcctacctcgccggcgccggcctggcgttcagcctgatgaagtccctcgggggcgggcggcgcggcacgggggcccagggcgagaccctgggcgagaagtggaagcggcagctgaaccagctctccaagagcgagttcaacatctacaagcgctccgggatcatggaggtggaccggagcgaggccaaggagggcctgaagcgcggggagaccacccggcacgccgtctcccgcggcacggcgaagctgcggtggttcgtggagcgcaacctggtgaagcccgaggggaaggtcatcgacctcggctgcggccgcggcgggtggagctactactgcgccgggctgaagaaggtgaccgaggtgaaggggtacaccaagggcgggcccggccacgaggagcccatcccgatggccacctacgggtggaacctggtcaagctccactccggcaaggacgtgttcttcacgccgcccgagaagtgcgacaccctgctgtgcgacatcggggagagctcccccaacccgaccatcgaggagggccgcaccctccgggtgctgaagatggtcgagccctggctgcgcgggaaccagttctgcatcaagatcctcaacccctacatgcccagcgtggtggagaccctggagcagatgcagcggaagcacggcggcatgctggtccgcaacccgctctcccggaacagcacgcacgagatgtactgggtgtcctgcgggaccggcaacatcgtgagcgccgtcaacatgacctcccgcatgctgctgaaccgcttcaccatggcccaccggaagcccacgtacgagcgcgacgtggacctcggggcgggcacccggcacgtggccgtcgagcccgaggtggccaacctggacatcatcggccagcgcatcgagaacatcaagcacgagcacaagagcacctggcactacgacgaggacaacccctacaagacctgggcctaccacgggtcctacgaggtcaagccgagcggctccgccagcagcatggtgaacggggtggtcaagctgctcacgaagccctgggacgtgatccccatggtgacccagatcgcgatgaccgacaccacgcccttcggccagcagcgggtcttcaaggagaaggtggacacccgcaccccgaaggccaagcgggggaccgcccagatcatggaggtgacggcccgctggctgtggggcttcctgtcccggaacaagaagccccgcatctgcacccgggaggagttcacccgcaaggtccggagcaacgccgcgatcggcgccgtgttcgtggacgagaaccagtggaactccgccaaggaggccgtcgaggacgagcgcttctgggacctcgtgcagaaggagcgggagctgcacaagcaggggaagtgcgcgacctgcgtgtacaacatgatgggcaagcgcgagaagaagctgggggagttcggcaaggccaaggggagccgggccatctggtacatgtggctcggcgcccgcttcctggagttcgaggccctgggcttcatgaacgaggaccactggttctcccgggagaacagcctctccggggtcgagggcgaggggctgcacaagctgggctacatcctccgcgacatcagcaagatccccgggggcaacatgtacgcggacgacacggccggctgggacacccggatcaccgaggacgacctgcagaacgaggccaagatcaccgacatcatggagccggagcacgccctgctcgccacgtccatcttcaagctgacctaccagaacaaggtggtgcgcgtccagcgccccgcgaagaacgggaccgtgatggacgtgatcagccggcgcgaccagcggggctccgggcaggtcggcacctacggcctgaacacgttcaccaacatggaggcccagctcatccgccagatggagagcgaggggatcttcctgccctccgagctggagacccccaacctcgccgagcgggtgctggactggctggagaagtacggcgtggagcgcctcaagcggatggccatcagcggggacgactgcgtcgtgaagccgatcgacgaccgcttcgccaccgcgctgacggccctgaacgacatgggcaaggtgcggaaggacatcccccagtgggagccctccaaggggtggaacgactggcagcaggtccccttctgcagccaccacttccaccagctcatcatgaaggacggccgcgagatcgtggtgccgtgccggaaccaggacgagctggtcggccgcgcccgggtgtcccagggggccggctggagcctgcgcgagaccgcctgcctcggcaagagctacgcgcagatgtggcagctgatgtacttccaccggcgcgacctgcggctcgccgccaacgccatctgctccgcggtgcccgtcgactgggtgcccaccagccgcaccacgtggtccatccacgcccaccaccagtggatgaccaccgaggacatgctgagcgtgtggaaccgggtctggatcgaggagaacccctggatggaggacaagacccacgtgtccagctggggcgacgtgccgtacctggggaagcgcgaggaccagtggtgcggctccctcatcggcctgaccgcccgcgccacgtgggccagcaacatccaggtcgcgatcaaccaggtgcggcgcctgatcgggaacgagaactacctcgactacatgacctccatgaagcggttcaagaacgagggcgaccccgagggggccctgtggtga

SEQ ID NO: 8560 - RNA, 9879 nt, synthetic construct
  misc_feature 1..9879: note = derived and/or modified CDS sequence (opt1) from DENV-1__FJ898394__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgccggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtgacctacgggacctgcagccagaccggcgagcaccggcgcgacaagcggagcgtggccctcgcgccccacgtgggcctggggctggagacccgcaccgagacctggatgtccagcgagggcgcctggaagcagatccagcgggtggagacgtgggccctccgccacccggggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgcccgacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacgccccaggagacgtggaaccggcaggacctgctggtgaccttcaagaccgcccacgcgaagaagcaggaggtggtcgtgctcggctcccaggagggcgccatgcacaccgccctgacgggggccaccgagatccagaccagcggcaccacgaccatcttcgccgggcacctgaagtgccgcctcaagatggacaagctgaccctgaagggcatgtcctacgtgatgtgcaccgggagcttcaagctcgagaaggaggtcgcggagacgcagcacggcaccgtgctggtgcagatcaagtacgagggcaccgacgccccctgcaagatcccgttctccacccaggacgagaagggggtcacgcagaacggccggctgatcaccgccaaccccatcgtgaccgacaaggagaagcccgtgaacatcgaggccgagcccccgttcggggagagctacatcgtcatcggcgcgggcgagaaggccctgaagctctcctggttcaagaaggggagctccatcggcaagatgttcgaggccaccgcccgcggggcccggcgcatggcgatcctgggcgacacggcctgggacttcgggagcatcggcggcgtgttcacctccgtggggaagctggtccaccagatcttcggcaccgcctacggggtcctgttcagcggcgtgtcctggaccatgaagatcgggatcggcgtcctgctgacgtggctcggcctgaacagccgctccaccagcctgtccatgacctgcatcgccgtggggctcgtgaccctgtacctgggcgtcatggtgcaggccgacagcgggtgcgtgatcaactggaagggccgggagctcaagtgcgggtccggcatcttcgtcacgaacgaggtgcacacctggaccgagcagtacaagttccaggcggacagccccaagcgcctgagcgccgccatcggcaaggcctgggaggagggggtgtgcggcatccggtccgccacccgcctggagaacatcatgtggaagcagatcagcaacgagctcaaccacatcctgctggagaacgacatgaagttcaccgtcgtggtgggggacgtcgtgggcatcctcgcgcaggggaagaagatgatccggccccagcccatggagcacaagtactcctggaagtcctggggcaaggccaagatcatcggcgccgacgtgcagaacacgaccttcatcatcgacgggccgaacacccccgagtgccccgacgaccagcgcgcctggaacatctgggaggtcgaggactacggcttcgggatcttcaccacgaacatctggctgaagctgcgggactcctacacccaggtgtgcgaccaccgcctcatgagcgcggccatcaaggactccaaggccgtgcacgccgacatgggctactggatcgagagcgagaagaacgagacctggaagctggcccgggcgtccttcatcgaggtcaagacctgcatctggcccaagagccacacgctgtggtccaacggcgtgctcgagagcgagatgatcatcccgaagatctacgggggccccatctcccagcacaactaccgccccgggtacttcacccagaccgccggcccgtggcacctggggaagctggagctcgacttcgacctgtgcgagggcaccacggtggtcgtggacgagcactgcggcaaccgggggcccagcctgcgcaccaccaccgtgacgggcaagatcatccacgagtggtgctgccggtcctgcaccctgccgcccctccgcttcaagggggaggacggctgctggtacgggatggagatccggccggtcaaggagaaggaggagaacctggtcaagagcatggtgtccgccggcagcggcgaggtcgacagcttctccctcgggctgctgtgcatcagcatcatgatcgaggaggtgatgcgctcccggtggagccgcaagatgctcatgaccggcaccctggccgtgttcctgctcctgatcatggggcagctgacgtggaacgacctcatccggctgtgcatcatggtcggcgccaacgtgtccgaccgcatggggatgggcaccacctacctggcgctcatggccaccttcaagatgcgccccatgttcgccgtgggcctgctgttccggcgcctcacgagccgggaggtcctgctgctcaccatcgggctgtccctggtggccagcgtcgagctccccaactccctggaggagctgggcgacgggctcgccatgggcatcatgatcctgaagctgctcaccgacttccagagccaccagctgtgggcgaccctgctctccctgacgttcatcaagaccaccctgagcctccactacgcctggaagaccatggccatggtgctgtccatcgtgagcctgttccccctctgcctgtccacgaccagccagaagaccacctggctgccggtcctcctgggctccctggggtgcaagcccctcacgatgttcctgatcgccgagaacaagatctggggccgcaagagctggcccctgaacgaggggatcatggcggtgggcgtggtctccatcctcctgagcagcctgctcaagaacgacgtgcccctggccgggccgctgatcgccggcggcatgctcatcgcctgctacgtgatctccgggagctccgccgacctgagcctggagaaggcggccgaggtctcctgggaggaggaggccgagcacagcggcgcctcccacaacatcctcgtggaggtgcaggacgacgggaccatgaagatcaaggacgaggagcgggacgacaccctgaccatcctgctcaaggccaccctgctggcggtcagcggcgtgtaccccctctccatccccgccacgctgttcgtgtggtacttctggcagaagaagaagcagcgcagcggggtcctgtgggacaccccctccccgcccgaggtggagcgggccgtgctggacgacggcatctaccgcatcatgcagcggggcctcctggggcgcagccaggtcggcgtgggggtgttccaggagaacgtcttccacaccatgtggcacgtgacccggggcgccgtgctgatgtaccaggggaagcgcctcgagccctcctgggccagcgtcaagaaggacctgatctcctacggcggcgggtggcggctgcagggcagctggaacacgggggaggaggtccaggtgatcgcggtcgagcccggcaagaacccgaagaacgtgcagaccgcccccgggaccttcaagacccccgagggcgaggtgggcgccatcgccctcgacttcaagcccgggacgtccggcagcccgatcgtcaaccgcgaggggaagatcgtgggcctgtacggcaacggggtggtcaccacctccggcacctacgtgagcgccatcgcgcaggccaaggccagccaggaggggcccctgcccgagatcgaggacgaggtgttccggaagcgcaacctcacgatcatggacctgcacccgggctccgggaagacccggcgctacctgcccgccatcgtccgggaggcgatcaagcgcaagctccggaccctgatcctggcccccacccgcgtggtggccagcgagatggccgaggccctcaagggcatgcccatccgctaccagacgaccgcggtcaagtccgagcacaccggcaaggagatcgtggacctgatgtgccacgccaccttcacgatgcggctgctcagcccggtgcgcgtccccaactacaacatgatcatcatggacgaggcccacttcaccgacccctccagcatcgccgcccgggggtacatctccacccgcgtgggcatgggggaggcggccgccatcttcatgaccgccacgcccccgggcagcgtggaggccttcccccagtccaacgcggtcatccaggacgaggagcgggacatccccgagcgcagctggaactccgggtacgagtggatcaccgacttccccggcaagaccgtgtggttcgtgccgagcatcaagtccggcaacgacatcgccaactgcctgcggaagaacgggaagcgcgtcatccagctgagccggaagaccttcgacacggagtaccagaagaccaagaacaacgactgggactacgtggtgaccaccgacatctccgagatgggcgccaacttccgcgccgaccgggtcatcgacccccgccggtgcctcaagcccgtgatcctgaaggacgggcccgagcgcgtcatcctggcgggcccgatgcccgtgacggtggccagcgccgcccagcggcgcgggcggatcggccgcaaccacaacaaggagggcgaccagtacatctacatggggcagcccctcaacaacgacgaggaccacgcccactggaccgaggcgaagatgctgctggacaacatcaacacccccgagggcatcatcccggccctcttcgagcccgagcgggagaagtccgccgccatcgacggggagtaccgcctgcgcggcgaggcccggaagaccttcgtcgagctgatgcgccgcggggacctccccgtgtggctgagctacaaggtggcgtccgagggcttccagtacagcgaccgccggtggtgcttcgacggcgagcgcaacaaccaggtcctggaggagaacatggacgtggagatctggacgaaggagggggagcggaagaagctccgcccccggtggctggacgcccgcacctacagcgacccgctggccctccgggagttcaaggagttcgccgccggccgccggtccgtgagcggggacctgatcctggagatcggcaagctcccccagcacctgacccagcgcgcgcagaacgccctggacaacctcgtcatgctgcacaactccgagcagggcgggcgggcctaccgccacgccatggaggagctgcccgacaccatcgagacgctcatgctgctggcgctcatcgccgtgctgaccggcggggtgaccctgttcttcctcagcggccgggggctgggcaagacctccatcggcctgctctgcgtcatggccagctccgtgctgctgtggatggccagcgtggagccccactggatcgccgcgtccatcatcctcgagttcttcctgatggtcctgctcatcccggagcccgaccgccagcggacgccccaggacaaccagctggcctacgtggtgatcgggctcctcttcatgatcctgacggtcgccgccaacgagatgggcctgctcgagaccaccaagaaggacctggggatcggccacgtggccgtggagaaccaccaccacgcgaccatgctggacgtcgacctccacccggccagcgcctggacgctgtacgccgtggccaccaccatcatcacccccatgatgcgccacacgatcgagaacaccaccgcgaacatctccctgaccgccatcgccaaccaggccgccatcctcatggggctggacaagggctggcccatcagcaagatggacatcggcgtgcccctgctcgcgctggggtgctactcccaggtcaacccgctgacgctcaccgccgccgtgctgatgctggtggcccactacgcgatcatcggccccgggctccaggccaaggccacccgggaggcccagaagcgcaccgccgcgggcatcatgaagaaccccacggtcgacgggatcgtggccatcgacctggaccccgtggtctacgacgccaagttcgagaagcagctgggccagatcatgctcctgatcctgtgcaccagccagatcctcctgatgcgcaccacctgggccctgtgcgagtccatcacgctcgccaccggcccgctgaccaccctgtgggaggggagccccggcaagttctggaacacgaccatcgcggtgtccatggccaacatcttccgggggagctacctcgccggcgccggcctggccttctccctgatgaagtccctcgggggcgggcgccggggcaccggggcgcagggcgagaccctgggcgagaagtggaagcgccagctgaaccagctcagcaagtccgagttcaacatctacaagcggagcgggatcatggaggtggaccgctccgaggccaaggagggcctgaagcgcggggagacgacccgccacgccgtcagccggggcaccgccaagctgcgctggttcgtggagcggaacctggtgaagcccgaggggaaggtcatcgacctcggctgcggccgcgggggctggtcctactactgcgcggggctgaagaaggtgaccgaggtgaagggctacacgaagggcgggcccggccacgaggagccgatccccatggccacctacgggtggaacctggtcaagctccacagcggcaaggacgtgttcttcacgccgcccgagaagtgcgacaccctgctgtgcgacatcggggagtccagcccgaaccccacgatcgaggagggccggaccctccgcgtgctgaagatggtcgagccctggctgcgggggaaccagttctgcatcaagatcctcaacccctacatgccgtccgtggtggagaccctggagcagatgcagcgcaagcacggcggcatgctggtccggaaccccctcagccgcaactccacccacgagatgtactgggtgagctgcgggaccggcaacatcgtgtccgccgtcaacatgacgagccggatgctgctgaaccgcttcaccatgacccaccgcaagcccacctacgagcgggacgtggacctcggggccggcacgcgccacgtggccgtcgagcccgaggtggcgaacctggacatcatcggccagcggatcgagaacatcaagcacgagcacaagtccacctggcactacgacgaggacaacccgtacaagacctgggcctaccacgggagctacgaggtcaagccctccggcagcgcctccagcatggtgaacggggtggtcaagctgctcaccaagccctgggacgtgatccccatggtgacgcagatcgccatgaccgacaccaccccgttcggccagcagcgcgtcttcaaggagaaggtggacacgcggacccccaaggccaagcgcgggaccgcgcagatcatggaggtgaccgcccggtggctgtggggcttcctgagccgcaacaagaagccccggatctgcacgcgcgaggagttcacccggaaggtccgctccaacgccgccatcggcgccgtgttcgtggacgagaaccagtggaacagcgcgaaggaggccgtcgaggacgagcggttctgggacctcgtgcagaaggagcgcgagctgcacaagcaggggaagtgcgcgacctgcgtgtacaacatgatgggcaagcgggagaagaagctgggggagttcggcaaggccaaggggtcccgcgcgatctggtacatgtggctcggcgcccggttcctggagttcgaggccctgggcttcatgaacgaggaccactggttcagccgcgagaactccctcagcggggtcgagggcgaggggctgcacaagctgggctacatcctccgggacatctccaagatccccggcgggaacatgtacgccgacgacaccgccgggtgggacacgcgcatcaccgaggacgacctgcagaacgaggcgaagatcaccgacatcatggagcccgagcacgccctgctcgccaccagcatcttcaagctgacgtaccagaacaaggtggtgcgggtccagcgccccgccaagaacgggaccgtgatggacgtgatctcccgccgggaccagcgcggcagcgggcaggtcggcacctacggcctgaacaccttcacgaacatggaggcccagctcatccggcagatggagtccgaggggatcttcctgcccagcgagctggagaccccgaacctcgcggagcgcgtgctggactggctggagaagcacggcgtggagcggctcaagcgcatggccatctccggggacgactgcgtcgtgaagcccatcgacgaccggttcgccaccgccctgaccgccctgaacgacatgggcaaggtgcgcaaggacatcccccagtgggagcccagcaaggggtggaacgactggcagcaggtcccgttctgctcccaccacttccaccagctcatcatgaaggacggccgggagatcgtggtgccctgccgcaaccaggacgagctggtcggccgggcgcgcgtgagccagggggccggctggtccctgcgggagacggcctgcctcggcaagagctacgcccagatgtggcagctgatgtacttccaccgccgggacctgcgcctcgccgcgaacgccatctgcagcgccgtgcccgtcgactgggtgcccacctcccggaccacctggagcatccacgcccaccaccagtggatgacgaccgaggacatgctgtccgtgtggaaccgcgtctggatcgaggagaacccgtggatggaggacaagacccacgtgagctcctggggcgacgtgccctacctggggaagcgggaggaccagtggtgcggcagcctcatcggcctgaccgcgcgcgccacctgggcctccaacatccaggtcgccatcaaccaggtgcgccggctgatcgggaacgagaactacctcgactacatgacgagcatgaagcgcttcaagaacgagggcgaccccgagggggccctgtggtga

SEQ ID NO: 8561 - RNA, 9879 nt, synthetic construct
  misc_feature 1..9879: note = derived and/or modified CDS sequence (opt1) from DENV-1__GQ199838__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgcgggggtgaacatgtgcaccctcatcgccatggacctgggggagctgtgcgaggacaccatgacctacaagtgcccccgcatcaccgaggccgagcccgacgacgtggactgctggtgcaacgccaccgacacctgggtgacctacgggacctgcagccagacgggggagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgctggtcgaccggggctgggggaacggctgcggcctgttcggcaaggggagcctgatcacgtgcgccaagttcaagtgcgtgaccaagctggagggcaagatcgtgcagtacgagaacctcaagtactccgtcatcgtgaccgtgcacacgggcgaccagcaccaggtcgggaacgagagcaccgagcacggcaccaccgcgaccatcacgccccaggcccccacctccgagatccagctgaccgactacggggccctgaccctcgactgcagcccccgcacgggcctggacttcaacgagatggtgctgctcaccatgaaggagaagtcctggctggtccacaagcagtggttcctggacctcccgctgccctggaccagcggggccagcacctcccaggagacgtggaaccggcaggacctgctcgtgaccttcaagaccgcccacgcgaagaagcaggaggtggtcgtgctgggcagccaggagggcgccatgcacaccgccctgacgggggccaccgagatccagacctccggcaccacgaccatcttcgccgggcacctcaagtgccgcctgaagatggacaagctgaccctcaagggcatgagctacgtgatgtgcaccgggtccttcaagctggagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctcaagctgagctggttcaagaaggggtccagcatcggcaagatgttcgaggccaccgcccgcggggcccggcgcatggcgatcctgggcgacacggcctgggacttcgggtccatcggcggcgtgttcaccagcgtggggaagctcgtccaccagatcttcggcaccgcctacggggtgctgttctccggcgtgagctggaccatgaagatcgggatcggcgtcctgctcacgtggctgggcctgaactcccgcagcacctccctcagcatgacctgcatcgccgtggggctggtgaccctgtacctcggcgtcatggtgcaggccgactccgggtgcgtgatcaactggaagggccgggagctgaagtgcgggagcggcatcttcgtcacgaacgaggtgcacacctggaccgagcagtacaagttccaggcggacagcccgaagcgcctgtccgccgccatcggcaaggcctgggaggagggggtgtgcggcatccggagcgccacccgcctcgagaacatcatgtggaagcagatctccaacgagctgaaccacatcctgctcgagaacgggatgaagttcaccgtcgtggtgggcgacgtcgtggggatcctggcgcagggcaagaagatgatccggccccagcccatggagcacaagtacagctggaagtcctggggcaaggccaagatcatcggggccgacgtgcagaacacgaccttcatcatcgacggccccaacaccccggagtgccccgacgaccagcgcgcctggaacatctgggaggtcgaggactacgggttcggcatcttcaccacgaacatctggctgaagctccgggacagctacacccaggtgtgcgaccaccgcctgatgtccgcggccatcaaggacagcaaggccgtgcacgccgacatgggctactggatcgagtccgagaagaacgagacctggaagctggcccgggcgagcttcatcgaggtcaagacctgcatctggcccaagtcccacacgctctggagcaacggggtgctggagtccgagatgatcatccccaagatctacggcgggccgatcagccagcacaactaccgccccggctacttcacccagaccgccgggccctggcacctgggcaagctcgagctggacttcgacctgtgcgagggcaccacggtggtcgtggacgagcactgcgggaaccggggcccgtccctccgcaccaccaccgtgacggggaagatcatccacgagtggtgctgccggagctgcaccctgccgcccctgcgcttcaagggcgaggacgggtgctggtacggcatggagatccggcccgtcaaggagaaggaggagaacctcgtgaagtccatggtgagcgccggcagcggggaggtcgactccttcagcctgggcctgctctgcacctccatcatgatcgaggaggtgatgcgcagccggtggtcccgcaagatgctgatgaccgggacgctggccgtgttcctcctgctgatcatgggccagctcacctggaacgacctgatccggctgtgcatcatggtcggggccaacgcgagcgaccgcatgggcatgggcaccacctacctcgccctgatggccacgttcaagatgcgcccgatgttcgccgtggggctcctcttccggcgcctgacctcccgggaggtgctgctcctgaccatcggcctgagcctcgtcgcctccgtggagctgcccaacagcctggaggagctcggggacggcctggcgatgggcatcatgatcctgaagctcctgaccgacttccagtcccaccagctgtgggccacgctcctgagcctgaccttcatcaagaccaccctctccctgcactacgcctggaagacgatggccatggtcctgagcatcgtgtccctcttccccctgtgcctgagcaccacctcccagaagaccacgtggctccccgtgctgctggggagcctcggctgcaagccgctgaccatgttcctgatcgcggagaacaagatctgggggcgcaagtcctggcccctcaacgagggcatcatggccgtcggggtggtgagcatcctgctgagctccctcctgaagaacgacgtccccctggccggccccctcatcgccggcgggatgctgatcgcctgctacgtgatcagcggctccagcgcggacctgtccctcgagaaggccgccgaggtgagctgggaggaggaggccgagcactccggggccagccacaacatcctggtcgaggtgcaggacgacggcaccatgaagatcaaggacgaggagcgggacgacaccctgaccatcctcctgaaggcgacgctgctcgccgtgtccggggtctacccgctgagcatccccgccaccctgttcgtgtggtacttctggcagaagaagaagcagcgctccggcgtgctgtgggacacccccagcccgcccgaggtcgagcgggccgtgctcgacgacggcatctaccgcatcatgcagcgggggctgctgggccgctcccaggtgggggtcggcgtgttccaggagaacgtgttccacaccatgtggcacgtcacgcgcggggccgtgctcatgtaccagggcaagcgcctggagcccagctgggcgtccgtgaagaaggacctgatcagctacggcgggggctggcggctccaggggtcctggaacaccggcgaggaggtccaggtgatcgccgtggagcccgggaagaaccccaagaacgtccagaccgcccccggcaccttcaagacgcccgagggcgaggtgggggccatcgccctggacttcaagcccggcaccagcgggtcccccatcgtgaaccgcgagggcaagatcgtcggcctgtacgggaacggcgtggtgaccaccagcgggacgtacgtcagcgcgatcgcccaggccaaggcctcccaggagggcccgctccccgagatcgaggacgaggtgttccggaagcgcaacctgaccatcatggacctgcaccccgggagcggcaagacccggcgctacctcccggcgatcgtgcgggaggccatcaagcgcaagctgcggaccctgatcctcgcccccacgcgcgtcgtggcctccgagatggccgaggcgctgaagggcatgcccatccgctaccagaccaccgccgtcaagagcgagcacaccgggaaggagatcgtcgacctgatgtgccacgccacgttcaccatgcggctcctgtcccccgtgcgcgtgccgaactacaacatgatcatcatggacgaggcccacttcaccgaccccagctccatcgccgcgcggggctacatcagcacccgcgtcgggatgggcgaggccgccgccatcttcatgacggccacgccgcccgggtccgtggaggcgttcccgcagagcaacgccgtgatccaggacgaggagcgggacatccccgagcgctcctggaacagcggctacgagtggatcaccgacttccccggcaagaccgtctggttcgtgccctccatcaagagcgggaacgacatcgccaactgcctgcggaagaacggcaagcgcgtgatccagctctcccggaagacgttcgacaccgagtaccagaagaccaagaacaacgactgggactacgtcgtgaccacggacatcagcgagatgggggccaacttccgcgcggaccgggtgatcgacccgcgccggtgcctgaagcccgtcatcctgaaggacggccccgagcgcgtgatcctcgccgggcccatgccggtcaccgtggcctccgccgcccagcggcgcggccggatcggccgcaaccacaacaaggagggggaccagtacatctacatgggccagcccctgaacaacgacgaggaccacgcgcactggaccgaggccaagatgctgctcgacaacatcaacacccccgaggggatcatccccgccctgttcgagccggagcgggagaagtccgccgccatcgacggcgagtaccgcctgcgcggggaggcgcggaagacgttcgtggagctcatgcgccggggcgacctgcccgtctggctgtcctacaaggtggccagcgagggcttccagtacagcgaccgccggtggtgcttcgacggggagcgcaacaaccaggtgctcgaggagaacatggacgtcgagatctggaccaaggagggcgagcggaagaagctgcgcccccggtggctggacgcccgcacctactccgaccccctcgccctgcgggagttcaaggagttcgccgcggggcgccggagcgtgtccggcgacctgatcctcgagatcggcaagctgccgcagcacctgacccagcgcgcccagaacgccctcgacaacctggtgatgctgcacaacagcgagcagggcgggcgggcctaccgccacgcgatggaggagctccccgacacgatcgagaccctgatgctgctcgccctgatcgccgtcctgaccgggggcgtgaccctcttcttcctgtccgggcggggcctgggcaagaccagcatcgggctcctgtgcgtgatggcctccagcgtcctgctctggatggcctccgtggagccccactggatcgcggccagcatcatcctggagttcttcctgatggtgctcctgatccccgagccggaccgccagcggacgccccaggacaaccagctggcctacgtcgtgatcggcctcctgttcatcatcctgaccgtggccgccaacgagatggggctcctggagaccaccaagaaggacctgggcatcgggcacgtcgcggtggagaaccaccaccacgccacgatgctcgacgtggacctgcaccccgcctccgcctggaccctgtacgccgtcgcgaccaccatcatcacgccgatgatgcgccacaccatcgagaacaccaccgccaacatcagcctcacggccatcgccaaccaggccgcgatcctgatgggcctggacaagggctggcccatctccaagatggacatcggggtgcccctcctggccctgggctgctacagccaggtgaaccccctcaccctgaccgccgccgtcctgatgctcgtggcgcactacgccatcatcgggccgggcctgcaggccaaggccacccgggaggcccagaagcgcacggcggccgggatcatgaagaaccccaccgtggacggcatcgtcgccatcgacctggaccccgtggtgtacgacgccaagttcgagaagcagctcggccagatcatgctgctgatcctctgcacctcccagatcctgctgatgcgcaccacgtgggccctctgcgagagcatcaccctggcgaccgggcccctgaccacgctctgggagggctccccggggaagttctggaacaccaccatcgccgtcagcatggccaacatcttccggggctcctacctggccggcgccgggctggcgttcagcctcatgaagtccctgggcgggggccgccgggggaccggcgcccagggcgagacgctgggggagaagtggaagcgccagctcaaccagctgtccaagagcgagttcaacatctacaagcggtccggcatcatggaggtggaccgcagcgaggccaaggaggggctgaagcggggcgagaccacccgccacgccgtgtcccgggggaccgcgaagctgcgctggttcgtcgagcggaacctcgtgaagcccgagggcaaggtgatcgacctgggctgcgggcgcggcgggtggagctactactgcgccggcctgaagaaggtcacggaggtgaaggggtacaccaagggcggccccgggcacgaggagcccatcccgatggccacctacggctggaacctcgtgaagctgcactccgggaaggacgtcttcttcacgccgcccgagaagtgcgacacgctgctctgcgacatcggcgagagctcccccaacccgaccatcgaggaggggcggaccctgcgcgtgctgaagatggtggagccctggctccggggcaaccagttctgcatcaagatcctgaacccctacatgcccagcgtcgtggagaccctggagcagatgcagcgcaagcacggcgggatgctcgtgcggaacccgctgtcccgcaacagcacccacgagatgtactgggtctcctgcggcacggggaacatcgtgagcgccgtgaacatgacctcccggatgctgctcaaccgcttcaccatggcccaccgcaagcccacctacgagcgggacgtcgacctgggcgcgggcacgcgccacgtggccgtggagcccgaggtcgccaacctggacatcatcgggcagcggatcgagaacatcaagcacgagcacaagagcacctggcactacgacgaggacaacccctacaagacctgggcctaccacggctcctacgaggtgaagccgagcgggtccgccagcagcatggtcaacggcgtggtgaagctcctgaccaagccctgggacgtcatccccatggtgacgcagatcgcgatgaccgacaccacccccttcgggcagcagcgcgtgttcaaggagaaggtcgacacgcggaccccgaaggccaagcgcggcaccgcccagatcatggaggtgaccgcccggtggctgtggggcttcctctcccgcaacaagaagccccggatctgcacgcgcgaggagttcacccggaaggtgcgcagcaacgccgcgatcggggccgtcttcgtggacgagaaccagtggaactccgccaaggaggccgtggaggacgagcggttctgggacctggtccagaaggagcgcgagctgcacaagcagggcaagtgcgcgacctgcgtgtacaacatgatggggaagcgggagaagaagctcggcgagttcgggaaggccaagggcagccgcgccatctggtacatgtggctgggcgcccggttcctggagttcgaggccctcgggttcatgaacgaggaccactggttctcccgcgagaacagcctgtccggcgtggagggggagggcctgcacaagctcgggtacatcctgcgggacatcagcaagatccccggcggcaacatgtacgcggacgacaccgccgggtgggacacgcgcatcaccgaggacgacctgcagaacgaggccaagatcaccgacatcatggagccggagcacgccctcctggccacctccatcttcaagctgacgtaccagaacaaggtcgtgcgggtgcagcgccccgcgaagaacggcaccgtcatggacgtgatcagccgccgggaccagcgcgggtccggccaggtgggcacctacgggctcaacaccttcacgaacatggaggcccagctgatccggcagatggagagcgagggcatcttcctgccctccgagctcgagacccccaacctggccgagcgcgtcctggactggctcgagaagtacggggtggagcggctgaagcgcatggccatcagcggcgacgactgcgtggtcaagccgatcgacgaccggttcgccaccgcgctgaccgccctcaacgacatggggaaggtgcgcaaggacatcccccagtgggagccctccaagggctggaacgactggcagcaggtccccttctgcagccaccacttccaccagctgatcatgaaggacggccgggagatcgtcgtgccgtgccgcaaccaggacgagctggtggggcgggcccgcgtctcccagggcgccgggtggagcctccgggagacggcctgcctgggcaagagctacgcgcagatgtggcagctgatgtacttccaccgccgggacctccgcctggccgccaacgccatctgctccgcggtgcccgtggactgggtccccaccagccggaccacctggtccatccacgcccaccaccagtggatgacgaccgaggacatgctgagcgtgtggaaccgcgtgtggatcgaggagaacccctggatggaggacaagacccacgtctccagctggggcgacgtgccgtacctcggcaagcgggaggaccagtggtgcggctccctgatcgggctgaccgcccgcgccacctgggccagcaacatccaggtggcgatcaaccaggtccgccggctcatcggcaacgagaactacctggactacatgacgtccatgaagcgcttcaagaacgagggggaccccgagggcgccctgtggtga

SEQ ID NO: 8562 - RNA, 9879 nt, synthetic construct
  misc_feature 1..9879: note = derived and/or modified CDS sequence (opt1) from DENV-1__FJ898396__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgcgggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtgacctacgggacctgcagccagaccggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccgtgggcggcgtgttcaccagcgtcgggaagctggtgcaccagatcttcggcaccgcctacggggtcctgttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggccgactccgggtgcgtcatcaactggaagggccgggagctcaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctggagaacatcatgtggaagcagatctccaacgagctcaaccacatcctgctggagaacgacatgaagttcaccgtggtggtcggggacgtggtgggcatcctcgcgcaggggaagaagatgatccggccccagcccatggagcacaagtacagctggaagtcctggggcaaggccaagatcatcggcgccgacgtccagaacacgaccttcatcatcgacgggcccaacaccccggagtgccccgacgaccagcgcgcctggaacatctgggaggtggaggactacggcttcgggatcttcaccacgaacatctggctgaagctgcgggacagctacacccaggtgtgcgaccaccgcctcatgtccgcggccatcaaggacagcaaggccgtccacgccgacatgggctactggatcgagtccgagaagaacgagacctggaagctggcccgggcgagcttcatcgaggtgaagacctgcatctggcccaagtcccacacgctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcaccacggtcgtggtggacgagcactgcggcaaccgggggccgtccctgcgcaccaccaccgtcacgggcaagatcatccacgagtggtgctgccggagctgcaccctgccgcccctccgcttcaagggggaggacggctgctggtacgggatggagatccggcccgtgaaggagaaggaggagaacctggtgaagtccatggtcagcgccggcagcggcgaggtggactccttcagcctcgggctgctgtgcatctccatcatgatcgaggaggtgatgcgcagccggtggtcccgcaagatgctcatgaccggcaccctggccgtcttcctgctcctgatcatggggcagctgacgtggaacgacctcatccggctgtgcatcatggtgggcgccaacgcgagcgaccgcatggggatgggcaccacctacctggccctcatggccaccttcaagatgcgcccgatgttcgccgtggggctgctgttccggcgcctcacgtcccgggaggtcctgctgctcaccatcgggctgagcctggtggcctccgtcgagctccccaacagcctggaggagctgggcgacgggctcgcgatgggcatcatgatcctgaagctgctcaccgacttccagtcccaccagctgtgggccaccctgctcagcctgacgttcatcaagaccaccctgtccctccactacgcctggaagaccatggccatggtgctgagcatcgcgtccctgttccccctctgcctgagcacgacctcccagaagaccacctggctgcccgtgctcctgggcagcctggggtgcaagccgctcacgatgttcctgatcaccgagaccaagatctggggccgcaagtcctggcccctgaacgaggggatcatggccgtcggcgtggtgagcatcctcctgagctccctgctcaagaacgacgtccccctggccgggcccctgatcgccggcggcatgctcatcgcctgctacgtgatcagcgggtccagcgcggacctgtccctggagaaggccgccgaggtgagctgggaggaggaggccgagcactccggcgccagccacaacatcctcgtcgtggtgcaggacgacgggaccatgaagatcaaggacgaggagcgggacgacaccctgacgatcctgctcaaggcgaccctgctggccgtctccggcgtgtacccgctcagcatccccgccaccctgttcgtgtggtacttctggcagaagaagaagcagcgctccggggtcctgtgggacacccccagcccgcccgaggtggagcgggccgtgctggacgacggcatctaccgcatcatgcagcggggcctcctggggcgctcccaggtcggcgtgggggtgttccaggagaacgtcttccacacgatgtggcacgtgacccggggcgccgtgctgatgtaccaggggaagcgcctcgagcccagctgggcgtccgtcaagaaggacctgatcagctacggcggcgggtggcggctgcagggctcctggaacaccggggaggaggtccaggtgatcgccgtcgagcccggcaagaaccccaagaacgtgcagaccgcccccgggacgttcaagacccccgagggcgaggtgggcgccatcgccctcgacttcaagcccgggaccagcggctcccccatcgtcaaccgcgaggggaagatcgtgggcctgtacggcaacggggtggtcaccacgagcggcacctacgtgagcgcgatcgcccaggccaaggcctcccaggaggggccgctgcccgagatcgaggacgaggtgttccggaagcgcaacctcaccatcatggacctgcaccccggcagcgggaagacccggcgctacctgccggcgatcgtccgggaggccatcaagcgcaagctccggacgctgatcctggcccccacccgcgtggtggcctccgagatggccgaggcgctcaagggcatgcccatccgctaccagaccaccgccgtcaagagcgagcacacgggcaaggagatcgtggacctgatgtgccacgccaccttcaccatgcggctgctctcccccgtgcgcgtcccgaactacaacatgatcatcatggacgaggcccacttcaccgaccccagctccatcgccgcgcgggggtacatcagcacgcgcgtgggcatgggggaggccgccgccatcttcatgaccgccacgccgcccggctccgtggaggcgttcccgcagagcaacgccgtcatccaggacgaggagcgggacatccccgagcgctcctggaacagcgggtacgagtggatcaccgacttccccggcaagacggtgtggttcgtgccctccatcaagagcggcaacgacatcgccaactgcctgcggaagaacgggaagcgcgtcatccagctgtcccggaagaccttcgacaccgagtaccagaagaccaagaacaacgactgggactacgtggtgacgaccgacatcagcgagatgggcgccaacttccgcgcggaccgggtcatcgacccgcgccggtgcctcaagcccgtgatcctgaaggacgggcccgagcgcgtcatcctggccggccccatgccggtgaccgtggcctccgccgcccagcggcgcgggcggatcggccgcaaccacaacaaggagggcgaccagtacatctacatggggcagcccctcaacaacgacgaggaccacgcgcactggaccgaggccaagatgctgctggacaacatcaacacgcccgagggcatcatccccgccctcttcgagccggagcgggagaagtccgccgccatcgacggggagtaccgcctgcgcggcgaggcgcggaagaccttcgtcgagctgatgcgccgcggggacctccccgtgtggctgtcctacaaggtggccagcgagggcttccagtacagcgaccgccggtggtgcttcgacggcgagcgcaacaaccaggtcctggaggagaacatggacgtggagatctggaccaaggagggggagcggaagaagctccgcccccggtggctggacgcccgcacctactccgaccccctggccctccgggagttcaaggagttcgccgcgggccgccggagcgtgtccggggacctgatcctggagatcggcaagctcccgcagcacctgacgcagcgcgcccagaacgccctggacaacctcgtcatgctgcacaacagcgagcagggcgggcgggcctaccgccacgcgatggaggagctgcccgacaccatcgagaccctcatgctgctggccctcatcgccgtgctgaccggcggggtgaccctgttcttcctctccggccgggggctgggcaagacgagcatcggcctgctctgcgtcatggcctccagcgtgctgctgtggatggcctccgtggagccccactggatcgcggccagcatcaccctcgagttcttcctgatggtcctgctcatccccgagccggaccgccagcggacgccccaggacaaccagctggcctacgtggtgatcgggctcctcttcatgatcctgaccgtcgccgccaacgagatgggcctgctcgagacgaccaagaaggacctggggatcggccacgtggcggtggagaaccaccaccacgccaccatgctggacgtcgacctccaccccgcctccgcctggaccctgtacgccgtggcgacgaccatcatcaccccgatgatgcgccacaccatcgagaacacgaccgccaacatcagcctgaccgccatcgccaaccaggccgcgatcctcatggggctggacaagggctggcccatctccaagatggacatcggcgtgcccctgctcgccctggggtgctacagccaggtcaaccccctgaccctcacggccgccgtgctgatgctggtggcgcactacgccatcatcggcccggggctccaggccaaggccacccgggaggcccagaagcgcaccgcggccggcatcatgaagaaccccaccgtcgacgggatcgtggccatcgacctggaccccgtggtctacgacgccaagttcgagaagcagctgggccagatcatgctcctgatcctgtgcacgtcccagatcctcctgatgcgcaccacctgggccctgtgcgagagcatcaccctcgcgacgggccccctgaccaccctgtgggaggggtccccgggcaagttctggaacaccacgatcgccgtgagcatggccaacatcttccgggggtcctacctcgccggcgccggcctggcgttcagcctgatgaagtccctcgggggcgggcgccggggcaccggggcccagggcgagaccctgggcgagaagtggaagcgccagctgaaccagctctccaagagcgagttcaacatctacaagcggtccgggatcatggaggtggaccgcagcgaggccaaggagggcctgaagcgcggggagaccacgcgccacgccgtctcccggggcaccgcgaagctgcgctggttcgtggagcggaacctggtgaagcccgaggggaaggtcatcgacctcggctgcggccgcgggggctggagctactactgcgccgggctgaagaaggtgaccgaggtgaagggctacaccaagggcgggcccggccacgaggagcccatcccgatggccacgtacgggtggaacctggtcaagctccactccggcaaggacgtgttcttcacgccgcccgagaagtgcgacaccctgctgtgcgacatcggggagagctcccccaacccgaccatcgaggagggccggaccctccgcgtgctgaagatggtcgagccctggctgcgggggaaccagttctgcatcaagatcctcaacccctacatgcccagcgtggtggagacgctggagcagatgcagcgcaagcacggcggcatgctggtccggaacccgctctcccgcaacagcacccacgagatgtactgggtgtcctgcgggaccggcaacatcgtgagcgccgtcaacatgacctcccggatgctgctgaaccgcttcacgatggcccaccgcaagcccacctacgagcgggacgtggacctcggggcgggcacccgccacgtggccgtcgagcccgaggtggccaacctggacatcatcggccagcggatcgagaacatcaagcacgagcacaagagcacctggcactacgacgaggacaacccctacaagacgtgggcctaccacgggtcctacgaggtcaagccgagcggctccgccagcagcatggtgaacggggtggtcaagctgctcaccaagccctgggacgtgatccccatggtgacccagatcgcgatgaccgacacgacccccttcggccagcagcgcgtcttcaaggagaaggtggacacccggaccccgaaggccaagcgcgggacggcccagatcatggaggtgaccgcccggtggctgtggggcttcctgtcccgcaacaagaagccccggatctgcacccgcgaggagttcacccggaaggtccgcagcaacgccgcgatcggcgccgtgttcgtggacgagaaccagtggaactccgccaaggaggccgtcgaggacgagcggttctgggacctcgtgcagaaggagcgcgagctgcacaagcaggggaagtgcgcgacgtgcgtgtacaacatgatgggcaagcgggagaagaagctgggggagttcggcaaggccaaggggagccgcgccatctggtacatgtggctcggcgcccggttcctggagttcgaggccctgggcttcatgaacgaggaccactggttctcccgcgagaacagcctctccggggtcgagggcgaggggctgcacaagctgggctacatcctccgggacatcagcaagatccccgggggcaacatgtacgcggacgacaccgccggctgggacacccgcatcaccgaggacgacctgcagaacgaggccaagatcacggacatcatggagccggagcacgccctgctcgccacctccatcttcaagctgacctaccagaacaaggtggtgcgggtccagcgccccgcgaagaacgggaccgtgatggacgtgatcagccgccgggaccagcgcggctccgggcaggtcggcacgtacggcctgaacaccttcaccaacatggaggcccagctcatccggcagatggagagcgaggggatcttcctgccctccgagctggagacccccaacctcgccgagcgcgtgctggactggctggagaagtacggcgtggagcggctcaagcgcatggccatcagcggggacgactgcgtcgtgaagccgatcgacgaccggttcgccacggcgctgaccgccctgaacgacatgggcaaggtgcgcaaggacatcccccagtgggagccctccaaggggtggaacgactggcagcaggtccccttctgcagccaccacttccaccagctcatcatgaaggacggccgggagatcgtggtgccgtgccgcaaccaggacgagctggtcggccgggcccgcgtgtcccagggggccggctggagcctgcgggagaccgcctgcctcggcaagagctacgcgcagatgtggcagctgatgtacttccaccgccgggacctgcgcctcgccgccaacgccatctgctccgcggtgcccgtcgactgggtgcccaccagccggacgacctggtccatccacgcccaccaccagtggatgaccaccgaggacatgctgagcgtgtggaaccgcgtctggatcgaggagaacccctggatggaggacaagacccacgtgtccagctggggcgacgtgccgtacctggggaagcgggaggaccagtggtgcggctccctcatcggcctgacggcccgcgccacctgggccagcaacatccaggtcgcgatcaaccaggtgcgccggctgatcgggaacgagaactacctcgactacatgacctccatgaagcgcttcaagaacgagggcgaccccgagggggccctgtggtga

SEQ ID NO: 8563 - RNA, 9879 nt, synthetic construct
  misc_feature 1..9879: note = derived and/or modified CDS sequence (opt1) from DENV-1__GQ199839__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgcgggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtgacctacgggacctgcagccggacgggcgagcaccgccgggacaagcgcagcgtggccctcgcgccccacgtgggcctggggctggagacccggaccgagacctggatgtccagcgagggcgcctggaagcagatccagcgcgtggagacgtgggccctccggcaccccgggttcaccgtgatcgccctgttcctggcgcacgccatcggcacctccatcacccagaaggggatcatcttcatcctcctgatgctggtgacgcccagcatggccatgcgctgcgtcggcatcggctcccgggacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcgcaagctctgcatcgaggccaagatcagcaacaccacgaccgactcccggtgccccacccagggcgaggccaccctgatggaggagcaggacgccaacttcgtgtgccgccggacgttcgtcgaccgcggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccggacgggcctcgacttcaacgagatggtgctgctgaccatgaaggagaagtcctggctcgtccacaagcagtggttcctggacctgccgctcccctggaccagcggggccagcacctcccaggagacgtggaaccgccaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccggctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccgcctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccgccgcatggcgatcctgggcgacacggcctgggacttcgggtccatcggcggcgtgttcaccagcgtggggaagctggtccaccagatcttcggcaccgcctacggggtcctgttctccggcgtgagctggaccatgaagatcgggatcggcgtcctgctgacgtggctcggcctgaactcccggagcacctccctgagcatgacctgcatcgccgtggggctcgtgaccctgtacctgggcgtcatggtgcaggccgactccgggtgcgtgatcaactggaagggccgcgagctcaagtgcgggagcggcatcttcgtcacgaacgaggtgcacacctggaccgagcagtacaagttccaggcggacagcccgaagcggctgtccgccgccatcggcaaggcctgggaggagggggtgtgcggcatccgcagcgccacccggctggagaacatcatgtggaagcagatctccaacgagctcaaccacatcctgctggagaacgggctcaagttcaccgtcgtggtgggcgacgtcgtggggatcctggcgcagggcaagaagatgatccgcccccagcccatggagcacaagtacagctggaagtcctggggcaaggccaagatcatcggggccgacgtgcagaacacgaccttcatcatcgacggccccaacaccccggagtgccccgacgaccagcgggcctggaacatctgggaggtcgaggactacgggttcggcatcttcaccacgaacatctggctgaagctccgcgacagctacacccaggtgtgcgaccaccggctgatgtccgcggccatcaaggacagcaaggccgtgcacgccgacatgggctactggatcgagtccgagaagaacgagacctggaagctggcccgcgcgagcttcatcgaggtcaagacctgcatctggcccaagtcccacacgctctggagcaacggggtgctggagtccgagatgatcatccccaagatctacggcgggccgatcagccagcacaactaccggcccggctacttcacccagaccgccgggccctggcacctgggcaagctcgagctggacttcgacctgtgcgagggcaccacggtggtcgtggacgagcactgcgggaaccgcggcccgtccctccggaccaccaccgtgacggggaagatcatccacgagtggtgctgccgcagctgcaccctgccgcccctgcggttcaagggcgaggacgggtgctggtacggcatggagatccgccccgtcaaggagaaggaggagaacctcgtgaagtccatggtgagcgccggcagcggggaggtcgactccttcagcctgggcctgctctgcacctccatcatgatcgaggaggtgatgcggagccgctggtcccggaagatgctgatgaccgggacgctggccgtgttcctcctgctgatcatgggccagctcacctggaacgacctgatccgcctgtgcatcatggtcggggccaacgcgagcgaccgcatgggcatgggcaccacctacctcgccctgatggccacgttcaagatgcggccgatgttcgccgtggggctcctgttccgccggctgacctcccgcgaggtgctgctcctgaccatcgggctgagcctcgtcgcctccgtggagctgcccaacagcctggaggagctcggggacggcctggcgatgggcatcatgatcctgaagctcctgaccgacttccagtcccaccagctgtgggccacgctcctgagcctgaccttcatcaagaccaccctctccctgcactacgcctggaagacgatggccatggtcctgagcatcgtgtccctcttccccctgtgcctgagcaccacctcccagaagaccacgtggctccccgtgctgctggggagcctcggctgcaagccgctgaccatgttcctgatcgcggagaacaagatctgggggcggaagtcctggcccctcaacgagggcatcatggccgtcggggtggtgagcatcctgctgagctccctcctgaagaacgacgtccccctggccggccccctcatcgccggcgggatgctgatcgcctgctacgtgatcagcggctccagcgcggacctgtccctcgagaaggccgccgaggtgagctgggaggaggaggccgagcactccggggccagccacaacatcttcgtcgaggtgcaggacgacggcaccatgaagatcaaggacgaggagcgcgacgacaccctgaccatcctgctcaaggcgacgctgctggccgtgtccggggtctacccgctcagcatccccgccaccctgttcgtgtggtacttctggcagaagaagaagcagcggtccggcgtgctgtgggacacccccagcccgcccgaggtcgagcgcgccgccctggacgacggcatctaccggatcatgcagcgcgggctcctgggccggtcccaggtgggggtgggcgtcttccaggagaacgtgttccacaccatgtggcacgtgacgcgcggggcggtcctgatgtaccagggcaagcggctcgagcccagctgggcctccgtgaagaaggacctgatcagctacggcgggggctggcgcctgcaggggtcctggaacaccggcgaggaggtgcaggtcatcgccgtggagcccgggaagaaccccaagaacgtgcagaccgcccccggcaccttcaagacgcccgagggcgaggtcggggccatcgcgctcgacttcaagcccggcaccagcgggtcccccatcgtgaaccgggagggcaagatcgtgggcctgtacgggaacggcgtcgtgaccaccagcgggacgtacgtgagcgccatcgcccagaccaaggcctcccaggagggcccgctgcccgagatcgaggacgaggtcttccgcaagcggaacctcaccatcatggacctgcaccccgggagcggcaagacccgccggtacctgccggcgatcgtgcgcgaggccatcaagcggaagctccgcacgctgatcctggcccccacccgcgtggtcgcctccgagatggccgaggcgctcaagggcatgcccatccggtaccagaccaccgccgtcaagagcgagcacacggggaaggagatcgtggacctgatgtgccacgccaccttcaccatgcgcctgctctcccccgtccgggtgccgaactacaacatgatcatcatggacgaggcccacttcaccgaccccagctccatcgccgcgcgcggctacatcagcacgcgggtggggatgggcgaggccgccgccatcttcatgaccgccacgccgcccgggtccgtcgaggcgttcccgcagagcaacgccgtgatccaggacgaggagcgcgacatccccgagcggtcctggaacagcggctacgagtggatcaccgacttccccggcaagacggtgtggttcgtcccctccatcaagagcgggaacgacatcgccaactgcctgcgcaagaacggcaagcgggtgatccagctgtcccgcaagaccttcgacaccgagtaccagaagaccaagaacaacgactgggactacgtggtcacgaccgacatcagcgagatgggggccaacttccgggcggaccgcgtgatcgacccgcggcgctgcctcaagcccgtgatcctgaaggacggccccgagcgggtcatcctggccgggcccatgccggtgaccgtcgcctccgccgcccagcgccggggccgcatcggccggaaccacaacaaggagggggaccagtacatctacatgggccagcccctcaacaacgacgaggaccacgcgcactggaccgaggccaagatgctgctggacaacatcaacacgcccgaggggatcatccccgccctcttcgagccggagcgcgagaagtccgccgccatcgacggcgagtaccgcctgcgcggggaggcgcgcaagaccttcgtggagctgatgcggcgcggcgacctccccgtgtggctgtcctacaaggtcgccagcgagggcttccagtacagcgaccggcgctggtgcttcgacggggagcggaacaaccaggtgctggaggagaacatggacgtggagatctggaccaaggagggcgagcgcaagaagctccggccccgctggctggacgcccggacctactccgaccccctggccctccgcgagttcaaggagttcgccgcggggcggcgcagcgtctccggcgacctgatcctggagatcggcaagctcccgcagcacctgacgcagcgggcccagaacgccctggacaacctcgtgatgctgcacaacagcgagcagggcgggcgcgcctaccggcacgcgatggaggagctgcccgacaccatcgagaccctcatgctgctggccctcatcgccgtgctgaccgggggcgtcaccctgttcttcctctccgggcgcggcctgggcaagacgagcatcgggctgctctgcgtgatggcctccagcgtgctgctgtggatggcctccgtcgagccccactggatcgcggccagcatcatcctcgagttcttcctgatggtgctgctcatccccgagccggaccggcagcgcacgccccaggacaaccagctggcctacgtggtcatcggcctcctcttcatcatcctgaccgtggccgccaacgagatggggctgctcgagaccacgaagaaggacctgggcatcgggcacgtggcggtcgagaaccaccaccacgccaccatgctggacgtggacctccaccccgcctccgcctggaccctgtacgccgtggcgaccacgatcatcaccccgatgatgcggcacaccatcgagaacaccacggccaacatcagcctgaccgccatcgccaaccaggccgcgatcctcatgggcctggacaagggctggcccatctccaagatggacatcggggtccccctgctcgccctgggctgctacagccaggtgaaccccctgaccctcaccgccgccgtgctgatgctggtcgcgcactacgccatcatcgggccgggcctccaggccaaggccacgcgcgaggcccagaagcgcaccgcggccgggatcatgaagaaccccaccgtggacggcatcgtggccatcgacctggaccccgtcgtgtacgacgccaagttcgagaagcagctgggccagatcatgctcctgatcctgtgcacctcccagatcctcctgatgcggacgacctgggccctgtgcgagagcatcaccctcgcgaccgggcccctgacgaccctgtgggagggctccccggggaagttctggaacaccaccatcgccgtgagcatggccaacatcttccgcggctcctacctcgccggcgccgggctggcgttcagcctgatgaagtccctcggcgggggccggcgcgggacgggcgcccagggcgagaccctgggggagaagtggaagcggcagctgaaccagctctccaagagcgagttcaacatctacaagcgctccggcatcatggaggtcgaccggagcgaggccaaggaggggctgaagcgcggcgagaccacccggcacgccgtgtcccgcgggacggcgaagctgcggtggttcgtggagcgcaacctggtcaagcccgagggcaaggtgatcgacctcggctgcgggcggggcgggtggagctactactgcgccggcctgaagaaggtgaccgaggtcaaggggtacaccaagggcggccccgggcacgaggagcccatcccgatggccacctacggctggaacctggtgaagctccactccgggaaggacgtgttcttcacgccgcccgagaagtgcgacaccctgctgtgcgacatcggcgagagctcccccaacccgaccatcgaggaggggcgcaccctccgggtcctgaagatggtggagccctggctgcgcggcaaccagttctgcatcaagatcctcaacccctacatgcccagcgtggtcgagaccctggagcagatgcagcggaagcacggcgggatgctggtgcgcaacccgctctcccggaacagcacgcacgagatgtactgggtgtcctgcggcaccgggaacatcgtcagcgccgtgaacatgacctcccgcatgctgctgaaccgcttcaccatggcccaccggaagcccacgtacgagcgcgacgtggacctcggcgcgggcacccggcacgtcgccgtggagcccgaggtggccaacctggacatcatcgggcagcgcatcgagaacatcaagcacgagcacaagagcacctggcactacgacgaggacaacccctacaagacctgggcctaccacggctcctacgaggtcaagccgagcgggtccgccagcagcatggtgaacggcgtcgtgaagctgctcacgaagccctgggacgtgatccccatggtcacccagatcgcgatgaccgacaccacgcccttcgggcagcagcgggtgttcaaggagaaggtggacacccgcaccccgaaggccaagcggggcaccgcccagatcatggaggtcacggcccgctggctgtggggcttcctgtcccggaacaagaagccccgcatctgcacccgggaggagttcacccgcaaggtgcggagcaacgccgcgatcggggccgtgttcgtcgacgagaaccagtggaactccgccaaggaggccgtggaggacgagcgcttctgggacctcgtgcagaaggagcgggagctgcacaagcagggcaagtgcgcgacctgcgtctacaacatgatggggaagcgcgagaagaagctgggcgagttcgggaaggccaagggcagccgggccatctggtacatgtggctcggcgcccgcttcctggagttcgaggccctggggttcatgaacgaggaccactggttctcccgggagaacagcctctccggcgtggagggggagggcctgcacaagctggggtacatcctccgcgacatcagcaagatccccggcggcaacatgtacgcggacgacacggccgggtgggacacccggatcaccgaggacgacctgcagaacgaggccaagatcaccgacatcatggagccggagcacgccctgctcgccacgtccatcttcaagctgacctaccagaacaaggtggtccgcgtgcagcgccccgcgaagaacggcaccgtgatggacgtcatcagccggcgcgaccagcgggggtccggccaggtgggcacctacgggctgaacacgttcaccaacatggaggcccagctcatccgccagatggagagcgagggcatcttcctgccctccgagctggagacccccaacctcgccgagcgggtgctggactggctggagaagtacggggtcgagcgcctcaagcggatggccatcagcggcgacgactgcgtggtgaagccgatcgacgaccgcttcgccaccgcgctgacggccctgaacgacatggggaaggtccggaaggacatcccccagtgggagccctccaagggctggaacgactggcagcaggtccccttctgcagccaccacttccaccagctcatcatgaaggacggccgcgagatcgtggtcccgtgccggaaccaggacgagctggtggggcgcgcccgggtgtcccagggcgccgggtggagcctgcgcgagaccgcctgcctcggcaagagctacgcgcagatgtggcagctgatgtacttccaccggcgcgacctgcggctcgccgccaacgccatctgctccgcggtccccgtggactgggtgcccaccagccgcaccacgtggtccatccacgcccaccaccagtggatgaccaccgaggacatgctgagcgtctggaaccgggtgtggatcgaggagaacccctggatggaggacaagacccacgtgtccagctggggcgacgtcccgtacctgggcaagcgcgaggaccagtggtgcggctccctcatcgggctgaccgcccgcgccacgtgggccagcaacatccaggtggcgatcaaccaggtgcggcgcctgatcggcaacgagaactacctcgactacatgacctccatgaagcggttcaagaacgagggggaccccgagggcgccctgtggtga

SEQ ID NO: 8564 - RNA, 9879 nt, synthetic construct
  misc_feature 1..9879: note = derived and/or modified CDS sequence (opt1) from DENV-1__FJ898397__SS-prME
  source 1..9879: mol_type = other RNA
agcgtgaccatgctgctcatgctgatgcccaccgccctggccttccacctcaccatccggggcggggagccccacatgatcgtgagcaagcaggagcggggcaagagcctgctgttcaagaccagcgccggggtgaacatgtgcaccctcatcgccatggacctgggcgagttctgcgaggacaccatgacctacaagtgcccccgcatcaccgaggccgagcccgacgacgtggactgctggtgcaacgccaccgacacctgggtgacctacgggacctgcagccagaccggcgagcaccggcgggacaagcggtccgtggccctggcgccccacgtgggcctcgggctggagacccgcacggagacctggatgagctccgagggcgcctggaagcagatccagcgggtggagacctgggccctgcgccaccccgggttcaccgtgatcgccctcttcctggcgcacgccatcggcacgagcatcacccagaaggggatcatcttcatcctgctcatgctggtgaccccctccatggccatgcggtgcgtcggcatcggcagccgcgacttcgtggaggggctgtccggcgccacctgggtggacgtcgtgctcgagcacgggagctgcgtgacgaccatggccaaggacaagcccaccctggacatcgagctgctcaagaccgaggtcacgaaccccgcggtgctgcggaagctgtgcatcgaggccaagatctccaacaccaccaccgacagccgctgcccgacgcagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgacgaagctcgagggcaagatcgtccagtacgagaacctgaagtacagcgtgatcgtgaccgtccacaccggcgaccagcaccaggtggggaacgagtccaccgagcacggcacgaccgcgaccatcacgccccaggcccccagcaccgagatccagctgacggactacggggccctcaccctggactgcagcccccggaccggcctggacttcaacgagatggtcctcctgaccatgaaggagaagtcctggctggtgcacaagcagtggttcctcgacctgccgctgccctggacgagcggggcctccaccagccaggagacctggaaccggaaggacctcctggtgaccttcaagacggcccacgcgaagaagcaggaggtcgtggtgctgggctcccaggagggcgccatgcacaccgccctcaccggggccaccgagatccagacgagcggcaccaccaccatcttcgccgggcacctgaagtgccgcctgaagatggacaagctcacgctgaagggcatgtcctacgtcatgtgcaccgggagcttcaagctggagaaggaggtggcggagacccagcacggcaccgtgctcgtccagatcaagtacgagggcacggacgccccctgcaagatccccttctccacccaggacgagaagggggtgacccagaacggccggctgatcaccgccaacccgatcgtgacggacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacaccgcctgggacttcgggagcatcggcggcgtgttcacctccgtcgggaagctggtgcaccagatcttcggcacggcctacggggtgctgttcagcggcgtctcctggaccatgaagatcgggatcggcgtgctcctgacctggctgggcctcaacagccgctccaccagcctgtccatgacgtgcatcgccgtggggctggtcaccctctacctgggcgtgatggtgcaggccgacagcgggtgcgtcatcaactggaagggccgggagctgaagtgcgggagcggcatcttcgtgaccaacgaggtgcacacctggacggagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagttcaccgtggtggtcggggacgtggcgggcatcctggcccaggggaagaagatgatccggccccagcccatggagtacaagtactcctggaagtcctggggcaaggccaagatcatcggcgccgacgtgcagaacaccaccttcatcatcgacgggcccaacacgccggagtgccccgacgaccagcgcgcgtggaacatctgggaggtcgaggactacggcttcgggatcttcaccaccaacatctggctcaagctgcgggactcctacacccaggtgtgcgaccaccgcctgatgagcgccgccatcaaggactccaaggccgtgcacgccgacatgggctactggatcgagagcgagaagaacgagacgtggaagctcgcgcgggcctccttcatcgaggtcaagacctgcatctggcccaagagccacaccctgtggtccaacggcgtgctggagagcgagatgatcatccccaagatctacgggggcccgatctcccagcacaactaccgccccgggtacttcacccagacggccggcccctggcacctcgggaagctggagctggacttcgacctctgcgagggcaccaccgtggtcgtggacgagcactgcggcaaccgggggccgagcctgcgcaccacgaccgtgaccggcaagatcatccacgagtggtgctgccggtcctgcaccctgccgcccctgcgcttcaagggggaggacggctgctggtacgggatggagatccggcccgtcaaggagaaggaggagaacctggtcaagagcatggtgagcgccggctccggcgaggtcgacagcttctccctggggctcctgtgcatcagcatcatgatcgaggaggtgatgcgctcccggtggagccgcaagatgctgatgacgggcaccctcgccgtgttcttcctgctgatcatggggcagctcacctggaacgacctgatccggctgtgcatcatggtcggcgcgaacgcctccgaccgcatggggatgggcaccacgtacctcgccctgatggccaccttcaagatgcgcccgatgttcgccgtggggctcctgttccggcgcctgaccagccgggaggtgctgctcctgaccatcgggctgtccctcgtcgcgagcgtggagctgcccaactccctggaggagctcggcgacgggctggccatgggcatcatgatcctgaagctcctgacggacttccagagccaccagctgtgggccaccctcctgtccctgaccttcatcaagaccacgttcagcctccactacgcctggaagaccatggcgatggtcctgtccatcgtgagcctgttccccctctgcctgtccaccaccagccagaagacgacctggctgcccgtgctcctgggctccctggggtgcaagccgctcaccatgttcctgatcgccgagaacaagatctggggccgcaagagctggcccctgaacgaggggatcatggccgtcggcatcgtgagcatcctcctgtccagcctgctcaagaacgacgtgcccctggccgggcccctgatcgccggcggcatgctcatcgcgtgctacgtcatctccgggagctccgccgacctgagcctggagaaggccgccgaggtgtcctgggaggaggaggccgagcacagcggcgcgtcccacaacatcctcgtggaggtccaggacgacgggaccatgaagatcaaggacgaggagcgggacgacacgctgaccatcctgctcaaggccaccctgctggccgtgagcggcgtgtacccgctctccatccccgccaccctgttcgtctggtacttctggcagaagaagaagcagcgcagcggggtgctgtgggacacccccagcccgcccgaggtggagcgggccgtcctcgacgacggcatctaccgcatcatgcagcggggcctgctggggcgcagccaggtgggcgtgggggtcttccaggagaacgtgttccacacgatgtggcacgtgacccggggcgcggtcctgatgtaccaggggaagcgcctcgagccctcctgggccagcgtgaagaaggacctgatctcctacggcggcgggtggcggctgcagggcagctggaacaccggggaggaggtgcaggtcatcgccgtggagcccggcaagaaccccaagaacgtgcagaccgcccccgggacgttcaagacctccgagggcgaggtcggcgccatcgcgctcgacttcaagcccgggaccagcggcagccccatcgtgaaccgcgaggggaagatcgtgggcctgtacggcaacggggtcgtgaccacgtccggcacctacgtgagcgccatcgcccaggccaaggcgtcccaggaggggcccctgccggagatcgaggacgaggtcttccggaagcgcaacctcaccatcatggacctgcaccccggcagcgggaagacccggcgctacctgcccgccatcgtgcgggaggccatcaagcgcaagctccggacgctgatcctggccccgacccgcgtggtcgcctccgagatggcggaggccctcaagggcatgcccatccgctaccagaccaccgccgtcaagagcgagcacacgggcaaggagatcgtggacctgatgtgccacgccaccttcaccatgcggctgctctcccccgtccgcgtgcccaactacaacatgatcatcatggacgaggcccacttcaccgacccgagctccatcgcggcccgggggtacatcagcacgcgcgtgggcatgggggaggccgccgccatcttcatgaccgcgacgccgcccggctccgtcgaggccttcccccagagcaacgccgtgatccaggacgaggagcgggacatcccggagcgctcctggaacagcgggtacgagtggatcaccgacttccccggcaagacggtgtggttcgtcccctccatcaagagcggcaacgacatcgccaactgcctgcggaagaacgggaagcgcgtgatccagctgtcccggaagaccttcgacaccgagtaccagaagaccaagaacaacgactgggactacgtggtcacgaccgacatcagcgagatgggcgcgaacttccgcgccgaccgggtgatcgacccccgccggtgcctcaagccggtgatcctgaaggacgggcccgagcgcgtcatcctggccggccccatgcccgtgaccgtcgcctccgccgcgcagcggcgcgggcggatcggccgcaaccacaacaaggagggcgaccagtacatctacatggggcagccgctcaacaacgacgaggaccacgcccactggaccgaggccaagatgctgctggacaacatcaacacgcccgagggcatcatccccgccctcttcgagcccgagcgggagaagtccgccgcgatcgacggggagtaccgcctgcgcggcgaggcccggaagaccttcgtggagctgatgcgccgcggggacctcccggtgtggctgagctacaaggtcgcctccgagggcttccagtacagcgaccgccggtggtgcttcgacggcgagcgcaacaaccaggtgctggaggagaacatggacgtggagatctggaccaaggagggggagcggaagaagctccgcccccggtggctggacgcccgcacctactccgaccccctggccctccgggagttcaaggagttcgcggccggccgccggagcgtctccggggacctgatcctggagatcggcaagctcccccagcacctgacgcagcgcgcccagaacgccctggacaacctcgtgatgctgcacaacagcgagcagggcgggcgggcgtaccgccacgccatggaggagctgccggacaccatcgagaccctcatgctgctggccctcatcgccgtgctgaccggcggggtcacgctgttcttcctctccggccgggggctgggcaagaccagcatcggcctgctctgcgtgatggcctccagcgtgctgctgtggatggcgtccgtcgagccccactggatcgccgccagcatcatcctcgagttcttcctgatggtgctgctcatccccgagcccgaccgccagcggaccccgcaggacaaccagctggcctacgtggtcatcgggctcctcttcatgatcctgaccgtggccgcgaacgagatgggcctgctcgagaccacgaagaaggacctggggatcggccacgtggccgtcgagaaccaccaccacgccgccatgctggacgtggacctccaccccgcctccgcgtggaccctgtacgccgtggccaccaccatcatcacgcccatgatgcgccacaccatcgagaacaccaccgccaacatcagcctgacggccatcgcgaaccaggccgccatcctcatggggctggacaagggctggccgatctccaagatggacatcggcgtccccctgctcgccctggggtgctacagccaggtgaaccccctgaccctcaccgcggccgtgctgatgctggtcgcccactacgccatcatcggccccgggctccaggccaaggcgacccgggaggcccagaagcgcacggccgccggcatcatgaagaacccgaccgtggacgggatcgtggccatcgacctggaccccgtcgtgtacgacgcgaagttcgagaagcagctgggccagatcatgctcctgatcctgtgcacctcccagatcctcctgatgcgcaccacgtgggccctgtgcgagagcatcaccctcgccaccggccccctgaccacgctgtgggaggggtcccccggcaagttctggaacaccaccatcgccgtgagcatggccaacatcttccgggggagctacctcgcgggcgccggcctggccttctccctgatgaagtccctcgggggcgggcgccggggcaccggggcccagggcgagacgctgggcgagaagtggaagcgccagctgaaccagctctccaagagcgagttcaacacctacaagcggtccgggatcatggaggtcgaccgcagcgaggcgaaggagggcctgaagcgcggggagaccaccaagcacgccgtgtcccgcggcacggccaagctgcggtggttcgtggagcgcaacctcgtcaagccggaggggaaggtgatcgacctgggctgcggccgcggcgggtggagctactactgcgccgggctgaagaaggtgaccgaggtcaaggggtacaccaagggcgggcccggccacgaggagcccatccccatggccacctacgggtggaacctggtgaagctccactccggcaaggacgtgttcttcatcccgcccgagaagtgcgacacgctgctgtgcgacatcggggagagctcccccaaccccaccatcgaggagggccgcaccctccgggtcctgaagatggtggagccgtggctgcgcgggaaccagttctgcatcaagatcctcaacccctacatgcccagcgtggtcgagaccctggagcagatgcagcggaagcacggcggcatgctggtgcgcaaccccctctcccggaacagcacgcacgagatgtactgggtgtcctgcgggaccggcaacatcgtcagcgcggtgaacatgacctcccgcatgctgctgaaccggttcaccatggcccaccgcaagccgacctacgagcgcgacgtggacctcggggccggcacgcggcacgtcgccgtggagcccgaggtggccaacctggacatcatcggccagcgcatcgagaacatcaagcacgagcacaagagcacctggcactacgacgaggacaacccctacaagacctgggcgtaccacgggtcctacgaggtcaagcccagcggcagcgcctccagcatggtgaacggggtcgtgaagctgctcaccaagccgtgggacgtgatccccatggtcacgcagatcgccatgaccgacaccacccccttcggccagcagcgggtgttcaaggagaaggtggacacgcgcacccccaaggccaagcgggggaccgcccagatcatggaggtcaccgcgaagtggctgtggggcttcctgtcccgcaacaagaagccgcggatctgcacgcgcgaggagttcacccggaaggtgcgcagcaacgccgccatcggcgccgtgttcgtcgacgagaaccagtggaactccgcgaaggaggccgtggaggacgagcggttctgggacctcgtgcaccgcgagcgggagctgcacaagcaggggaagtgcgcgacctgcgtctacaacatgatgggcaagcgcgagaagaagctgggggagttcggcaaggccaaggggagccgggccatctggtacatgtggctcggcgcgcgcttcctggagttcgaggccctgggcttcatgaacgaggaccactggttctcccgggagaacagcctctccggggtggagggcgaggggctgcacaagctgggctacatcctccgcgacatcagcaagatccccgggggcaacatgtacgccgacgacaccgccggctgggacacgcggatcaccgaggacgacctgcagaacgaggccaagatcaccgacatcatggagcccgagcacgcgctgctcgccacctccatcttcaagctgacgtaccagaacaaggtggtccgcgtgcagcggccggccaagaacgggaccgtgatggacgtcatcagccgccgcgaccagcggggctccggccaggtgggcacctacggcctgaacaccttcacgaacatggaggcccagctcatccgccagatggagagcgaggggatcttctcccccagcgagctggagacccccaacctggccggccgggtgctcgactggctggagaagcacggggtcgagcgcctgaagcggatggcgatctccggcgacgactgcgtggtgaagcccatcgacgaccgcttcgccaccgccctcaccgccctgaacgacatggggaaggtccggaaggacatcccgcagtgggagcccagcaagggctggaacgactggcagcaggtccccttctgcagccaccacttccaccagctgatcatgaaggacggccgcgagatcgtggtcccctgccggaaccaggacgagctcgtggggcgcgcccgggtgtcccagggcgcggggtggagcctgcgcgagacggcctgcctgggcaagtcctacgcccagatgtggcagctcatgtacttccaccggcgcgacctgcggctggccgcgaacgccatctgcagcgccgtcccggtggactgggtgcccacctcccgcaccacctggagcatccacgcccaccaccagtggatgacgaccgaggacatgctctccgtctggaaccgggtgtggatcgaggagaacccctggatggaggacaagacccacatcagctcctggggcgacgtgccctacctgggcaagcgcgaggaccagtggtgcggcagcctgatcgggctcaccgcccgggcgacgtgggccaccaacatccaggtcgccatcaaccaggtgcgccgcctgatcggcaacgagaactacctggactacatgacctccatgaagcggttcaagaacgagagcgacccggagggggccctctggtga

SEQ ID NO: 8565 - RNA, 9879 nt, synthetic construct
  misc_feature 1..9879: note = derived and/or modified CDS sequence (opt1) from DENV-1__FJ898398__SS-prME
  source 1..9879: mol_type = other RNA
agcgtgaccatgctgctgatgctgatgcccaccgccctggccttccacctcacgacccggggcggggagccccacatgatcgtgagcaagcaggagcggggcaagagcctgctgttcaagacctccgccggggtgaacatgtgcaccctcatcgccatggacctgggcgagttctgcgaggacaccatgacctacaagtgcccccgcatcaccgaggccgagcccgacgacgtggactgctggtgcaacgccaccgacacgtgggtcacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtcgagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggaccagcggggcctccaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctcgtccagatcaagtacgagggcaccgacgccccctgcaagatccccttctccacccaggacgagaagggggtgacccagaacggccggctgatcacggccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacaccgcctgggacttcgggagcatcggcggcgtgttcacgtccgtcgggaagctggtgcaccagatcttcggcaccgcctacggggtgctgttcagcggcgtctcctggaccatgaagatcgggatcggcgtgctcctgacctggctgggcctcaacagccgctccacgagcctgtccatgacctgcatcgccgtggggctggtcaccctctacctgggcgtgatggtgcaggccgacagcgggtgcgtcatcaactggaagggccgggagctgaagtgcgggagcggcatcttcgtgaccaacgaggtgcacacgtggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagctgaccgtggtggtcggggacgtggcgggcatcctcgcccaggggaagaagatgatccggccccagcccatggagtacaagtactcctggaagatctggggcaaggccaagatcatcggcgccgacgtgcagaacaccacgttcatcatcgacgggcccaacaccccggagtgccccgacgaccagcgcgcgtggaacatctgggaggtcgaggactacggcttcgggatcttcaccaccaacatctggctgaagctgcgggacagctacacccaggtgtgcgaccaccgcctcatgtccgccgccatcaaggacagcaaggccgtgcacgccgacatgggctactggatcgagtccgagaagaacgagacctggaagctggcgcgggccagcttcatcgaggtcaagacctgcatctggcccaagtcccacaccctgtggagcaacggcgtgctcgagtccgagatgatcatccccaagatctacgggggcccgatcagccagcacaactaccgccccgggtacttcacgcagaccgccggcccctggcacctggggaagctggagctcgacttcgacctgtgcgagggcaccaccgtggtcgtggacgagcactgcggcaaccgggggccgtccctgcgcacgaccaccgtgaccggcaagatcatccacgagtggtgctgccggagctgcacgctgccgcccctccgcttcaagggggaggacggctgctggtacgggatggagatccggcccgtcaaggagaaggaggagaacctggtgaagtccatggtgagcgccggcagcggcgaggtcgactccttcagcctcgggctgctgtgcatctccatcatgatcgaggaggtgatgcgcagccggtggtcccgcaagatgctcatgaccggcaccctggccgtgttcttcctgctcatcatggggcagctgacctggaacgacctgatccggctctgcatcatggtcggcgcgaacgccagcgaccgcatggggatgggcacgacctacctggccctgatggccaccttcaagatgcgcccgatgttcgccgtgggcctcctgttccggcgcctgacctcccgggaggtgctcctgctgacgatcgggctcagcctggtcgcgtccgtggagctgcccaacagcctcgaggagctgggcgacgggctggccatgggcatcatgatcctcaagctgctgaccgacttccagtcccaccagctctgggccaccctgctgagcctcaccttcatccgcacgaccttctccctgcactacgcctggaagaccatggcgatggtcctgagcatcgtgtccctcttccccctgtgcctgagcaccacgtcccagaagaccacctggctccccgtgctgctgggcagcctcgggtgcaagccgctgaccatgttcctgatcgccgagaacaagatctggggccggaagtcctggcccctcaacgaggggatcatggccgtcggcatcgtgagcatcctgctgagctccctcctgaagaacgacgtgcccctggccgggcccctcatcgccggcggcatgctgatcgcgtgctacgtcatcagcgggtccagcgccgacctgtccctcgagaaggccgccgaggtgagctgggaggaggaggccgagcactccggcgcgagccacaacatcctggtggaggtccaggacgacgggacgatgaagatcaaggacgaggagcgcgacgacaccctgaccatcctcctgaaggccaccctgctcgccgtgtccggcgtgtacccgctgagcatccccgccaccctgttcgtctggtacttctggcagaagaagaagcagcggtccggggtgctctgggacacgcccagcccgcccgaggtggagcgcgccgtcctggacgacggcatctaccggatcatgcagcgcggcctgctggggcggtcccaggtgggcgtgggggtcttccaggagaacgtgttccacaccatgtggcacgtgacccgcggcgcggtcctcatgtaccaggggaagcggctggagcccagctgggcctccgtgaagaaggacctgatcagctacggcggcgggtggcgcctccagggctcctggaacaccggggaggaggtgcaggtcatcgccgtggagcccggcaagaaccccaagaacgtgcagacggcccccgggaccttcaagaccagcgagggcgaggtcggcgccatcgcgctggacttcaagcccgggacctccggcagccccatcgtgaaccgggaggggaagatcgtgggcctgtacggcaacggggtcgtgacgaccagcggcacctacgtgtccgccatcgcccaggccaaggcgagccaggaggggcccctcccggagatcgaggacgaggtcttccgcaagcggaacctgaccatcatggacctgcaccccggctccgggaagacgcgccggtacctccccgccatcgtgcgcgaggccatcaagcggcgcctgcgcaccctgatcctcgccccgacccgggtggtcgccagcgagatggcggaggccctgaagggcatgcccatccgctaccagaccacggccgtgaagtccgagcacaccggcaaggagatcgtggacctgatgtgccacgccaccttcaccatgcggctcctgagccccgtccgcgtgcccaactacaacatgatcatcatggacgaggcccacttcacggacccgtccagcatcgcggcccgggggtacatctccacccgcgtgggcatgggggaggccgccgccatcttcatgaccgcgacgccgcccggcagcgtcgaggccttcccccagtccaacgccgtgatccaggacgaggagcgggacatcccggagcgcagctggaactccgggtacgagtggatcacggacttccccggcaagaccgtgtggttcgtccccagcatcaagtccggcaacgacatcgccaactgcctgcggaagaacgggaagcgcgtgatccagctcagccggaagaccttcgacaccgagtaccagaagacgaagaacaacgactgggactacgtggtcaccaccgacatctccgagatgggcgcgaacttccgcgccgaccgggtgatcgacccccgccggtgcctgaagccggtgatcctgaaggacgggcccgagcgcgtcatcctcgccggccccatgcccgtgaccgtcgccagcgccgcgcagcggcgcgggcggatcggccgcaaccacaacaaggagggcgaccagtacatctacatggggcagccgctgaacaacgacgaggaccacgcccactggacggaggccaagatgctgctcgacaacatcaacacccccgagggcatcatccccgccctgttcgagcccgagcgcgagaagtccgccgcgatcgacggggagtaccggctgcgcggcgaggcccggaagaccttcgtggagctcatgcgccgcggggacctgccggtgtggctgagctacaaggtcgccagcgagggcttccagtactccgaccgccggtggtgcttcgacggcgagcgcaacaaccaggtgctcgaggagagcatggacgtggagatctggaccaaggagggggagcggaagaagctgcgcccccggtggctggacgcccgcacgtactccgaccccctcgccctgcgggagttcaaggagttcgcggccggccgccggagcgtctccggggacctgatcctcgagatcggcaagctgccccagcacctgacccagcgcgcccagaacgccctcgacaacctggtgatgctgcacaacagcgagcagggcgggcgggcgtaccgccacgccatggaggagctcccggacaccatcgagaccctgatgctgctcgccctgatcgccgtgctgacgggcggggtcaccctcttcttcctgtccggccgggggctgggcaagaccagcatcggcctcctgtgcgtgatggcctccagcgtgctgctctggatggcgtccgtcgagccccactggatcgccgccagcatcatcctggagttcttcctgatggtgctcctgatccccgagcccgaccgccagcggaccccgcaggacaaccagctggcctacgtggtcatcgggctcctgttcatgatcctgaccgtggccgcgaacgagatgggcctcctggagacgaccaagaaggacctggggatcggccacgtggccgtcgagaaccaccaccacgccgccatgctcgacgtggacctgcaccccgcctccgcgtggaccctgtacgccgtggccaccacgatcatcacccccatgatgcgccacaccatcgagaacaccacggccaacatcagcctcaccgccatcgcgaaccaggccgccatcctgatggggctggacaagggctggccgatctccaagatggacatcggcgtccccctcctggccctggggtgctacagccaggtgaaccccctcaccctgaccgcggccgtgctgatgctcgtcgcccactacgccatcatcggccccgggctgcaggccaaggcgacgcgcgaggcccagaagcggaccgccgccggcatcatgaagaacccgaccgtggacgggatcgtggccatcgacctggaccccgtcgtgtacgacgcgaagttcgagaagcagctcggccagatcatgctgctgatcctctgcacctcccagatcctgctgatgcgcacgacctgggccctctgcgagagcatcaccctggccaccggccccctgacgaccctctgggaggggtcccccggcaagttctggaacaccaccatcgccgtgagcatggccaacatcttccgggggagctacctggcgggcgccggcctggccttctccctcatgaagtccctcgggggcgggcgccgggggacgggggcccagggcgagaccctgggcgagaagtggaagcgccagctcaaccagctgtccaagagcgagttcaacacctacaagcggtccgggatcatggaggtcgaccgcagcgaggcgaaggagggcctgaagcgcggggagaccacgaagcacgccgtgtcccgcggcaccgccaagctccggtggttcgtggagcgcaacctggtcaagccggaggggaaggtgatcgacctgggctgcggccgcggcgggtggagctactactgcgccgggctgaagaaggtgaccgaggtcaaggggtacaccaagggcgggcccggccacgaggagcccatccccatggccacgtacgggtggaacctcgtgaagctgcactccggcaaggacgtgttcttcatcccgcccgagaagtgcgacaccctgctctgcgacatcggggagagctcccccaaccccaccatcgaggagggccgcaccctgcgggtcctgaagatggtggagccgtggctccgcgggaaccagttctgcatcaagatcctgaacccctacatgcccagcgtggtcgagacgctggagcagatgcagcggaagcacggcggcatgctcgtgcgcaaccccctgtcccggaacagcacccacgagatgtactgggtgtcctgcgggaccggcaacatcgtcagcgcggtgaacatgacctcccgcatgctgctcaaccgcttcaccatggcccaccggaagccgacgtacgagcgcgacgtggacctgggggccggcacccggcacgtcgccgtggagcccgaggtggccaacctggacatcatcggccagcgcatcgagaacatcaagcacgagcacaagagcacctggcactacgacgaggacaacccctacaagacctgggcgtaccacgggtcctacgaggtcaagcccagcggcagcgcctccagcatggtgaacggggtcgtgaagctcctgacgaagccgtgggacgtgatccccatggtcacccagatcgccatgaccgacaccacgcccttcggccagcagcgggtgttcaaggagaaggtggacacccgcacccccaaggccaagcgggggaccgcccagatcatggaggtcacggcgaagtggctgtggggcttcctctcccgcaacaagaagccgcggatctgcacccgcgaggagttcacccggaaggtgcgcagcaacgccgccatcggcgccgtgttcgtcgacgagaaccagtggaactccgcgaaggaggccgtggaggacgagcggttctgggacctggtgcaccgcgagcgggagctgcacaagcaggggaagtgcgcgacctgcgtctacaacatgatgggcaagcgcgagaagaagctcggggagttcggcaaggccaaggggagccgggccatctggtacatgtggctgggcgcgcgcttcctggagttcgaggccctcggcttcatgaacgaggaccactggttctcccgggagaacagcctgtccggggtggagggcgaggggctgcacaagctcggctacatcctgcgcgacatcagcaagatccccgggggcaacatgtacgccgacgacacggccggctgggacacccggatcaccgaggacgacctgcagaacgaggccaagatcaccgacatcatggagcccgagcacgcgctcctggccaagtccatcttcaagctgacgtaccagaacaaggtggtccgcgtgcagcgcccggccaagaacgggaccgtgatggacgtcatcagccggcgcgaccagcggggctccggccaggtgggcacctacggcctcaacaccttcacgaacatggaggcccagctgatccgccagatggagagcgaggggatcttctcccccagcgagctggagacccccaacctcgccggccgggtgctgaactggctggagaagcacggggtcgagcgcctcaagcggatggcgatctccggcgacgactgcgtggtgaagcccatcgacgaccgcttcgccaccgccctgaccgccctgaacgacatggggaaggtccggaaggacatcccgcagtgggagcccagcaagggctggaacgactggcagcaggtccccttctgcagccaccacttccaccagctcatcatgaaggacggccgcgagatcgtggtcccctgccggaaccaggacgagctggtggggcgcgcccgggtgtcccagggcgcggggtggagcctgcgcgagacggcctgcctcggcaagtcctacgcccagatgtggcagctgatgtacttccaccggcgcgacctgcggctcgccgcgaacgccatctgcagcgccgtcccggtggactgggtgcccacctcccgcaccacctggagcatccacgcccaccaccagtggatgacgaccgaggacatgctgtccgtctggaaccgggtgtggatcgaggagaacccctggatggaggacaagacccacgtgagctcctggggcgacgtcccctacctgggcaagcgcgaggaccagtggtgcggcagcctcatcgggctgaccgcccgcgcgacgtgggccaccaacatccaggtggccatcaaccaggtgcggcgcctgctcggcaacgagaactacctggactacatgacctccatgaagcggttcaagaacgagagcgacccggagggggccctgtggtga

SEQ ID NO: 8566 - RNA, 9879 nt, synthetic construct
  misc_feature 1..9879: note = derived and/or modified CDS sequence (opt1) from DENV-1__FJ898399__SS-prME
  source 1..9879: mol_type = other RNA
agcgtgaccatgctgctcatgctgatgcccaccgccctggccttccacctcacgacccgcggcggggagccccacatgatcgtgagcaagcaggagcggggcaagagcctgctgttcaagaccagcgcgggggtgaacatgtgcaccctcatcgccatggacctgggcgagttctgcgaggacaccatgacctacaagtgcccccgcatcaccgaggccgagcccgacgacgtggactgctggtgcaacgccaccgacacgtgggtcacctacgggacctgcagccagaccggcgagcaccggcgcgacaagcggtccgtggccctggcgccccacgtgggcctcgggctggagacgcgcaccgagacctggatgagctccgagggcgcctggaagcagatccagcgggtcgagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggaccagcggggcctccaccagccaggagacctggaaccggaaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctcgtccagatcaagtacgagggcaccgacgccccctgcaagatccccttctccacccaggacgagaagggggtgacccagaacggccggctgatcacggccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacaccgcctgggacttcgggagcatcggcggcgtgttcacgtccgtcgggaagctggtgcaccagatcttcggcaccgcctacggggtgctgttcagcggcgtctcctggaccatgaagatcgggatcggcgtgctcctgacctggctgggcctcaacagccgctccacgagcctgtccatgacctgcatcgccgtggggctggtcaccctctacctgggcgtgatggtgcaggccgacagcgggtgcgtcatcaactggaagggccgggagctgaagtgcgggagcggcatcttcgtgaccaacgaggtgcacacgtggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagctgaccgtggtggtcggggacgtggcgggcatcctcgggcagggcaagaagatgatccggccccagcccatggagtacaagtactcctggaagtcctggggcaaggccaagatcatcggggccgacgcccagaacaccacgttcatcatcgacggccccaacaccccggagtgccccgacgaccagcgcgcgtggaacatctgggaggtggaggactacgggttcggcatcttcaccaccaacatctggctgaagctgcgggactcctacacgcaggtctgcgaccaccgcctcatgagcgccgccatcaaggactccaaggccgtgcacgccgacatgggctactggatcgagagcgagaagaacgagacctggaagctggcgcgggcctccttcatcgaggtgaagacctgcatctggcccaagagccacaccctgtggtccaacggggtcctcgagagcgagatgatcatccccaagatctacggcgggccgatctcccagcacaactaccgccccggctacttcacgcagaccgccgggccctggcacctgggcaagctggagctcgacttcgacctgtgcgagggcaccaccgtggtggtcgacgagcactgcgggaaccggggcccgagcctgcgcacgaccaccgtgaccgggaagatcatccacgagtggtgctgccggtcctgcacgctgccgcccctccgcttcaagggcgaggacgggtgctggtacggcatggagatccggcccgtgaaggagaaggaggagaacctggtcaagagcatggtgagcgccggctccggggaggtggacagcttctccctcggcctgctgtgcatcagcatcatgatcgaggaggtcatgcgctcccggtggagccgcaagatgctcatgaccgggaccctggccgtgttcttcctgctcatcatgggccagctgacctggaacgacctgatccggctctgcatcatggtgggggcgaacgcctccgaccgcatgggcatgggcacgacctacctggccctgatggccaccttcaagatgcgcccgatgttcgccgtcgggctcctgttccggcgcctgaccagccgggaggtgctcctgctgacgatcggcctctccctggtggcgagcgtcgagctgcccaactccctcgaggagctgggggacggcctggccatgggcatcatgatcctcaagctgctgaccgacttccagagccaccagctctgggccaccctgctgtccctcaccttcatcaagacgaccttcagcctgcactacgcctggaagaccatggcgatggtgctgtccatcgtcagcctcttccccctgtgcctgtccaccacgagccagaagaccacctggctccccgtgctgctggggtccctcggctgcaagccgctgaccatgttcctgatcgccgagaacaagatctgggggcgcaagagctggcccctcaacgagggcatcatggccgtggggatcgtcagcatcctgctgtccagcctcctgaagaacgacgtgcccctggccggccccctcatcgccggcgggatgctgatcgcgtgctacgtgatctccggcagctccgccgacctgagcctcgagaaggccgccgaggtctcctgggaggaggaggccgagcacagcggggcgtcccacaacatcctggtggaggtgcaggacgacggcacgatgaagatcaaggacgaggagcgggacgacaccctgaccatcctcctgaaggccaccctgctcgccgtcagcggggtgtacccgctgtccatccccgccaccctgttcgtgtggtacttctggcagaagaagaagcagcgcagcggcgtcctctgggacacgcccagcccgcccgaggtggagcgggccgtgctggacgacggcatctaccgcatcatgcagcgggggctgctgggccgcagccaggtcggggtgggcgtgttccaggagaacgtcttccacaccatgtggcacgtgacccgcggggccgtgctcatgtaccagggcaagcgcctggagccctcctgggccagcgtcaagaaggacctgatctcctacggcgggggctggcggctccaggggagctggaacaccggcgaggaggtccaggtgatcgccgtcgagcccgggaagaaccccaagaacgtgcagacggcccccggcaccttcaagacctccgagggcgaggtgggggccatcgcgctggacttcaagcccggcaccagcgggagccccatcgtcaaccgcgagggcaagatcgtgggcctgtacgggaacggcgtggtcacgacctccgggacctacgtgagcgccatcgcccaggccaaggcgtcccaggagggccccctcccggagatcgaggacgaggtgttccggaagcgcaacctgaccatcatggacctgcaccccgggagcggcaagacgcggcgctacctccccgccatcgtccgggaggccatcaagcgcaagctgcggaccctgatcctcgccccgacccgcgtggtggcctccgagatggcggaggccctgaagggcatgcccatccgctaccagaccacggccgtcaagagcgagcacaccgggaaggagatcgtggacctgatgtgccacgccaccttcaccatgcggctcctgtcccccgtgcgcgtccccaactacaacatgatcatcatggacgaggcccacttcacggacccgagctccatcgcggcccggggctacatcagcacccgcgtggggatgggcgaggccgccgccatcttcatgaccgcgacgccgcccgggtccgtggaggccttcccccagagcaacgccgtcatccaggacgaggagcgggacatcccggagcgctcctggaacagcggctacgagtggatcacggacttccccggcaagaccgtgtggttcgtgccctccatcaagagcgggaacgacatcgccaactgcctgcggaagaacggcaagcgcgtcatccagctctcccggaagaccttcgacaccgagtaccagaagacgaagaacaacgactgggactacgtggtgaccaccgacatcagcgagatgggggcgaacttccgcgccgaccgggtcatcgacccccgccggtgcctgaagccggtgatcctgaaggacggccccgagcgcgtgatcctcgccgggcccatgcccgtcaccgtggcctccgccgcgcagcggcgcggccggatcggccgcaaccacaacaaggagggggaccagtacatctacatgggccagccgctgaacaacgacgaggaccacgcccactggacggaggccaagatgctgctcgacaacatcaacacccccgaggggatcatccccgccctgttcgagcccgagcgggagaagtccgccgcgatcgacggcgagtaccgcctgcgcggggaggcccggaagaccttcgtcgagctcatgcgccggggcgacctgccggtgtggctgagctacaaggtggcctccgagggcttccagtacagcgaccgccggtggtgcttcgacggggagcgcaacaaccaggtcctcgaggagaacatggacgtggagatctggaccaaggagggcgagcggaagaagctgcgcccccggtggctggacgcccgcacgtactccgaccccctcgccctgcgggagttcaaggagttcgcggccgggcgccggagcgtgtccggcgacctgatcctcgagatcggcaagctgccccagcacctgacccagcgcgcccagaacgccctcgacaacctggtcatgctgcacaacagcgagcagggcgggcgggcgtaccgccacgccatggaggagctcccggacaccatcgagaccctgatgctgctcgccctgatcgccgtgctgaccgggggcgtgaccctcttcttcctgtccgggcggggcctgggcaagaccagcatcgggctcctgtgcgtcatggcctccagcgtgctgctctggatggcgtccgtggagccccactggatcgccgccagcatcatcctggagttcttcctgatggtcctcctgatccccgagcccgaccgccagcggaccccgcaggacaaccagctggcctacgtggtgatcggcctcctgttcatgatcctgaccgtcgccgcgaacgagatggggctcctggagacgaccaagaaggacctgggcatcgggcacgtggccgtggagaaccaccaccacgccgccatgctcgacgtcgacctgcaccccgcctccgcgtggaccctgtacgccgtggccaccacgatcatcacccccatgatgcgccacaccatcgagaacaccacggccaacatcagcctcaccgccatcgcgaaccaggccgccatcctgatgggcctggacaagggctggccgatctccaagatggacatcggggtgcccctcctggccctgggctgctacagccaggtcaaccccctcaccctgaccgcggccgtgctgatgctcgtggcccactacgccatcatcgggcccggcctgcaggccaaggcgacgcgggaggcccagaagcgcaccgccgccgggatcatgaagaacccgaccgtcgacggcatcgtggccatcgacctggaccccgtggtctacgacgcgaagttcgagaagcagctcggccagatcatgctgctgatcctctgcacctcccagatcctgctgatgcgcacgacctgggccctctgcgagagcatcaccctggccaccgggcccctgacgaccctctgggagggctcccccgggaagttctggaacaccaccatcgccgtgagcatggccaacatcttccggggcagctacctggcgggcgccgggctggccttctccctcatgaagtccctgggcgggggccgccgggggacgggcgcccagggcgagaccctgggggagaagtggaagcgccagctcaaccagctgtccaagagcgagttcaacacctacaagcggtccggcatcatggaggtggaccgcagcgaggcgaaggaggggctgaagcggggcgagaccacgaagcacgccgtctcccgcgggaccgccaagctccggtggttcgtggagcgcaacctggtgaagccggagggcaaggtcatcgacctgggctgcgggcggggcgggtggagctactactgcgccggcctgaagaaggtgaccgaggtgaaggggtacaccaagggcggccccgggcacgaggagcccatccccatggccacgtacggctggaacctcgtcaagctgcactccgggaaggacgtgttcttcatcccgcccgagaagtgcgacaccctgctctgcgacatcggcgagagctcccccaaccccaccatcgaggaggggcgcaccctgcgggtgctgaagatggtcgagccgtggctccgcggcaaccagttctgcatcaagatcctgaacccctacatgcccagcgtggtggagacgctggagcagatgcagcggcgccacggcgggatgctcgtccggaaccccctgtcccgcaacagcacccacgagatgtactgggtgtcctgcggcaccgggaacatcgtgagcgcggtcaacatgacctcccggatgctgctcaaccgcttcaccatggcccaccgcaagccgacgtacgagcgggacgtggacctgggcgccggcacccgccacgtggccgtcgagcccgaggtggccaacctggacatcatcgggcagcggatcgagaacatcaagcacgagcacaagagcacctggcactacgacgaggacaacccctacaagacctgggcgtaccacggctcctacgaggtgaagcccagcgggagcgcctccagcatggtcaacggcgtggtcaagctcctgacgaagccgtgggacgtgatccccatggtgacccagatcgccatgaccgacaccacgcccttcgggcagcagcgcgtcttcaaggagaaggtggacacccggacccccaaggccaagcgcggcaccgcccagatcatggaggtgacggcgaagtggctgtggggcttcctctcccggaacaagaagccgcgcatctgcacccgggaggagttcacccgcaaggtccggagcaacgccgccatcggggccgtgttcgtggacgagaaccagtggaactccgcgaaggaggccgtcgaggacgagcgcttctgggacctggtgcaccgggagcgcgagctgcacaagcagggcaagtgcgcgacctgcgtgtacaacatgatggggaagcgggagaagaagctcggcgagttcgggaaggccaagggcagccgcgccatctggtacatgtggctgggcgcgcggttcctggagttcgaggccctcgggttcatgaacgaggaccactggttctcccgcgagaacagcctgtccggcgtcgagggggagggcctgcacaagctcgggtacatcctgcgggacatcagcaagatccccggcggcaacatgtacgccgacgacacggccgggtgggacacccgcatcaccgaggacgacctgcagaacgaggccaagatcaccgacatcatggagcccgagcacgcgctcctggccaagtccatcttcaagctgacgtaccagaacaaggtggtgcgggtccagcgcccggccaagaacggcaccgtgatggacgtgatcagccgccgggaccagcgcgggtccggccaggtcggcacctacgggctcaacaccttcacgaacatggaggcccagctgatccggcagatggagagcgagggcatcttctcccccagcgagctggagacccccaacctcgccgggcgcgtgctggactggctggagaagcacggcgtggagcggctcaagcgcatggcgatctccggggacgactgcgtcgtgaagcccatcgacgaccggttcgccaccgccctgaccgccctgaacgacatgggcaaggtgcgcaaggacatcccgcagtgggagcccagcaagggctggaacgactggcagcaggtccccttctgcagccaccacttccaccagctcatcatgaaggacgggcgggagatcgtggtgccctgccgcaaccaggacgagctggtcggccgggcccgcgtgtcccagggggcgggctggagcctgcgggagacggcctgcctcgggaagtcctacgcccagatgtggcagctgatgtacttccaccgccgggacctgcgcctcgccgcgaacgccatctgcagcgccgtgccggtcgactgggtgcccacctcccggaccacctggagcatccacgcccaccaccagtggatgacgaccgaggacatgctgtccgtgtggaaccgcgtctggatcgaggagaacccctggatggaggacaagacccacatcagctcctggggcgacgtgccctacctgggcaagcgggaggaccagtggtgcgggagcctcatcggcctgaccgcccgcgcgacgtgggccaccaacatccaggtggccatcaaccaggtccgccggctgatcgggaacgagaactacctcgactacatgacctccatgaagcgcttcaagaacgagagcgacccggagggcgccctgtggtga

SEQ ID NO: 8567 - RNA, 9879 nt, synthetic construct
  misc_feature 1..9879: note = derived and/or modified CDS sequence (opt1) from DENV-1__FJ898401__SS-prME
  source 1..9879: mol_type = other RNA
agcgtgaccatgctgctcatgctgatgcccaccgccctggccttccacctcaccacccgcggcggggagccccacatgatcgtgagcaagcaggagcggggcaagagcctgctgttcaagaccagcgcgggggtgaacatgtgcaccctcatcgccatggacctgggcgagttctgcgaggacacgatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggaccagcggggcctccaccagccaggagacctggaaccggaaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctcgtccagatcaagtacgagggcaccgacgccccctgcaagatccccttctccacccaggacgagaagggggtgacccagaacggccggctgatcacggccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacaccgcctgggacttcgggagcatcggcggcgtgttcacgtccgtcgggaagctggtgcaccagatcttcggcaccgcctacggggtgctgttcagcggcgtctcctggaccatgaagatcgggatcggcgtgctcctgacctggctgggcctcaacagccgctccacgagcctgtccatgacctgcatcgccgtggggctggtcaccctctacctgggcgtgatggtgcaggccgacagcgggtgcgtcatcaactggaagggccgggagctgaagtgcgggagcggcatcttcgtgaccaacgaggtgcacacgtggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagttcaccgtggtggtcggggacgtggcgggcatcctggcccaggggaagaagatgatccggccccagcccatggagtacaagtactcctggaagtcctggggcaaggccaagatcatcggcgccgacgtgcagaacaccacgttcatcatcgacgggcccaacaccccggagtgccccgacgaccagcgcgcgtggaacatctgggaggtcgaggactacggcttcgggatcttcaccaccaacatctggctcaagctgcgggactcctacacccaggtgtgcgaccaccgcctgatgagcgccgccatcaaggactccaaggccgtgcacgccgacatgggctactggatcgagagcgagaagaacgagacctggaagctcgcgcgggcctccttcatcgaggtcaagacctgcatctggcccaagagccacaccctgtggtccaacggcgtgctggagagcgagatgatcatccccaagatctacgggggcccgatctcccagcacaactaccgccccgggtacttcacgcagaccgccggcccctggcacctcgggaagctggagctggacttcgacctctgcgagggcaccaccgtggtcgtggacggccactgcgggaaccggggcccgagcctgcgcacgaccaccgtgaccgggaagatcatccacgagtggtgctgccggtcctgcacgctgccgcccctgcgcttcaagggcgaggacgggtgctggtacggcatggagatccggcccgtcaaggagaaggaggagaacctggtcaagagcatggtgagcgccggctccggggaggtcgacagcttctccctgggcctcctgtgcatcagcatcatgatcgaggaggtgatgcgctcccggtggagccgcaagatgctgatgaccgggaccctcgccgtgttcttcctgctgatcatgggccagctcacctggaacgacctgatccggctgtgcatcatggtcggggcgaacgcctccgaccgcatgggcatgggcacgacctacctcgccctgatggccaccttcaagatgcgcccgatgttcgccgtggggctcctgttccggcgcctgaccagccgggaggtgctgctcctgacgatcggcctgtccctcgtcgcgagcgtggagctgcccaactccctggaggagctcggggacggcctggccatgggcatcatgatcctgaagctcctgaccgacttccagagccaccagctgtgggccaccctcctgtccctgaccttcatcaagacgaccttcagcctccactacgcctggaagaccatggcgatggtcctgtccatcgtgagcctgttccccctctgcctgtccaccacgagccagaagaccacctggctgcccgtgctcctggggtccctgggctgcaagccgctcaccatgttcctgatcgccgagaacaagatctgggggcgcaagagctggcccctgaacgagggcatcatggccgtcgggatcgtgagcatcctcctgtccagcctgctcaagaacgacgtgcccctggccggccccctgatcgccggcgggatgctcatcgcgtgctacgtcatctccggcagctccgccgacctgagcctggagaaggccgccgaggtgtcctgggagaaggaggccgagcacagcggggcgtcccacaacatcctcgtggaggtccaggacgacggcacgatgaagatcaaggacgaggagcgggacgacaccctgaccatcctgctcaaggccaccctgctggccgtgagcggggtgtacccgctctccatccccgccaccctgttcgtctggcacttctggcagaagaagaagcagcgcagcggcgtgctgtgggacacgcccagcccgcccgaggtggagcgggccgtcctcgacgacggcatctaccgcatcatgcagcgggggctgctgggccgcagccaggtgggggtgggcgtcttccaggagaacgtgttccacaccatgtggcacgtgacccgcggggccgtcctgatgtaccagggcaagcgcctcgagccctcctgggccagcgtgaagaaggacctgatctcctacggcgggggctggcggctgcaggggagctggaacaccggcgaggaggtgcaggtcatcgccgtggagcccgggaagaaccccaagaacgtgcagacggcccccggcaccttcaagacctccgagggcgaggtcggggccatcgcgctcgacttcaagcccggcaccagcgggagccccatcgtgaaccgcgagggcaagatcgtgggcctgtacgggaacggcgtcgtgacgacctccgggacctacgtgagcgccatcgcccaggccaaggcgtcccaggagggccccctgccggagatcgaggacgaggtcttccggaagcgcaacctcaccatcatggacctgcaccccgggagcggcaagacgcggcgctacctgcccgccatcgtgcgggaggccatcaagcgcaagctccggaccctgatcctggccccgacccgcgtggtcgcctccgagatggcggaggccctcaagggcatgcccatccgctaccagaccacggccgtcaagagcgagcacaccgggaaggagatcgtggacctgatgtgccacgccaccttcaccatgcggctgctctcccccgtccgcgtgcccaactacaacatgatcatcatggacgaggcccacttcacggacccgagctccatcgcggcccggggctacatcagcacccgcgtggggatgggcgaggccgccgccatcttcatgaccgcgacgccgcccgggtccgtcgaggccttcccccagagcaacgccgtgatccaggacgaggagcgggacatcccggagcgctcctggaacagcggctacgagtggatcacggacttccccggcaagaccgtgtggttcgtcccctccatcaagagcgggaacgacatcgccaactgcctgcggaagaacggcaagcgcgtgatccagctgtcccggaagaccttcgacaccgagtaccagaagacgaagaacaacgactgggactacgtggtcaccaccgacatcagcgagatgggggcgaacttccgcgccgaccgggtgatcgacccccgccggtgcctcaagccggtgatcctgaaggacggccccgagcgcgtcatcctggccgggcccatgcccgtgaccgtcgcctccgccgcgcagcggcgcggccggatcggccgcaaccacaacaaggagggggaccagtacatctacatgggccagccgctcaacaacgacgaggaccacgcccactggacggaggccaagatgctgctggacaacatcaacacccccgaggggatcatccccgccctcttcgagcccgagcgggagaagtccgccgcgatcgacggcgagtaccgcctgcgcggggaggcccggaagaccttcgtggagctgatgcgccggggcgacctcccggtgtggctgagctacaaggtcgcctccgagggcttccagtacagcgaccgccggtggtgcttcgacggggagcgcaacaaccaggtgctggaggagaacatggacgtggagatctggaccaaggagggcgagcggaagaagctccgcccccggtggctggacgcccgcacgtactccgaccccctggccctccgggagttcaaggagttcgcggccgggcgccggagcgtctccggcgacctgatcctggagatcggcaagctcccccagcacctgacccagcgcgcccagaacgccctggacaacctcgtgatgctgcacaacagcgagcagggcgggcgggcgtaccgccacgccatggaggagctgccggacaccatcgagaccctcatgctgctggccctcatcgccgtgctgaccgggggcgtcacgctgttcttcctctccgggcggggcctgggcaagaccagcatcgggctgctctgcgtgatggcctccagcgtgctgctgtggatggcgtccgtcgagccccactggatcgccgccagcatcatcctcgagttcttcctgatggtgctgctcatccccgagcccgaccgccagcggaccccgcaggacaaccagctggcctacgtggtcatcggcctcctcttcatgatcctgaccgtggccgcgaacgagatggggctgctcgagacgaccaagaaggacctgggcatcgggcacgtggccgtcgagaaccaccaccacgccgccatgctggacgtggacctccaccccgcctccgcgtggaccctgtacgccgtggccaccacgatcatcacccccatgatgcgccacaccatcgagaacaccacggccaacatcagcctgaccgccatcgcgaaccaggccgccatcctcatgggcctggacaagggctggccgatctccaagatggacatcggggtccccctgctcgccctgggctgctacagccaggtgaaccccctgaccctcaccgcggccgtgctgatgctggtcgcccactacgccatcatcgggcccggcctccaggccaaggcgacgcgggaggcccagaagcgcaccgccgccgggatcatgaagaacccgaccgtggacggcatcgtggccatcgacctggaccccgtcgtgtacgacgcgaagttcgagaagcagctgggccagatcatgctcctgatcctgtgcacctcccagatcctcctgatgcgcacgacctgggccctgtgcgagagcatcaccctcgccaccgggcccctgacgaccctgtgggagggctcccccgggaagttctggaacaccaccatcgccgtgagcatggccaacatcttccggggcagctacctcgcgggcgccgggctggccttctccctgatgaagtccctcggcgggggccgccgggggacgggcgcccacggcgagaccctgggggagaagtggaagcgccagctgaaccagctctccaagagcgagttcaacacctacaagcggtccggcatcatggaggtcgaccgcagcgaggcgaaggaggggctgaagcggggcgagaccacgaagcacgccgtgtcccgcgggaccgccaagctgcggtggttcgtggagcgcaacctcgtcaagccggagggcaaggtgatcgacctgggctgcgggcggggcgggtggagctactactgcgccggcctgaagaaggtgaccgaggtcaaggggtacaccaagggcggccccgggcacgaggagcccatccccatggccacgtacggctggaacctggtgaagctccactccgggaaggacgtgttcttcatcccgcccgagaagtgcgacaccctgctgtgcgacatcggcgagagctcccccaaccccaccatcgaggaggggcgcaccctccgggtcctgaagatggtggagccgtggctgcgcggcaaccagttctgcatcaagatcctcaacccctacatgcccagcgtggtcgagacgctggagcagatgcagcggaagcacggcgggatgctggtgcgcaaccccctctcccggaacagcacccacgagatgtactgggtgtcctgcggcaccgggaacatcgtcagcgcggtgaacatgacctcccgcatgctgctgaaccggttcaccatggcccaccgcaagccgacgtacgagcgcgacgtggacctcggcgccggcacccggcacgtcgccgtggagcccgaggtggccaacctggacatcatcgggcagcgcatcgagaacatcaagcacgagcacaagagcacctggcactacgacgaggacaacccctacaagacctgggcgtaccacggctcctacgaggtcaagcccagcgggagcgcctccagcatggtgaacggcgtcgtgaagctgctcacgaagccgtgggacgtgatccccatggtcacccagatcgccatgaccgacaccacgcccttcgggcagcagcgggtgttcaaggagaaggtggacacccgcacccccaaggccaagcggggcaccgcccagatcatggaggtcacggcgaagtggctgtggggcttcctgtcccgcaacaagaagccgcggatctgcacccgcgaggagttcacccggaaggtgcgcagcaacgccgccatcggggccgtgttcgtcgacgagaaccagtggaactccgcgaaggaggccgtggaggacgagcggttctgggacctcgtgcaccgcgagcgggagctgcacaagcagggcaagtgcgcgacctgcgtctacaacatgatggggaagcgcgagaagaagctgggcgagttcgggaaggccaagggcagccgggccatctggtacatgtggctcggcgcgcgcttcctggagttcgaggccctggggttcatgaacgaggaccactggttctcccgggagaacagcctctccggcgtggagggggagggcctgcacaagctggggtacatcctccgcgacatcagcaagatccccggcggcaacatgtacgccgacgacacggccgggtgggacacccggatcaccgaggacgacctgcagaacgaggccaagatcaccgacatcatggagcccgagcacgcgctgctcgccaagtccatcttcaagctgacgtaccagaacaaggtggtccgcgtgcagcggccggccaagaacggcaccgtgatggacgtcatcagccgccgcgaccagcgggggtccggccaggtgggcacctacgggctgaacaccttcacgaacatggaggcccagctcatccgccagatggagagcgagggcatcttctcccccagcgagctggagacccccaacctggccgggcgggtgctcgactggctggagaagcacggcgtcgagcgcctgaagcggatggcgatctccggggacgactgcgtggtgaagcccatcgacgaccgcttcgccaccgccctcaccgccctgaacgacatgggcaaggtccggaaggacatcccgcagtgggagcccagcaagggctggaacgactggcagcaggtccccttctgcagccaccacttccaccagctgatcatgaaggacgggcgcgagatcgtggtcccctgccggaaccaggacgagctcgtgggccgcgcccgggtgtcccagggggcgggctggagcctgcgcgagacggcctgcctggggaagtcctacgcccagatgtggcagctcatgtacttccaccggcgcgacctgcggctggccgcgaacgccatctgcagcgccgtcccggtggactgggtgcccacctcccgcaccacctggagcatccacgcccaccaccagtggatgacgaccgaggacatgctctccgtctggaaccgggtgtggatcgaggagaacccctggatggaggacaagacccacatcagctcctggggcgacgtgccctacctgggcaagcgcgaggaccagtggtgcgggagcctgatcggcctcaccgcccgggcgacgtgggccaccaacatccaggtcgccatcaaccaggtgcgccgcctgatcgggaacgagaactacctggactacatgacctccatgaagcggttcaagaacgagagcgacccggagggcgccctctggtga

SEQ ID NO: 8568 - RNA, 9879 nt, synthetic construct
  misc_feature 1..9879: note = derived and/or modified CDS sequence (opt1) from DENV-1__FJ898402__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagaccagcgcgggggtgaacatgtgcaccctcatcgccatggacctgggcgagttctgcgaggacaccatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggaccagcggggcctccaccagccaggagacctggaaccggaaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctcgtccagatcaagtacgagggcaccgacgccccctgcaagatccccttctccacccaggacgagaagggggtgacccagaacggccggctgatcacggccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacaccgcctgggacttcgggagcatcggcggcgtgttcacgtccgtcgggaagctggtgcaccagatcttcggcaccgcctacggggtgctgttcagcggcgtctcctggaccatgaagatcgggatcggcgtgctcctgacctggctgggcctcaacagccgctccacgagcctgtccatgacctgcatcgccgtggggctggtcaccctctacctgggcgtgatggtgcaggccgacagcgggtgcgtcatcaactggaagggccgggagctgaagtgcgggagcggcatcttcgtgaccaacgaggtgcacacgtggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaactacatcctcctggagaacgacatgaagttcaccgtggtggtcggggacgtggcgggcatcctggcccaggggaagaagatgatccggccccagcccatggagtacaagtactcctggaagtcctggggcaaggccaagatcatcggcgccgacgtgcagaacaccacgttcatcatcgacgggcccaacaccccggagtgccccgacgaccagcgcgcgtggaacatctgggaggtcgaggactacggcttcgggatcttcaccaccaacatctggctcaagctgcgggactcctacacccaggtgtgcgaccaccgcctgatgagcgccgccatcaaggactccaaggccgtgcacgccgacatgggctactggatcgagagcgagaagaacgagacctggaagctcgcgcgggcctccttcatcgaggtcaagacctgcatctggcccaagagccacaccctgtggtccaacggcgtgctggagagcgagatgatcatccccaagatctacgggggcccgatctcccagcacaactaccgccccgggtacttcacgcagaccgccggcccctggcacctcgggaagctggagctggacttcgacctctgcgagggcaccaccgtggtcgtggacgagcactgcggcaaccgggggccgagcctgcgcacgaccaccgtgaccggcaagatcatccacgagtggtgctgccggtcctgcacgctgccgcccctgcgcttcaagggggaggacggctgctggtacgggatggagatccggcccgtcaaggagaaggaggagaacctggtcaagagcatggtgagcgccggctccggcgaggtcgacagcttctccctggggctcctgtgcatcagcatcatgatcgaggaggtgatgcgctcccggtggagccgcaagatgctgatgaccggcaccctcgccgtgttcttcctgctgatcatggggcagctcacctggaacgacctgatccggctgtgcatcatggtcggcgcgaacgcctccgaccgcatggggatgggcacgacctacctcgccctgatggccaccttcaagatgcgcccgatgttcgccgtggggctcctgttccggcgcctgaccagccgggaggtgctgctcctgacgatcgggctgtccctcgtcgcgagcgtggagctgcccaactccctggaggagctcggcgacgggctggccatgggcatcatgatcctgaagctcctgaccgacttccagagccaccagctgtgggccaccctcctgtccctgaccttcatcaagacgaccttcagcctccactacgcctggaagaccatggcgatggtcctgtccatcgtgagcctgttccccctctgcctgtccaccacgagccagaagaccacctggctgcccgtgctcctgggctccctggggtgcaagccgctcaccatgttcctgatcgccgagaacaagatctggggccgcaagagctggcccctgaacgaggggatcatggccgtcggcatcgtgagcatcctcctgtccagcctgctcaagaacgacgtgcccctggccgggcccctgatcgccggcggcatgctcatcgcgtgctacgtcatctccgggagctccgccgacctgagcctggagaaggccgccgaggtgtcctgggaggaggaggccgagcacagcggcgcgtcccacaacatcctcgtggaggtccaggacgacgggacgatgaagatcaaggacgaggagcgggacgacaccctgaccatcctgctcaaggccaccctgctggccgtgagcggcgtgtacccgctctccatccccgccaccctgttcgtctggtacttctggcagaagaagaagcagcgcagcggggtgctgtgggacacgcccagcccgcccgaggtggagcgggccgtcctcgacgacggcatctaccgcatcatgcagcggggcctgctggggcgcagccaggtgggcgtgggggtcttccaggagaacgtgttccacaccatgtggcacgtgacccggggcgcggtcctgatgtaccaggggaagcgcctcgagccctcctgggccagcgtgaagaaggacctgatctcctacggcggcgggtggcggctgcagggcagctggaacaccggggaggaggtgcaggtcatcgccgtggagcccggcaagaaccccaagaacgtgcagacggcccccgggaccttcaagacctccgagggcgaggtcggcgccatcgcgctcgacttcaagcccgggaccagcggcagccccatcgtgaaccgcgaggggaagatcgtgggcctgtacggcaacggggtcgtgacgacctccggcacctacgtgagcgccatcgcccaggccaaggcgtcccaggaggggcccctgccggagatcgaggacgaggtcttccggaagcgcaacctcaccatcatggacctgcaccccggcagcgggaagacgcggcgctacctgcccgccatcgtgcgggaggccatcaagcgcaagctccggaccctgatcctggccccgacccgcgtggtcgcctccgagatggcggaggccctcaagggcatgcccatccgctaccagaccacggccgtcaagagcgagcacaccggcaaggagatcgtggacctgatgtgccacgccaccttcaccatgcggctgctctcccccgtccgcgtgcccaactacaacatgatcatcatggacgaggcccacttcacggacccgagctccatcgcggcccgggggtacatcagcacccgcgtgggcatgggggaggccgccgccatcttcatgaccgcgacgccgcccggctccgtcgaggccttcccccagagcaacgccgtgatccaggacgaggagcgggacatcccggagcgctcctggaacagcgggtacgagtggatcacggacttccccggcaagaccgtgtggttcgtcccctccatcaagagcggcaacgacatcgccaactgcctgcggaagaacgggaagcgcgtgatccagctgtcccggaagaccttcgacaccgagtaccagaagacgaagaacaacgactgggactacgtggtcaccaccgacatcagcgagatgggcgcgaacttccgcgccgaccgggtgatcgacccccgccggtgcctcaagccggtgatcctgaaggacgggcccgagcgcgtcatcctggccggccccatgcccgtgaccgtcgcctccgccgcgcagcggcgcgggcggatcggccgcaaccacaacaaggagggcgaccagtacatctacatggggcagccgctcaacaacgacgaggaccacgcccactggacggaggccaagatgctgctggacaacatcaacacccccgagggcatcatccccgccctcttcgagcccgagcgggagaagtccgccgcgatcgacggggagtaccgcctgcgcggcgaggcccggaagaccttcgtggagctgatgcgccgcggggacctcccggtgtggctgagctacaaggtcgcctccgagggcttccagtacagcgaccgccggtggtgcttcgacggcgagcgcaacaaccaggtgctggaggagaacatggacgtggagatctggaccaaggagggggagcggaagaagctccgcccccggtggctggacgcccgcacgtactccgaccccctggccctccgggagttcaaggagttcgcggccggccgccggagcgtctccggggacctgatcctggagatcggcaagctcccccagcacctgacccagcgcgcccagaacgccctggacaacctcgtgatgctgcacaacagcgagcagggcgggcgggcgtaccgccacgccatggaggagctgccggacaccatcgagaccctcatgctgctggccctcatcgccgtgctgacgggcggggtcaccctgttcttcctctccggccgggggctgggcaagaccagcatcggcctgctctgcgtgatggcctccagcgtgctgctgtggaccgcgtccgtcgagccccactggatcgccgccagcatcatcctcgagttcttcctgatggtgctgctcatccccgagcccgaccgccagcggaccccgcaggacaaccagctggcctacgtggtcatcgggctcctcttcatgatcctgacggtggccgcgaacgagatgggcctgctcgagaccaccaagaaggacctggggatcggccacgtggccgtcgagaaccaccaccacgccgccatgctggacgtggacctccaccccgcctccgcgtggaccctgtacgccgtggccacgaccatcatcacccccatgatgcgccacaccatcgagaacacgaccgccaacatcagcctgaccgccatcgcgaaccaggccgccatcctcatggggctggacaagggctggccgatctccaagatggacatcggcgtccccctgctcgccctggggtgctacagccaggtgaaccccctgaccctcacggcggccgtgctgatgctggtcgcccactacgccatcatcggccccgggctccaggccaaggcgacccgggaggcccagaagcgcaccgccgccggcatcatgaagaacccgaccgtggacgggatcgtggccatcgacctggaccccgtcgtgtacgacgcgaagttcgagaagcagctgggccagatcatgctcctgatcctgtgcacgtcccagatcctcctgatgcgcaccacctgggccctgtgcgagagcatcaccctcgccacgggccccctgaccaccctgtgggaggggtcccccggcaagttctggaacaccacgatcgccgtgagcatggccaacatcttccgggggagctacctcgcgggcgccggcctggccttctccctgatgaagtccctcgggggcgggcgccggggcaccggggcccagggcgagaccctgggcgagaagtggaagcgccagctgaaccagctctccaagagcgagttcaacacctacaagcggtccgggatcatggaggtcgaccgcagcgaggcgaaggagggcctgaagcgcggggagacgaccaagcacgccgtgtcccgcggcaccgccaagctgcggtggttcgtggagcgcaacctcgtcaagccggaggggaaggtgatcgacctgggctgcggccgcggcgggtggagctactactgcgccgggctgaagaaggtgaccgaggtcaaggggtacacgaagggcgggcccggccacgaggagcccatccccatggccacctacgggtggaacctggtgaagctccactccggcaaggacgtgttcttcatcccgcccgagaagtgcgacaccctgctgtgcgacatcggggagagctcccccaaccccaccatcgaggagggccgcacgctccgggtcctgaagatggtggagccgtggctgcgcgggaaccagttctgcatcaagatcctcaacccctacatgcccagcgtggtcgagaccctggagcagatgcagcggaagcacggcggcatgctggtgcgcaaccccctctcccggaacagcacccacgagatgtactgggtgtcctgcgggaccggcaacatcgtcagcgcggtgaacatgacctcccgcatgctgctgaaccggttcacgatggcccaccgcaagccgacctacgagcgcgacgtggacctcggggccggcacccggcacgtcgccgtggagcccgaggtggccaacctggacatcatcggccagcgcatcgagaacatcaagcacgagcacaagagcacctggcactacgacgaggacaacccctacaagacgtgggcgtaccacgggtcctacgaggtcaagcccagcggcagcgcctccagcatggtgaacggggtcgtgaagctgctcaccaagccgtgggacgtgatccccatggtcacccagatcgccatgaccgacacgacccccttcggccagcagcgggtgttcaaggagaaggtggacacccgcacccccaaggccaagcgggggacggcccagatcatggaggtcaccgcgaagtggctgtggggcttcctgtcccgcaacaagaagccgcggatctgcacccgcgaggagttcacccggaaggtgcgcagcaacgccgccatcggcgccgtgttcgtcgacgagaaccagtggaactccgcgaaggaggccgtggaggacgagcggttctgggacctcgtgcaccgcgagcgggagctgcacaagcaggggaagtgcgccacgtgcgtctacaacatgatgggcaagcgcgagaagaagctgggggagttcggcaaggccaaggggagccgggccatctggtacatgtggctcggcgcgcgcttcctggagttcgaggccctgggcttcatgaacgaggaccactggttctcccgggagaacagcctctccggggtggagggcgaggggctgcacaagctgggctacatcctccgcgacatcagcaagatccccgggggcaacatgtacgccgacgacaccgccggctgggacacccggatcaccgaggacgacctgcagaacgaggccaagatcacggacatcatggagcccgagcacgcgctgctcgccaagtccatcttcaagctgacctaccagaacaaggtggtccgcgtgcagcggccggccaagaacgggaccgtgatggacgtcatcagccgccgcgaccagcggggctccggccaggtgggcacctacggcctgaacacgttcaccaacatggaggcccagctcatccgccagatggagagcgaggggatcttctcccccagcgagctggagacccccaacctggccggccgggtgctcgactggctggagaagcacggggtcgagcgcctgaagcggatggcgatctccggcgacgactgcgtggtgaagcccatcgacgaccgcttcgccaccgccctcacggccctgaacgacatggggaaggtccggaaggacatcccgcagtgggagcccagcaagggctggaacgactggcagcaggtccccttctgcagccaccacttccaccagctgatcatgaaggacggccgcgagatcgtggtcccctgccggaaccaggacgagctcgtggggcgcgcccgggtgtcccagggcgcggggtggagcctgcgcgagaccgcctgcctgggcaagtcctacgcccagatgtggcagctcatgtacttccaccggcgcgacctgcggctggccgcgaacgccatctgcagcgccgtcccggtggactgggtgcccacctcccgcaccacgtggagcatccacgcccaccaccagtggatgaccaccgaggacatgctctccgtctggaaccgggtgtggatcgaggagaacccctggatggaggacaagacccacatcagctcctggggcgacgtgccctacctgggcaagcgcgaggaccagtggtgcggcagcctgatcgggctcacggcccgggcgacctgggccaccaacatccaggtcgccatcaaccaggtgcgccgcctgatcggcaacgagaactacctggactacatgacctccatgaagcggttcaagaacgagagcgacccggagggggccctctggtga

SEQ ID NO: 8569 - RNA, 9879 nt, synthetic construct
  misc_feature 1..9879: note = derived and/or modified CDS sequence (opt1) from DENV-1__FJ898403__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagaccagcgccggggtgaacatgtgcaccctcatcgccatggacctgggcgagttctgcgaggacaccatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggaccagcggggcctccaccagccaggagacctggaaccggaaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctcgtccagatcaagtacgagggcaccgacgccccctgcaagatccccttctccacccaggacgagaagggggtgacccagaacggccggctgatcacggccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacaccgcctgggacttcgggagcatcggcggcgtgttcacgtccgtcgggaagctggtgcaccagatcttcggcaccgcctacggggtgctgttcagcggcgtctcctggaccatgaagatcgggatcggcgtgctcctgacctggctgggcctcaacagccgctccacgagcctgtccatgacctgcatcgccgtggggctggtcaccctctacctgggcgtgatggtgcaggccgacagcgggtgcgtcatcaactggaagggccgggagctgaagtgcgggagcggcatcttcgtgaccaacgaggtgcacacgtggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagttcaccgtggtggtcggggacgtggcgggcatcctggcccaggggaagaagatgatccggccccagcccatggagtacaagtactcctggaagtcctggggcaaggccaagatcatcggcgccgacgtgcagaacaccacgttcatcatcgacgggcccaacaccccggagtgccccgacgaccagcgcgcgtggaacatctgggaggtcgaggactacggcttcgggatcttcaccaccaacatctggctcaagctgcgggactcctacacccaggtgtgcgaccaccgcctgatgagcgccgccatcaaggactccaaggccgtgcacgccgacatgggctactggatcgagagcgagaagaacgagacctggaagctcgcgcgggcctccttcatcgaggtcaagacctgcatctggcccaagagccacaccctgtggtccaacggcgtgctggagagcgagatgatcatccccaagatctacgggggcccgatctcccagcacaactaccgccccgggtacttcacgcagaccgccggcccctggcacctcgggaagctggagctggacttcgacctctgcgagggcaccaccgtggtcgtggacgagcactgcggcaaccgggggccgagcctgcgcacgaccaccgtgaccggcaagatcatccacgagtggtgctgccggtcctgcacgctgccgcccctgcgcttcaagggggaggacggctgctggtacgggatggagatccggcccgtcaaggagaaggaggagaacctggtcaagagcatggtgagcgccggctccggcgaggtcgacagcttctccctggggctcctgtgcatcagcatcatgatcgaggaggtgatgcgctcccggtggagccgcaagatgctgatgaccggcaccctcgccgtgttcttcctgctgatcatggggcagctcacctggaacgacctgatccggctgtgcatcatggtcggcgcgaacgcctccgaccgcatggggatgggcacgacctacctcgccctgatggccaccttcaagatgcgcccgatgttcgccgtggggctcctgttccggcgcctgaccagccgggaggtgctgctcctgacgatcgggctgtccctcgtcgcgagcgtggagctgcccaactccctggaggagctcggcgacgggctggccatgggcatcatgatcctgaagctcctgaccgacttccagagccaccagctgtgggccaccctcctgtccctgaccttcatcaagacgaccttcagcctccactacgcctggaagaccatggcgatggtcctgtccatcgtgagcctgttccccctctgcctgtccaccacgagccagaagaccacctggctgcccgtgctcctgggctccctggggtgcaagccgctcaccatgttcctgatcgccgagaacaagatctggggccgcaagagctggcccctgaacgaggggatcatggccgtcggcatcgtgagcatcctcctgtccagcctgctcaagaacgacgtgcccctggccgggcccctgatcgccggcggcatgctcatcgcgtgctacgtcatctccgggagctccgccgacctgagcctggagaaggccgccgaggtgtcctgggaggaggaggccgagcacagcggcgcgtcccacaacatcctcgtggaggtccaggacgacgggacgatgaagatcaaggacgaggagcgggacgacaccctgaccatcctgctcaaggccaccctgctggccgtgagcggcgtgtacccgctctccatccccgccaccctgttcgtctggtacttctggcagaagaagaagcagcgcagcggggtgctgtgggacacgcccagcccgcccgaggtggagcgggccgtcctcgacgacggcatctaccgcatcatgcagcggggcctgctggggcgcagccaggtgggcgtgggggtcttccaggagaacgtgttccacaccatgtggcacgtgacccggggcgcggtcctgatgtaccaggggaagcgcctcgagccctcctgggccagcgtgaagaaggacctgatctcctacggcggcgggtggcggctgcagggcagctggaacaccggggaggaggtgcaggtcatcgccgtggagcccggcaagaaccccaagaacgtgcagacggcccccgggaccttcaagacctccgagggcgaggtcggcgccatcgcgctcgacttcaagcccgggaccagcggcagccccatcgtgaaccgcgaggggaagatcgtgggcctgtacggcaacggggtcgtgacgacctccggcacctacgtgagcgccatcgcccaggccaaggcgtcccaggaggggcccctgccggagatcgaggacgaggtcttccggaagcgcaacctcaccatcatggacctgcaccccggcagcgggaagacgcggcgctacctgcccgccatcgtgcgggaggccatcaagcgcaagctccggaccctgatcctggccccgacccgcgtggtcgcctccgagatggcggaggccctcaagggcatgcccatccgctaccagaccacggccgtcaagagcgagcacaccggcaaggagatcgtggacctgatgtgccacgccaccttcaccatgcggctgctctcccccgtccgcgtgcccaactacaacatgatcatcatggacgaggcccacttcacggacccgagctccatcgcggcccgggggtacatcagcacccgcgtgggcatgggggaggccgccgccatcttcatgaccgcgacgccgcccggctccgtcgaggccttcccccagagcaacgccgtgatccaggacgaggagcgggacatcccggagcgctcctggaacagcgggtacgagtggatcacggacttccccggcaagaccgtgtggttcgtcccctccatcaagagcggcaacgacatcgccaactgcctgcggaagaacgggaagcgcgtgatccagctgtcccggaagaccttcgacaccgagtaccagaagacgaagaacaacgactgggactacgtggtcaccaccgacatcagcgagatgggcgcgaacttccgcgccgaccgggtgatcgacccccgccggtgcctcaagccggtgatcctgaaggacgggcccgagcgcgtcatcctggccggccccatgcccgtgaccgtcgcctccgccgcgcagcggcgcgggcggatcggccgcaaccacaacaaggagggcgaccagtacatctacatggggcagccgctcaacaacgacgaggaccacgcccactggacggaggccaagatgctgctggacaacatcaacacccccgagggcatcatccccgccctcttcgagcccgagcgggagaagtccgccgcgatcgacggggagtaccgcctgcgcggcgaggcccggaagaccttcgtggagctgatgcgccgcggggacctcccggtgtggctgagctacaaggtcgcctccgagggcttccagtacagcgaccgccggtggtgcttcgacggcgagcgcaacaaccaggtgctggaggagaacatggacgtggagatctggaccaaggagggggagcggaagaagctccgcccccggtggctggacgcccgcacgtactccgaccccctggccctccgggagttcaaggagttcgcggccggccgccggagcgtctccggggacctgatcctggagatcggcaagctcccccagcacctgacccagcgcgcccagaacgccctggacaacctcgtgatgctgcacaacagcgagcagggcgggcgggcgtaccgccacgccatggaggagctgccggacaccatcgagaccctcatgctgctggccctcatcgccgtgctgacgggcggggtcaccctgttcttcctctccggccgggggctgggcaagaccagcatcggcctgctctgcgtgatggcctccagcgtgctgctgtggatggcgtccgtcgagccccactggatcgccgccagcatcatcctcgagttcttcctgatggtgctgctcatccccgagcccgaccgccagcggaccccgcaggacaaccagctggcctacgtggtcatcgggctcctcttcatgatcctgaccgtggccgcgaacgagatgggcctgctcgagacgaccaagaaggacctggggatcggccacgtggccgtcgagaaccaccaccacgccgccatgctggacgtggacctccaccccgcctccgcgtggaccctgtacgccgtggccaccacgatcatcacccccatgatgcgccacaccatcgagaacaccacggccaacatcagcctgaccgccatcgcgaaccaggccgccatcctcatggggctggacaagggctggccgatctccaagatggacatcggcgtccccctgctcgccctggggtgctacagccaggtgaaccccctgaccctcaccgcggccgtgctgatgctggtcgcccactacgccatcatcggccccgggctccaggccaaggcgacgcgggaggcccagaagcgcaccgccgccggcatcatgaagaacccgaccgtggacgggatcgtggccatcgacctggaccccgtcgtgtacgacgcgaagttcgagaagcagctgggccagatcatgctcctgatcctgtgcacctcccagatcctcctgatgcgcacgacctgggccctgtgcgagagcatcaccctcgccaccggccccctgacgaccctgtgggaggggtcccccggcaagttctggaacaccaccatcgccgtgagcatggccaacatcttccgggggagctacctcgcgggcgccggcctggccttctccctgatgaagtccctcgggggcgggcgccggggcacgggggcccagggcgagaccctgggcgagaagtggaagcgccagctgaaccagctctccaagagcgagttcaacacctacaagcggtccgggatcatggaggtcgaccgcagcgaggcgaaggagggcctgaagcgcggggagaccacgaagcacgccgtgtcccgcggcaccgccaagctgcggtggttcgtggagcgcaacctcgtcaagccggaggggaaggtgatcgacctgggctgcggccgcggcgggtggagctactactgcgccgggctgaagaaggtgaccgaggtcaaggggtacaccaagggcgggcccggccacgaggagcccatccccatggccacgtacgggtggaacctggtgaagctccactccggcaaggacgtgttcttcatcccgcccgagaagtgcgacaccctgctgtgcgacatcggggagagctcccccaaccccaccatcgaggagggccgcaccctccgggtcctgaagatggtggagccgtggctgcgcgggaaccagttctgcatcaagatcctcaacccctacatgcccagcgtggtcgagacgctggagcagatgcagcggaagcacggcggcatgctggtgcgcaaccccctctcccggaacagcacccacgagatgtactgggtgtcctgcgggaccggcaacatcgtcagcgcggtgaacatgacctcccgcatgctgctgaaccggttcaccatggcccaccgcaagccgacgtacgagcgcgacgtggacctcggggccggcacccggcacgtcgccgtggagcccgaggtggccaacctggacatcatcggccagcgcatcgagaacatcaagcacgagcacaagagcacctggcactacgacgaggacaacccctacaagacctgggcgtaccacgggtcctacgaggtcaagcccagcggcagcgcctccagcatggtgaacggggtcgtgaagctgctcacgaagccgtgggacgtgatccccatggtcacccagatcgccatgaccgacaccacgcccttcggccagcagcgggtgttcaaggagaaggtggacacccgcacccccaaggccaagcgggggaccgcccagatcatggaggtcacggcgaagtggctgtggggcttcctgtcccgcaacaagaagccgcggatctgcacccgcgaggagttcacccggaaggtgcgcagcaacgccgccatcggcgccgtgttcgtcgacgagaaccagtggaactccgcgaaggaggccgtggaggacgagcggttctgggacctcgtgcaccgcgagcgggagctgcacaagcaggggaagtgcgcgacctgcgtctacaacatgatgggcaagcgcgagaagaagctgggggagttcggcaaggccaaggggagccgggccatctggtacatgtggctcggcgcgcgcttcctggagttcgaggccctgggcttcatgaacgaggaccactggttctcccgggagaacagcctctccggggtggagggcgaggggctgcacaagctgggctacatcctccgcgacatcagcaagatccccgggggcaacatgtacgccgacgacacggccggctgggacacccggatcaccgaggacgacctgcagaacgaggccaagatcaccgacatcatggagcccgagcacgcgctgctcgccaagtccatcttcaagctgacgtaccagaacaaggtggtccgcgtgcagcggccggccaagaacgggaccgtgatggacgtcatcagccgccgcgaccagcggggctccggccaggtgggcacctacggcctgaacaccttcacgaacatggaggcccagctcatccgccagatggagagcgaggggatcttctcccccagcgagctggagacccccaacctggccggccgggtgctcgactggctggagaagcacggggtcgagcgcctgaagcggatggcgatctccggcgacgactgcgtggtgaagcccatcgacgaccgcttcgccaccgccctcaccgccctgaacgacatggggaaggtccggaaggacgtgccgcagtgggagcccagcaagggctggaacgactggcagcaggtccccttctgcagccaccacttccaccagctgatcatgaaggacggccgcgagatcgtcgtgccctgccggaaccaggacgagctcgtggggcgcgcccgggtctcccagggcgcggggtggagcctgcgcgagacggcctgcctgggcaagtcctacgcccagatgtggcagctcatgtacttccaccggcgcgacctgcggctggccgcgaacgccatctgcagcgccgtgccggtggactgggtccccacctcccgcaccacctggagcatccacgcccaccaccagtggatgacgaccgaggacatgctctccgtgtggaaccgggtgtggatcgaggagaacccctggatggaggacaagacccacatcagctcctggggcgacgtcccctacctgggcaagcgcgaggaccagtggtgcggcagcctgatcgggctcaccgcccgggcgacgtgggccaccaacatccaggtggccatcaaccaggtgcgccgcctgatcggcaacgagaactacctggactacatgacctccatgaagcggttcaagaacgagagcgacccggagggggccctctggtga

SEQ ID NO: 8570 - RNA, 9879 nt, synthetic construct
  misc_feature 1..9879: note = derived and/or modified CDS sequence (opt1) from DENV-1__FJ898404__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgcgggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtgacctacgggacctgcagccagacgggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccgtgggcggcgtgttcaccagcgtcgggaagctggtgcaccagatcttcggcaccgcctacggggtcctgttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggccgactccgggtgcgtcatcaactggaagggccgggagctcaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctggagaacatcatgtggaagcagatctccaacgagctcaaccacatcctgctggagaacgacatgaagttcaccgtggtggtcggggacgtggtgggcatcctcgcgcaggggaagaagatgatccggccccagcccatggagcacaagtacagctggaagtcctggggcaaggccaagatcatcggcgccgacgtccagaacacgaccttcatcatcgacgggcccaacaccccggagtgccccgacgaccagcgcgcctggaacatctgggaggtggaggactacggcttcgggatcttcaccacgaacatctggctgaagctgcgggacagctacacccaggtgtgcgaccaccgcctcatgtccgcggccatcaaggacagcaaggccgtccacgccgacatgggctactggatcgagtccgagaagaacgagacctggaagctggcccgggcgagcttcatcgaggtgaagacctgcatctggcccaagtcccacacgctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcaccacggtcgtggtggacgagcactgcggcaaccgggggccgtccctgcgcaccaccaccgtcacgggcaagatcatccacgagtggtgctgccggagctgcaccctgccgcccctccgcttcaagggggaggacggctgctggtacgggatggagatccggcccgtgaaggagaaggaggagaacctggtgaagtccatggtcagcgccggcagcggcgaggtggactccttcagcctcgggctgctgtgcatctccatcatgatcgaggaggtgatgcgcagccggtggtcccgcaagatgctcatgaccggcaccctggccgtcttcctgctcctgatcatggggcagctgacgtggaacgacctcatccggctgtgcatcatggtgggcgccaacgcgagcgaccgcatggggatgggcaccacctacctggccctcatggccaccttcaagatgcgcccgatgttcgccgtggggctgctgttccggcgcctcacgtcccgggaggtcctgctgctcaccatcgggctgagcctggtggcctccgtcgagctccccaacagcctggaggagctgggcgacgggctcgcgatgggcatcatgatcctgaagctgctcaccgacttccagtcccaccagctgtgggccaccctgctcagcctgacgttcatcaagaccaccctgtccctccactacgcctggaagaccatggccatggtgctgagcatcgcgtccctgttccccctctgcctgagcacgacctcccagaagaccacctggctgcccgtgctcctgggcagcctggggtgcaagccgctcacgatgttcctgatcaccgagaccaagatctggggccgcaagtcctggcccctgaacgaggggatcatggccgtcggcgtggtgagcatcctcctgagctccctgctcaagaacgacgtccccctggccgggcccctgatcgccggcggcatgctcatcgcctgctacgtgatcagcgggtccagcgcggacctgtccctggagaaggccgccgaggtgagctgggaggaggaggccgagcactccggcgccagccacaacatcctcgtcgtggtgcaggacgacgggaccatgaagatcaaggacgaggagcgggacgacaccctgacgatcctgctcaaggcgaccctgctggccgtctccggcgtgtacccgctcagcatccccgccaccctgttcgtgtggtacttctggcagaagaagaagcagcgctccggggtcctgtgggacacccccagcccgcccgaggtggagcgggccgtgctggacgacggcatctaccgcatcatgcagcggggcctcctggggcgctcccaggtcggcgtgggggtgttccaggagaacgtcttccacacgatgtggcacgtgacccggggcgccgtgctgatgtaccaggggaagcgcctcgagcccagctgggcgtccgtcaagaaggacctgatcagctacggcggcgggtggcggctgcagggctcctggaacaccggggaggaggtccaggtgatcgccgtcgagcccggcaagaaccccaagaacgtgcagaccgcccccgggacgttcaagacccccgagggcgaggtgggcgccatcgccctcgacttcaagcccgggaccagcggctcccccatcgtcaaccgcgaggggaagatcgtgggcctgtacggcaacggggtggtcaccacgagcggcacctacgtgagcgcgatcgcccaggccaaggcctcccaggaggggccgctgcccgagatcgaggacgaggtgttccggaagcgcaacctcaccatcatggacctgcaccccggcagcgggaagacccggcgctacctgccggcgatcgtccgggaggccatcaagcgcaagctccggacgctgatcctggcccccacccgcgtggtggcctccgagatggccgaggcgctcaagggcatgcccatccgctaccagaccaccgccgtcaagagcgagcacacgggcaaggagatcgtggacctgatgtgccacgccaccttcaccatgcggctgctctcccccgtgcgcgtcccgaactacaacatgatcatcatggacgaggcccacttcaccgaccccagctccatcgccgcgcgggggtacatcagcacgcgcgtgggcatgggggaggccgccgccatcttcatgaccgccacgccgcccggctccgtggaggcgttcccgcagagcaacgccgtcatccaggacgaggagcgggacatccccgagcgctcctggaacagcgggtacgagtggatcaccgacttccccggcaagacggtgtggttcgtgccctccatcaagagcggcaacgacatcgccaactgcctgcggaagaacgggaagcgcgtcatccagctgtcccggaagaccttcgacaccgagtaccagaagaccaagaacaacgactgggactacgtggtgacgaccgacatcagcgagatgggcgccaacttccgcgcggaccgggtcatcgacccgcgccggtgcctcaagcccgtgatcctgaaggacgggcccgagcgcgtcatcctggccggccccatgccggtgaccgtggcctccgccgcccagcggcgcgggcggatcggccgcaaccacaacaaggagggcgaccagtacatctacatggggcagcccctcaacaacgacgaggaccacgcgcactggaccgaggccaagatgctgctggacaacatcaacacgcccgagggcatcatccccgccctcttcgagccggagcgggagaagtccgccgccatcgacggggagtaccgcctgcgcggcgaggcgcggaagaccttcgtcgagctgatgcgccgcggggacctccccgtgtggctgtcctacaaggtggccagcgagggcttccagtacagcgaccgccggtggtgcttcgacggcgagcgcaacaaccaggtcctggaggagaacatggacgtggagatctggaccaaggagggggagcggaagaagctccgcccccggtggctggacgcccgcacctactccgaccccctggccctccgggagttcaaggagttcgccgcgggccgccggagcgtgtccggggacctgatcctggagatcggcaagctcccgcagcacctgacgcagcgcgcccagaacgccctggacaacctcgtcatgctgcacaacagcgagcagggcgggcgggcctaccgccacgcgatggaggagctgcccgacaccatcgagaccctcatgctgctggccctcatcgccgtgctgaccggcggggtgaccctgttcttcctctccggccgggggctgggcaagacgagcatcggcctgctctgcgtcatggcctccagcgtgctgctgtggatggcctccgtggagccccactggatcgcggccagcatcatcctcgagttcttcctgatggtcctgctcatccccgagccggaccgccagcggacgccccaggacaaccagctggcctacgtggtgatcgggctcctcttcatgatcctgaccgtcgccgccaacgagatgggcctgctcgagaccacgaagaaggacctggggatcggccacgtggcggtggagaaccaccaccacgccaccatgctggacgtcgacctccaccccgcctccgcctggaccctgtacgccgtggcgaccacgatcatcaccccgatgatgcgccacaccatcgagaacaccacggccaacatcagcctgaccgccatcgccaaccaggccgcgatcctcatggggctggacaagggctggcccatctccaagatggacatcggcgtgcccctgctcgccctggggtgctacagccaggtcaaccccctgaccctcaccgccgccgtgctgatgctggtggcgcactacgccatcatcggcccggggctccaggccaaggccacgcgggaggcccagaagcgcaccgcggccggcatcatgaagaaccccaccgtcgacgggatcgtggccatcgacctggaccccgtggtctacgacgccaagttcgagaagcagctgggccagatcatgctcctgatcctgtgcacctcccagatcctcctgatgcgcacgacctgggccctgtgcgagagcatcaccctcgcgaccggccccctgacgaccctgtgggaggggtccccgggcaagttctggaacaccaccatcgccgtgagcatggccaacatcttccgggggtcctacctcgccggcgccggcctggcgttcagcctgatgaagtccctcgggggcgggcgccggggcacgggggcccagggcgagaccctgggcgagaagtggaagcgccagctgaaccagctctccaagagcgagttcaacatctacaagcggtccgggatcatggaggtggaccgcagcgaggccaaggagggcctgaagcgcggggagaccacccgccacgccgtctcccggggcacggcgaagctgcgctggttcgtggagcggaacctggtgaagcccgaggggaaggtcatcgacctcggctgcggccgcgggggctggagctactactgcgccgggctgaagaaggtgaccgaggtgaagggctacaccaagggcgggcccggccacgaggagcccatcccgatggccacctacgggtggaacctggtcaagctccactccggcaaggacgtgttcttcacgccgcccgagaagtgcgacaccctgctgtgcgacatcggggagagctcccccaacccgaccatcgaggagggccggaccctccgcgtgctgaagatggtcgagccctggctgcgggggaaccagttctgcatcaagatcctcaacccctacatgcccagcgtggtggagaccctggagcagatgcagcgcaagcacggcggcatgctggtccggaacccgctctcccgcaacagcacgcacgagatgtactgggtgtcctgcgggaccggcaacatcgtgagcgccgtcaacatgacctcccggatgctgctgaaccgcttcaccatggcccaccgcaagcccacgtacgagcgggacgtggacctcggggcgggcacccgccacgtggccgtcgagcccgaggtggccaacctggacatcatcggccagcggatcgagaacatcaagcacgagcacaagagcacctggcactacgacgaggacaacccctacaagacctgggcctaccacgggtcctacgaggtcaagccgagcggctccgccagcagcatggtgaacggggtggtcaagctgctcacgaagccctgggacgtgatccccatggtgacccagatcgcgatgaccgacaccacgcccttcggccagcagcgcgtcttcaaggagaaggtggacacccggaccccgaaggccaagcgcgggaccgcccagatcatggaggtgacggcccggtggctgtggggcttcctgtcccgcaacaagaagccccggatctgcacccgcgaggagttcacccggaaggtccgcagcaacgccgcgatcggcgccgtgttcgtggacgagaaccagtggaactccgccaaggaggccgtcgaggacgagcggttctgggacctcgtgcagaaggagcgcgagctgcacaagcaggggaagtgcgcgacctgcgtgtacaacatgatgggcaagcgggagaagaagctgggggagttcggcaaggccaaggggagccgcgccatctggtacatgtggctcggcgcccggttcctggagttcgaggccctgggcttcatgaacgaggaccactggttctcccgcgagaacagcctctccggggtcgagggcgaggggctgcacaagctgggctacatcctccgggacatcagcaagatccccgggggcaacatgtacgcggacgacacggccggctgggacacccgcatcaccgaggacgacctgcagaacgaggccaagatcaccgacatcatggagccggagcacgccctgctcgccacgtccatcttcaagctgacctaccagaacaaggtggtgcgggtccagcgccccgcgaagaacgggaccgtgatggacgtgatcagccgccgggaccagcgcggctccgggcaggtcggcacctacggcctgaacacgttcaccaacatggaggcccagctcatccggcagatggagagcgaggggatcttcctgccctccgagctggagacccccaacctcgccgagcgcgtgctggactggctggagaagtacggcgtggagcggctcaagcgcatggccatcagcggggacgactgcgtcgtgaagccgatcgacgaccggttcgccaccgcgctgacggccctgaacgacatgggcaaggtgcgcaaggacatcccccagtgggagccctccaaggggtggaacgactggcagcaggtccccttctgcagccaccacttccaccagctcatcatgaaggacggccgggagatcgtggtgccgtgccgcaaccaggacgagctggtcggccgggcccgcgtgtcccagggggccggctggagcctgcgggagaccgcctgcctcggcaagagctacgcgcagatgtggcagctgatgtacttccaccgccgggacctgcgcctcgccgccaacgccatctgctccgcggtgcccgtcgactgggtgcccaccagccggaccacgtggtccatccacgcccaccaccagtggatgaccaccgaggacatgctgagcgtgtggaaccgcgtctggatcgaggagaacccctggatggaggacaagacccacgtgtccagctggggcgacgtgccgtacctggggaagcgggaggaccagtggtgcggctccctcatcggcctgaccgcccgcgccacgtgggccagcaacatccaggtcgcgatcaaccaggtgcgccggctgatcgggaacgagaactacctcgactacatgacctccatgaagcgcttcaagaacgagggcgaccccgagggggccctgtggtga

SEQ ID NO: 8571 - RNA, 9879 nt, synthetic construct
  misc_feature 1..9879: note = derived and/or modified CDS sequence (opt1) from DENV-1__GQ199840__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagaccagcgccggggtgaacatgtgcaccctcatcgccatggacctgggcgagttctgcgaggacaccatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtcgagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggaccagcggggcctccaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctcgtccagatcaagtacgagggcaccgacgccccctgcaagatccccttctccacccaggacgagaagggggtgacccagaacggccggctgatcacggccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacaccgcctgggacttcgggagcatcggcggcgtgttcacgtccgtcgggaagctggtgcaccagatcttcggcaccgcctacggggtgctgttcagcggcgtctcctggaccatgaagatcgggatcggcgtgctcctgacctggctgggcctcaacagccgctccacgagcctgtccatgacctgcatcgccgtggggctggtcaccctctacctgggcgtgatggtgcaggccgacagcgggtgcgtcatcaactggaagggccgggagctgaagtgcgggagcggcatcttcgtgaccaacgaggtgcacacgtggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagttcaccgtggtggtcggggacgtggcgggcatcctggcccaggggaagaagatgatccggccccagcccatggagtacaagtactcctggaagtcctggggcaaggccaagatcatcggcgccgacgtgcagaacaccacgttcatcatcgacgggcccaacaccccggagtgccccgacgaccagcgcgcgtggaacatctgggaggtcgaggactacggcttcgggatcttcaccaccaacatctggctcaagctgcgggactcctacacccaggtgtgcgaccaccgcctgatgagcgccgccatcaaggactccaaggccgtgcacgccgacatgggctactggatcgagagcgagaagaacgagacctggaagctcgcgcgggcctccttcatcgaggtcaagacctgcatctggcccaagagccacaccctgtggtccaacggcgtgctggagagcgagatgatcatccccaagatctacgggggcccgatctcccagcacaactaccgccccgggtacttcacgcagaccgccggcccctggcacctcgggaagctggagctggacttcgacctctgcgagggcaccaccgtggtcgtggacgagcactgcggcaaccgggggccgagcctgcgcacgaccaccgtgaccggcaagatcatccacgagtggtgctgccggtcctgcacgctgccgcccctgcgcttcaagggggaggacggctgctggtacgggatggagatccggcccgtcaaggagaaggaggagaacctggtcaagagcatggtgagcgccggctccggcgaggtcgacagcttctccctggggctcctgtgcatcagcatcatgatcgaggaggtgatgcgctcccggtggagccgcaagatgctgatgaccggcaccctcgccgtgttcttcctgctgatcaccgggcagctcacgtggaacgacctgatccggctgtgcatcatggtcggcgcgaacgcctccgaccgcatggggatgggcaccacctacctcgccctgatggccaccttcaagatgcgcccgatgttcgccgtgggcctcctgttccggcgcctgacgagccgggaggtgctgctcctgaccatcgggctgtccctcgtcgcgagcgtggagctgcccaactccctggaggagctcggcgacgggctggccatgggcatcatgatcctgaagctcctgaccgacttccagagccaccagctgtgggccaccctcctgtccctgacgttcatcaagaccaccttcagcctccactacgcctggaagaccatggcgatggtcctgtccatcgtgagcctgttccccctctgcctgtccacgaccagccagaagaccacctggctgcccgtgctcctgggctccctggggtgcaagccgctcacgatgttcctgatcgccgagaacaagatctggggccgcaagagctggcccctgaacgaggggatcatggccgtcggcatcgtgagcatcctcctgtccagcctgctcaagaacgacgtgcccctggccgggcccctgatcgccggcggcatgctcatcgcgtgctacgtcatctccgggagctccgccgacctgagcctggagaaggccgccgaggtgtcctgggaggaggaggccgagcacagcggcgcgtcccacaacatcctcgtggaggtccaggacgacgggaccatgaagatcaaggacgaggagcgggacgacaccctgaccatcctgctcaaggccaccctgctggccgtgagcggcgtgtacccgctctccatccccgccacgctgttcgtctggtacttctggcagaagaagaagcagcgcagcggggtgctgtgggacatccccagcccgcccgaggtggagcgggccgtcctcgacgacggcatctaccgcatcatgcagcggggcctgctggggcgcagccaggtgggcgtgggggtcttccaggagaacgtgttccacaccatgtggcacgtgacccggggcgcggtcctgatgtaccaggggaagcgcctcgagccctcctgggccagcgtgaagaaggacctgatctcctacggcggcgggtggcggctgcagggcagctggaacaccggggaggaggtgcaggtcatcgccgtggagcccggcaagaaccccaagaacgtgcagacggcccccgggaccttcaagacctccgagggcgaggtcggcgccatcgcgctcgacttcaagcccgggaccagcggcagccccatcgtgaaccgcgaggggaagatcgtgggcctgtacggcaacggggtcgtgacgacctccggcacctacgtgagcgccatcgcccaggccaaggcgtcccaggaggggcccctgccggagatcgaggacgaggtcttccggaagcgcaacctcaccatcatggacctgcaccccggcagcgggaagacgcggcgctacctgcccgccatcgtgcgggaggccatcaagcgcaagctccggaccctgatcctggccccgacccgcgtggtcgcctccgagatggcggaggccctcaagggcatgcccatccgctaccagaccacggccgtcaagagcgagcacaccggcaaggagatcgtggacctgatgtgccacgccaccttcaccatgcggctgctctcccccgtccgcgtgcccaactacaacatgatcatcatggacgaggcccacttcacggacccgagctccatcgcggcccgggggtacatcagcacccgcgtgggcatgggggaggccgccgccatcttcatgaccgcgacgccgcccggctccgtcgaggccttcccccagagcaacgccgtgatccaggacgaggagcgggacatcccggagcgctcctggaacagcgggtacgagtggatcacggacttccccggcaagaccgtgtggttcgtcccctccatcaagagcggcaacgacatcgccaactgcctgcggaagaacgggaagcgcgtgatccagctgtcccggaagaccttcgacaccgagtaccagaagacgaagaacaacgactgggactacgtggtcaccaccgacatcagcgagatgggcgcgaacttccgcgccgaccgggtgatcgacccccgccggtgcctcaagccggtgatcctgaaggacgggcccgagcgcgtcatcctggccggccccatgcccgtgaccgtcgcctccgccgcgcagcggcgcgggcggatcggccgcaaccacaacaaggagggcgaccagtacatctacatggggcagccgctcaacaacgacgaggaccacgcccactggacggaggccaagatgctgctggacaacatcaacacccccgagggcatcatccccgccctcttcgagcccgagcgggagaagtccgccgcgatcgacggggagtaccgcctgcgcggcgaggcccggaagaccttcgtggagctgatgcgccgcggggacctcccggtgtggctgagctacaaggtcgcctccgagggcttccagtacagcgaccgccggtggtgcttcgacggcgagcgcaacaaccaggtgctggaggagaacatggacgtggagatctggaccaaggagggggagcggaagaagctccgcccccggtggctggacgcccgcacgtactccgaccccctggccctccgggagttcaaggagttcgcggccggccgccggagcgtctccggggacctgatcctggagatcggcaagctcccccagcacctgacccagcgcgcccagaacgccctggacaacctcgtgatgctgcacaacagcgagcagggcgggcgggcgtaccgccacgccatggaggagctgccggacaccatcgagaccctcatgctgctggccctcatcgccgtgctgacgggcggggtcaccctgttcttcctctccggccgggggctgggcaagaccagcatcggcctgctctgcgtgatggcctccagcgtgctgctgtggatggcgtccgtcgagccccactggatcgccgccagcatcatcctcgagttcttcctgatggtgctgctcatccccgagcccgaccgccagcggaccccgcaggacaaccagctggcctacgtggtcatcgggctcctcttcatgatcctgaccgtggccgcgaacgagatgggcctgctcgagacgaccaagaaggacctggggatcggccacgtggccgccgagaaccaccaccacgccgccatgctggacgtcgacctccaccccgcgtccgcctggaccctgtacgccgtggccaccacgatcatcacccccatgatgcgccacaccatcgagaacaccacggccaacatcagcctgaccgcgatcgccaaccaggccgccatcctcatggggctggacaagggctggccgatctccaagatggacatcggcgtgcccctgctcgcgctggggtgctacagccaggtcaaccccctgaccctcaccgccgccgtgctgatgctggtggcccactacgccatcatcggccccgggctccaggcgaaggccacgcgggaggcccagaagcgcaccgccgccggcatcatgaagaacccgaccgtcgacgggatcgtggcgatcgacctggaccccgtggtctacgacgccaagttcgagaagcagctgggccagatcatgctcctgatcctgtgcacctcccagatcctcctgatgcgcacgacctgggccctgtgcgagagcatcaccctcgccaccggccccctgacgaccctgtgggaggggtcccccggcaagttctggaacaccaccatcgccgtgagcatggcgaacatcttccgggggagctacctcgccggcgccggcctggccttctccctgatgaagtccctcgggggcgggcgccggggcacgggggcgcagggcgagaccctgggcgagaagtggaagcgccagctgaaccagctctccaagagcgagttcaacacctacaagcggtccgggatcatggaggtggaccgcagcgaggccaaggagggcctgaagcgcggggagaccacgaagcacgccgtctcccgcggcaccgccaagctgcggtggttcgtggagcgcaacctcgtgaagccggaggggaaggtcatcgacctgggctgcggccgcggcgggtggagctactactgcgccgggctgaagaaggtgaccgaggtgaaggggtacaccaagggcgggcccggccacgaggagcccatccccatggcgacgtacgggtggaacctggtcaagctccactccggcaaggacgtgttcttcatcccgcccgagaagtgcgacaccctgctgtgcgacatcggggagagctcccccaaccccaccatcgaggagggccgcaccctccgggtgctgaagatggtcgagccgtggctgcgcgggaaccagttctgcatcaagatcctcaacccctacatgcccagcgtggtggagacgctggagcagatgcagcggaagcacggcggcatgctggtccgcaaccccctctcccggaacagcacccacgagatgtactgggtgtcctgcgggaccggcaacatcgtgagcgccgtcaacatgacctcccgcatgctgctgaaccggttcaccatggcccaccgcaagccgacgtacgagcgcgacgtggacctcggggccggcacccggcacgtggccgtcgagcccgaggtggcgaacctggacatcatcggccagcgcatcgagaacatcaagcacgagcacaagagcacctggcactacgacgaggacaacccctacaagacctgggcctaccacgggtcctacgaggtgaagcccagcggcagcgcctccagcatggtcaacggggtggtcaagctgctcacgaagccgtgggacgtgatccccatggtgacccagatcgccatgaccgacaccacgcccttcggccagcagcgggtcttcaaggagaaggtggacacccgcacccccaaggccaagcgggggaccgcgcagatcatggaggtgacggccaagtggctgtggggcttcctgtcccgcaacaagaagccgcggatctgcacccgcgaggagttcacccggaaggtccgcagcaacgccgccatcggcgcggtgttcgtggacgagaaccagtggaactccgccaaggaggccgtcgaggacgagcggttctgggacctcgtgcaccgcgagcgggagctgcacaagcaggggaagtgcgcgacctgcgtgtacaacatgatgggcaagcgcgagaagaagctgggggagttcggcaaggccaaggggagccgggcgatctggtacatgtggctcggcgcccgcttcctggagttcgaggccctgggcttcatgaacgaggaccactggttctcccgggagaacagcctctccggggtcgagggcgaggggctgcacaagctgggctacatcctccgcgacatcagcaagatccccgggggcaacatgtacgccgacgacacggccggctgggacacccggatcaccgaggacgacctgcagaacgaggcgaagatcaccgacatcatggagcccgagcacgccctgctcgccaagtccatcttcaagctgacgtaccagaacaaggtggtgcgcgtccagcggccggccaagaacgggaccgtgatggacgtgatcagccgccgcgaccagcggggctccgggcaggtcggcacctacggcctgaacaccttcacgaacatggaggcccagctcatccgccagatggagagcgaggggatcttctcccccagcgagctggagacccccaacctggcgggccgggtgctcgactggctggagaagtacggggtggagcgcctgaagcggatggccatctccggcgacgactgcgtcgtgaagcccatcgacgaccgcttcgccaccgccctcaccgccctgaacgacatggggaaggtgcggaaggacatcccgcagtgggagcccagcaagggctggaacgactggcagcaggtccccttctgcagccaccacttccaccagctgatcatgaaggacggccgcgagatcgtggtgccctgccggaaccaggacgagctcgtcgggcgcgcgcgggtgtcccagggcgccgggtggagcctgcgcgagacggcctgcctgggcaagtcctacgcccagatgtggcagctcatgtacttccaccggcgcgacctgcggctggcggccaacgccatctgcagcgccgtgccggtcgactgggtgcccacctcccgcaccacctggagcatccacgcccaccaccagtggatgacgaccgaggacatgctctccgtgtggaaccgggtctggatcgaggagaacccctggatggaggacaagacccacatcagctcctggggcgacgtgccctacctgggcaagcgcgaggaccagtggtgcggcagcctgatcgggctcaccgcgcgggccacgtgggccaccaacatccaggtggccatcaaccaggtccgccgcctgatcggcaacgagaactacctggactacatgacctccatgaagcggttcaagaacgagagcgacccggagggggccctctggtga

SEQ ID NO: 8572 - RNA, 9879 nt, synthetic construct
  misc_feature 1..9879: note = derived and/or modified CDS sequence (opt1) from DENV-1__FJ898405__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgcgggggtgaacatgtgcaccctcatcgccatggacctgggggagctgtgcgaggacaccatgacctacaagtgcccccggatcaccgaggccgagcccgacgacgtggactgctggtgcaacgccaccgacacctgggtgacctacgggacctgctcccagacgggggagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccaacatcggcaagatgttcgaggccaccgcccgcggggcccggcgcatggcgatcctgggcgacacggcctgggacttcgggagcatcggcggcgtgttcacctccgtggggaagctggtccaccagatcttcggcaccgcctacggggtcctgttcagcggcgtgtcctggaccatgaagatcgggatcggcgtcctgctgacgtggctcggcctgaacagccgctccaccagcctgtccatgacctgcatcgccgtggggctcgtgaccctgtacctgggcgtcatggtgcaggccgacagcgggtgcgtgatcaactggaagggccgggagctcaagtgcgggtccggcatcttcgtcacgaacgaggtgcacacctggaccgagcagtacaagttccaggcggacagcccgaagcgcctgagcgccgccatcggcaaggcctgggaggagggggtgtgcggcatccggtccgccacccgcctggagaacatcatgtggaagcagatcagcaacgagctcaaccacatcctgctggagaacgacatgaagttcaccgtcgtggtgggggacgtcgtgggcatcctcgcgcaggggaagaagatgatccggccccagcccatggagcacaagtactcctggaagtcctggggcaaggccaagatcatcggcgccgacgtgcagaacacgaccttcatcatcgacgggcccaacaccccggagtgccccgacgaccagcgcgcctggaacatctgggaggtcgaggactacggcttcgggatcttcaccacgaacatctggctgaagctgcgggactcctacacccaggtgtgcgaccaccgcctcatgagcgcggccatcaaggactccaaggccgtgcacgccgacatgggctactggatcgagagcgagaagaacgagacctggaagctggcccgggcgtccttcatcgaggtcaagacctgcatctggcccaagagccacacgctgtggtccaacggcgtgctcgagagcgagatgatcatccccaagatctacgggggcccgatctcccagcacaactaccgccccgggtacttcacccagaccgccggcccctggcacctggggaagctggagctcgacttcgacctgtgcgagggcaccacggtggtcgtggacgagcactgcggcaaccgggggccgagcctgcgcaccaccaccgtgacgggcaagatcatccacgagtggtgctgccggtcctgcaccctgccgcccctccgcttcaagggggaggacggctgctggtacgggatggagatccggcccgtcaaggagaaggaggagaacctggtcaagagcatggtgtccgccggcagcggcgaggtcgacagcttctccctcgggctgctgtgcatcagcatcatgatcgaggaggtgatgcgctcccggtggagccgcaagatgctcatgaccggcaccctggccgtgttcctgctcctgatcatggggcagctgacgtggaacgacctcatccggctgtgcatcatggtcggcgccaacgcgtccgaccgcatggggatgggcaccacctacctggccctcatggccaccttcaagatgcgcccgatgttcgccgtgggcctgctgttccggcgcctcacgagccgggaggtgctgctgctcaccatcgggctgtccctggtcgccagcgtggagctccccaactccctggaggagctgggcgacgggctcgcgatgggcatcatgatcctgaagctgctcaccgacttccagagccaccagctgtgggccaccctgctctccctgacgttcatcaagaccaccctgagcctccactacgcctggaagaccatggccatggtcctgtccatcgtgagcctgttccccctctgcctgtccacgaccagccagaagaccacctggctgcccgtgctcctgggctccctggggtgcaagccgctcacgatgttcctgatcgcggagaacaagatctggggccgcaagagctggcccctgaacgaggggatcatggccgtcggcgtggtgtccatcctcctgagcagcctgctcaagaacgacgtccccctggccgggcccctgatcgccggcggcatgctcatcgcctgctacgtgatctccgggagctccgcggacctgagcctggagaaggccgccgaggtgtcctgggaggaggaggccgagcacagcggcgcctcccacaacatcctcgtcgaggtgcaggacgacgggaccatgaagatcaaggacgaggagcgggacgacaccctgaccatcctgctcaaggcgaccctgctggccgtgagcggcgtctacccgctctccatccccgccacgctgttcgtgtggtacttctggcagaagaagaagcagcgcagcggggtgctgtgggacacccccagcccgcccgaggtcgagcgggccgtgctggacgacggcatctaccgcatcatgcagcggggcctcctggggcgcagccaggtgggcgtcggggtgttccaggagaacgtgttccacaccatgtggcacgtcacccggggcgccgtgctgatgtaccaggggaagcgcctcgagccctcctgggcgagcgtgaagaaggacctgatctcctacggcggcgggtggcggctgcagggcagctggaacacgggggaggaggtccaggtgatcgccgtggagcccggcaagaaccccaagaacgtccagaccgcccccgggaccttcaagacccccgagggcgaggtgggcgccatcgccctcgacttcaagcccgggacgtccggcagccccatcgtgaaccgcgaggggaagatcgtcggcctgtacggcaacggggtggtgaccacctccggcacctacgtcagcgcgatcgcccaggccaaggccagccaggaggggccgctgcccgagatcgaggacgaggtgttccggaagcgcaacctcacgatcatggacctgcaccccggctccgggaagacccggcgctacctgccggcgatcgtgcgggaggccatcaagcgcaagctccggaccctgatcctggcccccacccgcgtcgtggccagcgagatggccgaggcgctcaagggcatgcccatccgctaccagacgaccgccgtgaagtccgagcacaccggcaaggagatcgtcgacctgatgtgccacgccaccttcacgatgcggctgctcagccccgtgcgcgtgccgaactacaacatgatcatcatggacgaggcccacttcaccgacccctccagcatcgccgcgcgggggtacatctccacccgcgtcggcatgggggaggccgccgccatcttcatgaccgccacgccgcccggcagcgtggaggcgttcccgcagtccaacgccgtgatccaggacgaggagcgggacatccccgagcgcagctggaactccgggtacgagtggatcaccgacttccccggcaagaccgtctggttcgtgcccagcatcaagtccggcaacgacatcgccaactgcctgcggaagaacgggaagcgcgtgatccagctgagccggaagaccttcgacacggagtaccagaagaccaagaacaacgactgggactacgtcgtgaccaccgacatctccgagatgggcgccaacttccgcgcggaccgggtgatcgacccgcgccggtgcctcaagcccgtcatcctgaaggacgggcccgagcgcgtgatcctggccggccccatgccggtcacggtggccagcgccgcccagcggcgcgggcggatcggccgcaaccacaacaaggagggcgaccagtacatctacatggggcagcccctcaacaacgacgaggaccacgcgcactggaccgaggccaagatgctgctggacaacatcaacacccccgagggcatcatccccgccctcttcgagccggagcgggagaagtccgccgccatcgacggggagtaccgcctgcgcggcgaggcgcggaagaccttcgtggagctgatgcgccgcggggacctccccgtctggctgagctacaaggtggcctccgagggcttccagtacagcgaccgccggtggtgcttcgacggcgagcgcaacaaccaggtgctggaggagaacatggacgtcgagatctggacgaaggagggggagcggaagaagctccgcccccggtggctggacgcccgcacctacagcgaccccctggccctccgggagttcaaggagttcgccgcgggccgccggtccgtgagcggggacctgatcctggagatcggcaagctcccgcagcacctgacccagcgcgcccagaacgccctggacaacctcgtgatgctgcacaactccgagcagggcgggcgggcctaccgccacgcgatggaggagctgcccgacaccatcgagacgctcatgctgctggccctcatcgccgtcctgaccggcggggtgaccctgttcttcctcagcggccgggggctgggcaagacctccatcggcctgctctgcgtgatggccagctccgtcctgctgtggatggccagcgtggagccccactggatcgcggcctccatcatcctcgagttcttcctgatggtgctgctcatccccgagccggaccgccagcggacgccccaggacaaccagctggcctacgtcgtgatcgggctcctcttcatgatcctgacggtggccgccaacgagatgggcctgctcgagaccaccaagaaggacctggggatcggccacgtcgcggtggagaaccaccaccacgccaccatgctggacgtggacctccaccccgccagcgcctggacgctgtacgccgtcgcgaccaccatcatcaccccgatgatgcgccacacgatcgagaacaccaccgccaacatctccctgaccgccatcgccaaccaggccgcgatcctcatggggctggacaagggctggcccatcagcaagatggacatcggcgtgcccctgctcgccctggggtgctactcccaggtgaaccccctgacgctcaccgccgccgtcctgatgctggtggcgcactacgccatcatcggcccggggctccaggccaaggccacccgggaggcccagaagcgcaccgcggccggcatcatgaagaaccccacggtggacgggatcgtcgccatcgacctggaccccgtggtgtacgacgccaagttcgagaagcagctgggccagatcatgctcctgatcctgtgcaccagccagatcctcctgatgcgcaccacctgggccctgtgcgagtccatcacgctcgcgaccggccccctgaccaccctgtgggaggggagcccgggcaagttctggaacacgaccatcgccgtctccatggccaacatcttccgggggagctacctcgccggcgccggcctggcgttctccctgatgaagtccctcgggggcgggcgccggggcaccggggcccagggcgagaccctgggcgagaagtggaagcgccagctgaaccagctcagcaagtccgagttcaacatctacaagcggagcgggatcatggaggtggaccgctccgaggccaaggagggcctgaagcgcggggagacgacccgccacgccgtgagccggggcaccgcgaagctgcgctggttcgtcgagcggaacctggtgaagcccgaggggaaggtgatcgacctcggctgcggccgcgggggctggtcctactactgcgccgggctgaagaaggtcaccgaggtgaagggctacacgaagggcgggcccggccacgaggagcccatcccgatggccacctacgggtggaacctggtgaagctccacagcggcaaggacgtcttcttcacgccgcccgagaagtgcgacaccctgctgtgcgacatcggggagtccagccccaacccgacgatcgaggagggccggaccctccgcgtgctgaagatggtggagccctggctgcgggggaaccagttctgcatcaagatcctcaacccctacatgccctccgtcgtggagaccctggagcagatgcagcgcaagcacggcggcatgctggtgcggaacccgctcagccgcaactccacccacgagatgtactgggtcagctgcgggaccggcaacatcgtgtccgccgtgaacatgacgagccggatgctgctgaaccgcttcaccatggcccaccgcaagcccacctacgagcgggacgtcgacctcggggcgggcacccgccacgtggccgtggagcccgaggtcgccaacctggacatcatcggccagcggatcgagaacatcaagcacgagcacaagtccacgtggcactacgacgaggacaacccctacaagacctgggcctaccacgggagctacgaggtgaagccgtccggcagcgcctccagcatggtcaacggggtggtgaagctgctcaccaagccctgggacgtcatccccatggtgacccagatcgcgatgacggacaccacccccttcggccagcagcgcgtgttcaaggagaaggtcgacacccggacgccgaaggccaagcgcgggaccgcccagatcatggaggtgaccgcccggtggctgtggggcttcctgagccgcaacaagaagccccggatctgcacccgcgaggagttcacgcggaaggtgcgctccaacgccgcgatcggcgccgtcttcgtggacgagaaccagtggaacagcgccaaggaggccgtggaggacgagcggttctgggacctcgtccagaaggagcgcgagctgcacaagcaggggaagtgcgcgacctgcgtgtacaacatgatgggcaagcgggagaagaagctgggggagttcggcaaggccaaggggtcccgcgccatctggtacatgtggctcggcgcccggttcctggagttcgaggccctgggcttcatgaacgaggaccactggttcagccgcgagaactccctcagcggggtggagggcgaggggctgcacaagctgggctacatcctccgggacatctccaagatccccgggggcaacatgtacgcggacgacaccgccggctgggacacccgcatcacggaggacgacctgcagaacgaggccaagatcaccgacatcatggagccggagcacgccctgctcgccaccagcatcttcaagctgacctaccagaacaaggtcgtgcgggtgcagcgccccgcgaagaacgggacggtcatggacgtgatctcccgccgggaccagcgcggcagcggccaggtgggcacctacggcctgaacaccttcaccaacatggaggcccagctcatccggcagatggagtccgaggggatcttcagcccctccgagctggagatccccaacctggccgagcgcgtcctcgactggctggagaagtacggcgtggagcggctgaagcgcatggccatcagcggggacgactgcgtggtcaagccgatcgacgaccggttcgccacggcgctcaccgccctgaacgacatgggcaaggtgcgcaaggacgtgccccagtgggagccctccaaggggtggaacgactggcagcaggtccccttctgcagccaccacttccaccagctgatcatgaaggacggccgggagatcgtggtgccgtgccgcaaccaggacgagctcgtcggccgggcccgcgtgtcccagggggccggctggagcctgcgggagaccgcctgcctgggcaagagctacgcgcagatgtggcagctcatgtacttccaccgccgggacctgcgcctggccgccaacgccatctgctccgcggtgcccgtcgactgggtgcccaccagccggacgacctggtccatccacgcccaccaccagtggatgaccaccgaggacatgctcagcgtgtggaaccgcgtctggatcgaggagaacccctggatggaggacaagacgcacgtgtccagctggggcgacgtgccgtacctggggaagcgggaggaccagtggtgcggctccctgatcggcctcaccgcccgcgccacctgggccagcaacatccaggtcgcgatcaaccaggtgcgccggctgatcgggaacgagaactacctggactacatgacctccatgaagcgcttcaagaacgagggcgaccccgagggggccctctggtga

SEQ ID NO: 8573 - RNA, 9879 nt, synthetic construct
  misc_feature 1..9879: note = derived and/or modified CDS sequence (opt1) from DENV-1__FJ898406__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgcgggggtgaacatgtgcaccctcatcgccatggacctgggggagctgtgcgaggacaccatgacctacaagtgcccccggatcaccgaggccgagcccgacgacgtggactgctggtgcaacgccaccgacacctgggtgacctacgggacctgctcccagacgggggagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccaacatcggcaagatgttcgaggccaccgcccgcggggcccggcgcatggcgatcctgggcgacacggcctgggacttcgggagcatcggcggcgtgttcacctccgtggggaagctggtccaccagatcttcggcaccgcctacggggtcctgttcagcggcgtgtcctggaccatgaagatcgggatcggcgtcctgctgacgtggctcggcctgaacagccgctccaccagcctgtccatgacctgcatcgccgtggggctcgtgaccctgtacctgggcgtcatggtgcaggccgacagcgggtgcgtgatcaactggaagggccgggagctcaagtgcgggtccggcatcttcgtcacgaacgaggtgcacacctggaccgagcagtacaagttccaggcggacagcccgaagcgcctgagcgccgccatcggcaaggcctgggaggagggggtgtgcggcatccggtccgccacccgcctggagaacatcatgtggaagcagatcagcaacgagctcaaccacatcctgctggagaacgacatgaagttcaccgtcgtggtgggggacgtcgtgggcatcctcgcgcaggggaagaagatgatccggccccagcccatggagcacaagtactcctggaagtcctggggcaaggccaagatcatcggcgccgacgtgcagaacacgaccttcatcatcgacgggcccaacaccccggagtgccccgacgaccagcgcgcctggaacatctgggaggtcgaggactacggcttcgggatcttcaccacgaacatctggctgaagctgcgggactcctacacccaggtgtgcgaccaccgcctcatgagcgcggccatcaaggactccaaggccgtgcacgccgacatgggctactggatcgagagcgagaagaacgagacctggaagctggcccgggcgtccttcatcgaggtcaagacctgcatctggcccaagagccacacgctgtggtccaacggcgtgctcgagagcgagatgatcatccccaagatctacgggggcccgatctcccagcacaactaccgccccgggtacttcacccagaccgccggcccctggcacctggggaagctggagctcgacttcgacctgtgcgagggcaccacggtggtcgtggacgagcactgcggcaaccgggggccgagcctgcgcaccaccaccgtgacgggcaagatcatccacgagtggtgctgccggtcctgcaccctgccgcccctccgcttcaagggggaggacggctgctggtacgggatggagatccggcccgtcaaggagaaggaggagaacctggtcaagagcatggtgtccgccggcagcggcgaggtcgacagcttctccctcgggctgctgtgcatcagcatcatgatcgaggaggtgatgcgctcccggtggagccgcaagatgctcatgaccggcaccctggccgtgttcctgctcctgatcatggggcagctgacgtggaacgacctcatccggctgtgcatcatggtcggcgccaacgcgtccgaccgcatggggatgggcaccacctacctggccctcatggccaccttcaagatgcgcccgatgttcgccgtgggcctgctgttccggcgcctcacgagccgggaggtgctgctgctcaccatcgggctgtccctggtcgccagcgtggagctccccaactccctggaggagctgggcgacgggctcgcgatgggcatcatgatcctgaagctgctcaccgacttccagagccaccagctgtgggccaccctgctctccctgacgttcatcaagaccaccctgagcctccactacgcctggaagaccatggccatggtcctgtccatcgtgagcctgttccccctctgcctgtccacgaccagccagaagaccacctggctgcccgtgctcctgggctccctggggtgcaagccgctcacgatgttcctgatcgcggagaacaagatctggggccgcaagagctggcccctgaacgaggggatcatggccgtcggcgtggtgtccatcctcctgagcagcctgctcaagaacgacgtccccctggccgggcccctgatcgccggcggcatgctcatcgcctgctacgtgatctccgggagctccgcggacctgagcctggagaaggccgccgaggtgtcctgggaggaggaggccgagcacagcggcgcctcccacaacatcctcgtcgaggtgcaggacgacgggaccatgaagatcaaggacgaggagcgggacgacaccctgaccatcctgctcaaggcgaccctgctggccgtgagcggcgtctacccgctctccatccccgccacgctgttcgtgtggtacttctggcagaagaagaagcagcgcagcggggtgctgtgggacacccccagcccgcccgaggtcgagcgggccgtgctggacgacggcatctaccgcatcatgcagcggggcctcctggggcgcagccaggtgggcgtcggggtgttccaggagaacgtgttccacaccatgtggcacgtcacccggggcgccgtgctgatgtaccaggggaagcgcctcgagccctcctgggcgagcgtgaagaaggacctgatctcctacggcggcgggtggcggctgcagggcagctggaacacgggggaggaggtccaggtgatcgccgtggagcccggcaagaaccccaagaacgtccagaccgcccccgggaccttcaagacccccgagggcgaggtgggcgccatcgccctcgacttcaagcccgggacgtccggcagccccatcgtgaaccgcgaggggaagatcgtcggcctgtacggcaacggggtggtgaccacctccggcacctacgtcagcgcgatcgcccaggccaaggccagccaggaggggccgctgcccgagatcgaggacgaggtgttccggaagcgcaacctcacgatcatggacctgcaccccggctccgggaagacccggcgctacctgccggcgatcgtgcgggaggccatcaagcgcaagctccggaccctgatcctggcccccacccgcgtcgtggccagcgagatggccgaggcgctcaagggcatgcccatccgctaccagacgaccgccgtgaagtccgagcacaccggcaaggagatcgtcgacctgatgtgccacgccaccttcacgatgcggctgctcagccccgtgcgcgtgccgaactacaacatgatcatcatggacgaggcccacttcaccgacccctccagcatcgccgcgcgggggtacatctccacccgcgtcggcatgggggaggccgccgccatcttcatgaccgccacgccgcccggcagcgtggaggcgttcccgcagtccaacgccgtgatccaggacgaggagcgggacatccccgagcgcagctggaactccgggtacgagtggatcaccgacttccccggcaagaccgtctggttcgtgcccagcatcaagtccggcaacgacatcgccaactgcctgcggaagaacgggaagcgcgtgatccagctgagccggaagaccttcgacacggagtaccagaagaccaagaacaacgactgggactacgtcgtgaccaccgacatctccgagatgggcgccaacttccgcgcggaccgggtgatcgacccgcgccggtgcctcaagcccgtcatcctgaaggacgggcccgagcgcgtgatcctggccggccccatgccggtcacggtggccagcgccgcccagcggcgcgggcggatcggccgcaaccacaacaaggagggcgaccagtacatctacatggggcagcccctcaacaacgacgaggaccacgcgcactggaccgaggccaagatgctgctggacaacatcaacacccccgagggcatcatccccgccctcttcgagccggagcgggagaagtccgccgccatcgacggggagtaccgcctgcgcggcgaggcgcggaagaccttcgtggagctgatgcgccgcggggacctccccgtctggctgagctacaaggtggcctccgagggcttccagtacagcgaccgccggtggtgcttcgacggcgagcgcaacaaccaggtgctggaggagaacatggacgtcgagatctggacgaaggagggggagcggaagaagctccgcccccggtggctggacgcccgcacctacagcgaccccctggccctccgggagttcaaggagttcgccgcgggccgccggtccgtgagcggggacctgatcctggagatcggcaagctcccgcagcacctgacccagcgcgcccagaacgccctggacaacctcgtgatgctgcacaactccgagcagggcgggcgggcctaccgccacgcgatggaggagctgcccgacaccatcgagacgctcatgctgctggccctcatcgccgtcctgaccggcggggtgaccctgttcttcctcagcggccgggggctgggcaagacctccatcggcctgctctgcgtgatggccagctccgtcctgctgtggatggccagcgtggagccccactggatcgcggcctccatcatcctcgagttcttcctgatggtgctgctcatccccgagccggaccgccagcggacgccccaggacaaccagctggcctacgtcgtgatcgggctcctcttcatgatcctgacggtggccgccaacgagatgggcctgctcgagaccaccaagaaggacctggggatcggccacgtcgcggtggagaaccaccaccacgccaccatgctggacgtggacctccaccccgccagcgcctggacgctgtacgccgtcgcgaccaccatcatcaccccgatgatgcgccacacgatcgagaacaccaccgccaacatctccctgaccgccatcgccaaccaggccgcgatcctcatggggctggacaagggctggcccatcagcaagatggacatcggcgtgcccctgctcgccctggggtgctactcccaggtgaaccccctgacgctcaccgccgccgtcctgatgctggtggcgcactacgccatcatcggcccggggctccaggccaaggccacccgggaggcccagaagcgcaccgcggccggcatcatgaagaaccccacggtggacgggatcgtcgccatcgacctggaccccgtggtgtacgacgccaagttcgagaagcagctgggccagatcatgctcctgatcctgtgcaccagccagatcctcctgatgcgcaccacctgggccctgtgcgagtccatcacgctcgcgaccggccccctgaccaccctgtgggaggggagcccgggcaagttctggaacacgaccatcgccgtctccatggccaacatcttccgggggagctacctcgccggcgccggcctggcgttctccctgatgaagtccctcgggggcgggcgccggggcaccggggcccagggcgagaccctgggcgagaagtggaagcgccagctgaaccagctcagcaagtccgagttcaacatctacaagcggagcgggatcatggaggtggaccgctccgaggccaaggagggcctgaagcgcggggagacgacccgccacgccgtgagccggggcaccgcgaagctgcgctggttcgtcgagcggaacctggtgaagcccgaggggaaggtgatcgacctcggctgcggccgcgggggctggtcctactactgcgccgggctgaagaaggtcaccgaggtgaagggctacacgaagggcgggcccggccacgaggagcccatcccgatggccacctacgggtggaacctggtgaagctccacagcggcaaggacgtcttcttcacgccgcccgagaagtgcgacaccctgctgtgcgacatcggggagtccagccccaacccgacgatcgaggagggccggaccctccgcgtgctgaagatggtggagccctggctgcgggggaaccagttctgcatcaagatcctcaacccctacatgccctccgtcgtggagaccctggagcagatgcagcgcaagcacggcggcatgctggtgcggaacccgctcagccgcaactccacccacgagatgtactgggtcagctgcgggaccggcaacatcgtgtccgccgtgaacatgacgagccggatgctgctgaaccgcttcaccatggcccaccgcaagcccacctacgagcgggacgtcgacctcggggcgggcacccgccacgtggccgtggagcccgaggtcgccaacctggacatcatcggccagcggatcgagaacatcaagcacgagcacaagtccacgtggcactacgacgaggacaacccctacaagacctgggcctaccacgggagctacgaggtgaagccgtccggcagcgcctccagcatggtcaacggggtggtgaagctgctcaccaagccctgggacgtcatccccatggtgacccagatcgcgatgacggacaccacccccttcggccagcagcgcgtgttcaaggagaaggtcgacacccggacgccgaaggccaagcgcgggaccgcccagatcatggaggtgaccgcccggtggctgtggggcttcctgagccgcaacaagaagccccggatctgcacccgcgaggagttcacgcggaaggtgcgctccaacgccgcgatcggcgccgtcttcgtggacgagaaccagtggaacagcgccaaggaggccgtggaggacgagcggttctgggacctcgtccagaaggagcgcgagctgcacaagcaggggaagtgcgcgacctgcgtgtacaacatgatgggcaagcgggagaagaagctgggggagttcggcaaggccaaggggtcccgcgccatctggtacatgtggctcggcgcccggttcctggagttcgaggccctgggcttcatgaacgaggaccactggttcagccgcgagaactccctcagcggggtggagggcgaggggctgcacaagctgggctacatcctccgggacatctccaagatccccgggggcaacatgtacgcggacgacaccgccggctgggacacccgcatcacggaggacgacctgcagaacgaggccaagatcaccgacatcatggagccggagcacgccctgctcgccaccagcatcttcaagctgacctaccagaacaaggtcgtgcgggtgcagcgccccgcgaagaacgggacggtcatggacgtgatctcccgccgggaccagcgcggcagcggccaggtgggcacctacggcctgaacaccttcaccaacatggaggcccagctcatccggcagatggagtccgaggggatcttcagcccctccgagctggagatccccaacctggccgagcgcgtcctcgactggctggagaagtacggcgtggagcggctgaagcgcatggccatcagcggggacgactgcgtggtcaagccgatcgacgaccggttcgccacggcgctcaccgccctgaacgacatgggcaaggtgcgcaaggacgtgccccagtgggagccctccaaggggtggaacgactggcagcaggtccccttctgcagccaccacttccaccagctgatcatgaaggacggccgggagatcgtggtgccgtgccgcaaccaggacgagctcgtcggccgggcccgcgtgtcccagggggccggctggagcctgcgggagaccgcctgcctgggcaagagctacgcgcagatgtggcagctcatgtacttccaccgccgggacctgcgcctggccgccaacgccatctgctccgcggtgcccgtcgactgggtgcccaccagccggacgacctggtccatccacgcccaccaccagtggatgaccaccgaggacatgctcagcgtgtggaaccgcgtctggatcgaggagaacccctggatggaggacaagacgcacgtgtccagctggggcgacgtgccgtacctggggaagcgggaggaccagtggtgcggctccctgatcggcctcaccgcccgcgccacctgggccagcaacatccaggtcgcgatcaaccaggtgcgccggctgatcgggaacgagaactacctggactacatggcctccatgaagcgcttcaagaacgagggcgaccccgagggggccctctggtga
